United States Patent 6,812,339 (POLYMORPHISMS IN KNOWN GENES ASSOCIATED WITH HUMAN DISEASE, METHODS OF DETECTION AND USES THEREOF) - sequence listing, part 50

SEQ ID NO: 14938 - DNA, 22374 bp, Human
  misc_feature (1)...(22374): n = A,T,C or G
cctcacattgtgaggaggtgaaattggaagtgtcacattgggaaagtatctgtataatgagtctgtaagctgcaaaactctttgtaaatcggaatcaagcactcaggagatctcggtcacttaagcttggttctcacacccgtgcatgcttgcacttgcatgttttttaagacaacagcttttgctttagtagttgggcggtcgcaagtgaacactgtccagtggttcttctggtgcccagactcggaggagatgggactgctctcaatgtgtttgttagaaacgaaactgttcgcactataaccccataaccccttacaatgttcagaaaaaaacaagaaggggcttgaaatacccactagtgtgccgcctgctcagcccatctgggtctgtgaaaccacatctgagccctgtgggctgtggtggcgacacaggcagagggcgggcagggttgccagcgccccgcctgggctaggaacgcctgtgcgcagctccctgagagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaagtaagtgaggtggggagagaaggaagccagtgcctgacactgtggggagtggctgggcaaagcagcattggaggtgttgtagggttcctactgtctgatgagctggtgtggggttcttactgtctgatgtcgtctctggtggaagttagcagggctggggcagatgcacagagcacggtggcgggggtgagcccaggatcggattgatgcccacccaccacctggcaccctgcagtcccagctggccagaaggcaagcatgctggaccacaaagcaaagatcctccagctctgctgctggcaagccttggggccaggggactcacagaagagcaggtttgggcctgtgccttcctcctgcccaaatgggtctctctccccttccccttccagccagggccgcagctggggctgcagcttgagtgacgggaaaagaaaggtttactccaccagcgcattagcggcactcacagcattaaaaatgcaggaggtggtgggaggagcgggccagggaggaaaactcatgcagctgcggggcgcggggaagagccgggcttctgcctcctcagcccggatcagagccgaagaacgagggcagtttgggttgagaaggattctccagtgtaaccgagaagcgagcgtccaggaggctgttggggaggtcggcactgtgggcttcctggccttcgtttgctgtttcgagggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgtgtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtcaagcccggcttccttttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcagaaggggccgggggagctggcgcagggctctctacctagcgctgcaggctcctgggcgattgtagcgggaccgtcacacacaactggcacccaggccaggggtccagagctaaattctgcctgcaggagcggttattgtggcatccgtttctaaaaagtttaaaggcaacattttattttattttaatttttttgagacaagatctgcctctgtcgcccaggctggagtgcagtggcgagatctcagctcactgcaacctgtgcctcccggcttcaagcgattctcagcctcagcctcccgagtagctgggattgcaggcgcccgccaccacgcccggctaatttttttttttctttttgttttgtttgagactcagtctcgctctgttgcccaggctgaagtgcagtggggcgctctcggctcactgcaacctctgcctcccaggttcaagcgattctcctgcctcagcctcccgagtagctgggattacaggagcgtgccaccactccgggctaatttttgtgttttaagtagagatggggtttcaccatgttggtcaggcagatttcgaattcctgacctcaagtgatccacccgcctcggcctttatttacttatttttttttaatagacacggggtcatgttgccagccatgttgcccaggctggtcgtgaactcctgggctcaagtgatcctcccgccttgcccttggccttccaagtgctaggattacaggcgtgagccaccaacaccctgcctgaggcaacattttaaacttggtgtatgttgaaaatttcaaaacccctcagctgtcctgcatcctcatttaggttcctgcttggctcgagtttgagtttacagcccctgcaagtaaatccaagagcctgttacagattggcggtcgtgccttatgaaatctgacttctacttccaggtacagacagtgtttgtgtgttcctgttgtggctaactttaagaagcggtgtttctcagaattgataagaccatggcacaaaactgtgacgattggctttggagtaaccctgtgtgcggttcctattgcacaggtactgtcgtgtgcagtgattcttatctagtgtaccgtgtcctcttgaagtctcaagtgggcggtgaagcattagacaagctaccatagtttttcccagtgctcccatcccttcccccacagtaccggcatcttttcacagttgagcagatatattaatattctcattttgattatctcatttggtaggaacagcacatcaaattgtataaagcgagtagagagaaataagaggatattacagtctatcaacaaagtagtctttgattcaacagaaatttattgagcaacttttatgtgcaagacactgagaatgtaagaatgaacaacaaaaaattcttgttctcacaaaagctttgtggagatgaaagaggataaaatataaaatatcagctggtgataaatggtgggaagaaaacagggccgggcacagtggctgatgcccagggctttgggaggctgaggtgggaggatggcttgagctcaggagtttgagaccagcctagtcaacatagggagactctgtctctacaaaacagaaaaatttagccgggtgtggtggctcacacttctagtggcaactactcaggaggctgaggcaggaagatcacttgagcccaggagtttgaggctgcagtgagctatgatctcaccactgctctccagcctgggtgacagggcaagaccttttctcaaaaacaaaacaaaacaaatgaggtaagtgaataggcaattctgggagggagttttgttttagataaaggtggtcaagctactctgataaggcgaagtagagatctgaatgttctgaaagagccattatactatctggtgcggggaggagcttgccaggcagaaggaactcagaaggacaaagacctagaagcagaagtatgcctggtatgtctgaggagcatggagctaatgtgtctggaggcgaatgggggagaccgtaatagatgaagccagagagttaactgataatcagattgtgtcctttgtattttgtgggccattgttgtaaggctttgggttttctgaaaaagaagccgcagaagatattttttttttttttttttaaagacagagtctcactctgttgccaggctgcagtgcaatggcacaatcttggctcactgcaacctccgcctcccaggttcaagcaattctcatgccttagcctccgggtagctgggattacaggggtgtgccaccgcacccagctagtttttgtatttttagtagagatggggtttctccatgcttgtgaggctggtcacgaacccctgacctcaggcgatccacacgcctcggcatcccaaggtgctgggattacaggcctgagccaccgtgcccggctgtcacagaggatttttaacacagaactattatgatctgacataaattttaaaagttaaaaggttgctgtgtggaactaggaagactagttgctatatctaggcatgaaatgatactggcttggaccaggcaagcagaagaggtggggagaatttagctcaacgtagttagcaggagttgctgatggattggttgtcgggtgtattctctagattaggggtccccaacccctgggctggtactggtctgtggcctgttaggaagcaagctgcacagcaggaggtgagtggtgggcaggtgagcattactgcctgagctctgcctctgggcagatcagcagtggcatgggattctcataggagcacgaaacctattgtgaactacacgtgcgagggatctaggttgtgtgcttcttgtaagaatctaatgcctcatgatctgaggtggaacagtttcatcctgaaaccatcctcaccccacccagtccatgaaaaaattgtcttcaacagagccggtccctggtgccacaaacgttggggaccactgctctagattccaaaaatttttttttttttttttttttggagacggagtctcgctctgttgcccaggaagctctgcctcctgggttcacaccattctcctgcctcagcctcccgagtagctgggactacaggcgcccgccaccacaccctgctaatttttttgtatttgtagtagggacagggtttcaccgtgttagccaggatggtctcgatctcctgacctcgtgatccacctgcctcggcctcccaaagtgctgggattacaggcgtcagccactgcacctggccagattccaagattttttaaaggcattagcaactgaatgaatggcgatgccatttagtaggatggagaggagtgggttttgaaaggaaaaaaattttttggaaatgtcatttctaagatgtctaggaaacatctaggtggagctgtcaattaagtagttgatataaaagtggcacttcatttaaaaaaatcatagcttatatgctttatggggaagagctagagaggaaaccagcaagctccatttcagcaaaatattcctgccacttaacgtgtgtgttcatcacaaaaggaagattaattccatgtattacaagtattttcagcatcttctgaggctcattcatgagccctcaccttactgtgcctcacttcagttgtcatctctgcatgctgatgaatccatagccctaaaacccctcacttgaataccaggctattttcgaccacaattgggacaacctttgtttttttcattcaaaagatttttttttaggtttgtcctttctcagttattatattactttctaagcccagttaacctcagttctgggccacatgactggggtctctagtcatttagtacagcaatgccacttccattcttcaaaacccctcagtggtcagctaggcacgatggctctctcttgtaatcccagtacttttggaggctgaggtgggaggatcactgtaggccaagagttcgagaccagcctgagaaacatagcgagaccacccctctacaaaaaataattagctaggtgtggtggcgtgtgtcggtagtcctagctacctgggaggcaggaggatgatttgatttcaggagttcaaggctgcagtgagctgggatcacaacactatactccatcctgggcaacagaatgagaaatgaaaaacctacagtggctttccatgaggcgttcagaactaaaattaaactaagtctccctgcactccagggccctagtgagtctcatttctcttagctccaaccaggctagatccctggacatcccctgcaacaaaagtattattttcctcattgttacctattctccaggatgcgtggccattctgattctaggtatctttagtaccaagtctcacctctatttaaagcctttccttattcctgtccaacaactatctcctcctttttggccacttaatattgtatattttgatatttgatgataatcctttggcaccctcctgagtcatcagagcataatgggaagggtacagactttgaagtgagatttggtttgaggtctagatgtgactttttggaaaagttacataactattctgagcttccatgtcattgcttgtaaataagaaaggataataactggactgttgtgaggaacaagtgaaaacacattataaaatgtagcacattatgaagacttatcagaatattgagacaaaattagcttcttgtgagcagaggtgtctttcttccttttgtagtcctgtataagatgcctaatgaatacttaattatttgaaatataaagttcttgatttgttcatatcaaaaatatttcttgactgcctctttcaacatgcagtgattctgagtgtttgtactctgaatagcaaaaacaagacaacatagagtgattgattttttgtttttgtttttgttttgttttgttttgttttgagacgagtttcactcttaccacccaggctggagtgcaatggcaagatctcggctcactgcaacctccacctcctgggttcaggcaattctcctgcctcagcctcccgagtagctgggattacaggtgcccgccaccacgcccagctaatttgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagagtgagactctgtctcaaaaaaaaaaataaaataaccgaggtccccccatcaacactgtactgcttcattctgctcagaattgccctcccccatccactttttttttttttggcgagagagtcttgctctgtcgcccaggctggagtgaagtggcacgatcttggctctcactgcaacctccacctcctgggttcaagcgattctcctgcctcagcctctcaagtagctgggactacaggtgcccaccaccatgcccagctaatttttttttttttgtatttttagtagagttggggtttcgccatgttggccaggctggtctcgatctcttgaccttgtgatccacccgcctcggcctcccaaactattgggattacaggcgttagccaccatgcctggcccactttattagactcagcttaatcctcatcaaacttgtgaagccttttctaagctattagcactcaacatagaactgattgctcccttctgcatgcccccagtgtagctcatacatactcctcccacagcttccatgatacatgattgtgttcatttttctagttctgttagcccatcatcctgctctctctacccctacacctgtgtttgagggcagagaatgtcttgttgagacttgcgtctcaagtatctaacactgttaatgaatgaattgtaatcttatcaatttgttggttataatcaatagttttgggggtttttttggttttttgttttttttttgagatgtagtctcgctctgtcaccaggctggagcgcagtggtgcaatctcggctcactgcaacctctgcctcctgggttcaagtgattcttctgcctcagcctcccaagtagctgggactacaggcgtgtgccaccacgcccagctaatttttgtatttttagtagagacggggtttcaccatgttggccaggatcgtctcaatctcctgacctcgtgatctgcctgcctcagcctcccaaagtgctgggattacaggcgtgagccaccgtgcccggcacttttttttttttttttttagtcttgctctgtcacccaggctggagtgcagtggcagtctcggctcactgtaacctctgcctcctgggttcagtcgattctcctgcctcagcctcccgagtagctgggattaaagacgcacaccactacggcccagctaatttttgtatttttttagtagagacggggtttcaccatgttggccaggatcgtctcaatctcctgacctcgtgatctgcctgcctcagcctcccaaagtgctggtattacaggtgtgagccaccgtaccccgccacaatttattttatatgtaaagaaataatttgctttttggagcagagaatgaaagttggtagaaagcatactccggaattatttctctatattgtcttaaattgccaaaataaggccttaaaaaatataacccaaagaaatatagtgcagtttcagcctaaaacactaagcagcatgacaattacgttttttacttgcctattggtgaaaaagttctcagtttgagctttagaggttgagtgacaatgtttgtgtctttcagaaatcagagcctcattcccttagtagtgaagcattgatgaggagagcagtgtctttggtaacagatagcacctctacctttctctctcagaccacatatgcgttgattgaagctattactgaatatactaaggtatgtctcctcttaactcttgatcttctaaaccatggtttagcaaataatggctcacaaccaaattgtgtctgatacccatgttggtatttgattgaaacatagccaggcctatttgtttatgtgttgtcaataacggtttttgaggatttgagtagtttcaacagaggctgtaaggcccacaaagcccaaaatatttactgtcaggcccttcaaaaagtttgctgagccctgatctaaatcactcgtttttagacttttcccaggaaccttttttttttttttacagaaaaatcttaaatgtggcagcctagtatataaaacaggagtgaagctgatatggttcagttaagggcacaggggcctgtggtccatcaacagaggttgctctgtgaggattatttaaaagccactgatctaacctaatagaaaagagagtatatgggccaggcgtggtggctcacatctgtaatcccagcagtttgggaggccaaggcgggaggatcacttggggccaggagttcaagaccaacccagtcaatgtagcaagccccatctctagcagaaaaaaaattttaaacttagccaggcatggtgtgttgtgtgcctgtagtcccagttactccaggggctgaggtgggaggatcacttgagtctaggagtttgagattacagtgagctatgaacatgccagtgcacttccgtctgggtgacatagcatcctgtttgtaaaaaataataaatttttttttttgagatggagtcttgcttacgcaggctggagtgcagtggagtgatgtcagctcgctgcaatctccgcctcctgggttcaagcgattttccttcctcagcctcctgagtagctgggattacaggtgtgtgccaccatgcccggctaatttttttgtatttttagtagagacggggttttgccatgttggccaagctggtctcgaactcctgacttcaggtgatccacgtgtcttagcctcccaaagtgctaggattacaggcatgagccactgcacccggccaataaaaattttttagcgtatatggataatcaaaagtattgaagtctcatttgtgcatttgttttacatatattttccagcagcttttttcccctcaacctttaaagttttcccttgcattgttttctctttctgtgtctgaattgctgacaagcttttaaaaacacagaagtttacagatggagatactaatgtcctgatacctttacttcataggataatagtgcaatttcattgaggcagcaggatggaagagccagtttgctgtaatgggacttaatttccttgaggtggaaatctctctattccttctgatatgtctcacttactttactcagacttgttcattctctatttgtaggctgtttataccttaacttctctttaccgacaatatacaagtttacttgggaaaatgaattcagaggaggaagatgaagtgtggcaggtgatcataggagccagagctgaggtaagcagaaagttctaggcatttctgtgttagtgcacctacctcatgtggtatctaaattattgaattaagtctaatcaatataatcagtgttctctaaatctactactttaagtccatttaaatgggctagacctcttatgctgtctgaagcactttgcttgatttatatagatgacttcaaaacaccaagagtacttgaagctggaaaccacttggatgactgcagttggtctttcagagatggcagcagaagctgcatatcaaactggtaggttcaagttttgtgttgggtttttttttttattttttaactaggaaggtaccatttgagttttcatctggttttctaaaatgagggctttatagtaaatggtctaagtggctctcactttgagaaattttccccatttcctacatattaacctacattttatttgcacaatagaaacaatgagcatacccttgcagaccagaccagtagaagctaggttatgtcttcaaaatgaaaaatgataaaactattaccattggaaaattggattgcttccaaatagttttagcttcttttggtaatacaatttattaacaatcatagaattacaccgttggctgagacttgagatgagtaatctatgtgaacctttttgtacagatggagaaaatgagacctggaatcatagtcagtggcaaaaccaggacaaattatttgtctatgtcaggctttgtggtaggcatttcgtaggcactttttatatgtgaagaaactagagggcagatgggccagatcattcggctaagatgacacggtatggtgagtaagcagccaagctgagattcagctgagtaggtcttttttttttttttttttttttccttcataaaatagagatggggttttacaatgttgcacaggctaatctcgaaatcctaggctcaagcagtctacccaccttggcctcccaaagtgctgggattataggcatgagccacggagccaagtaggtcgaattccaaagcctctgcttctcctattctcccagcagccagtgctttgtcctttgcaccgtggtgccccaaggtgcccatcatagaacatcctacctgagtggtcccaacctaggtaggtaggctcacagaaaaaaaaattttttttaatggagttttgttcctgtcacccaggctggagtgcactggcgccatctaggctcactgcaacctccacctcctgggttcaagtgattctcctgcctcagcctcccaagtagctgggattacaggcacccgccaccacgcccagctagtttttgtatttttaatagagaatagtttttgtatttttaatagagaaggggttttgccatgttggccaggctggtcttgaactcctgacctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttttaaacacctaacaaatgtatatatactaaatataaaactttgccccctccctctaaatttacatactcttctaagacacacagtaaattttgtaccaggtgacaaaaggaagagacaacaaaatcatttaaaaagttgatatatcacctgggcgcggtggctcacgcctgtaatcccagcactttgggaggccaaggcgggtggatcacgaggtcaggagatcaagaccatcctggctaacacggtgaaaccccgtctctactaaaataaaaaaaaaaaataaataaattaggcatggtggtgggcacctgtagtcccagctactcaggaggctgaggcaggagaatggcgtgaacccgggaggtggagcttacagtgagccgagatcgcgccactgcactccagcctgggtgataagtgagactccatctcaaaaaaaaaaaaaaaaaaaggtagaaatggtattcgaagattttgatgtccccaaaatggacaccagggcctaggatgtttcgtgggagagttttatcaaatcttccaaaactataatacctatgttactgtaagtgtaccagcgcaaagaaagtaatgacaagcctcctcttactactgtatgaagccagcatagccccgatcccaaactggactagggcagcaccaaaacgaaaagctcagtatcacttcaaaatgtagccgtaaatcaaacgtagccatttaccctcaaaatagaatgatagttcaacactgtaaaaaactatagagtgagactccttctcaaacaaatataattcactgtttgagatgatatatccatagattaaaggagaaaaaccacttaacatatgcccaaaacatcttcagtgtagtagccatttatgattcgaatctaagtacaattatgaagagataattttcttaatgtaataaaggttaagtaatcctacttaattgtgtggactttcagaagtgttttcatcgaagttagaagaggaggatgcctgccattctccactacctgtcaacattgtcctgaaggttcttgttaatgcagtaagatcaaaatgttctacagacgaattgataaaatgtatatacccagatggtgaaatacactaactagcagcaggtaaaatgagagagctcatttttttttttgggggggagacgagtttcactctcacctaggctggagtgaagtggcgcgatctcagctcactgcaacctccgcctcccaggttcaagcaattctcctgcttcaggctcccaagtagctgagactgcaggtgcactctgccacacccagctactttttttgtattttagtagaaacggggtttcaccgtgttacccaggctggtcttgaactcctgagctcaggcagtccacccacctcggcatcccaaagtgctaggattacaggcacgagccactgcacccagccttttttctttttttcttttttttttgagacggagtctgtcgcccaggctggagtgcagtggcacgatcttggctcacttcagccttcgcctcccgggtccaagctattctcctgcctcagcctcccaagtagctgggattacaggcatgcgccaccatgcctggctaatttttttttgtatttttggtagagacgggttcaccatgttagccaggctggtctcgaactcctgaccctcaggtgatctgcctgccttggcttcccaaagttctgagattagaggcgtgagccactgcgcccggccttcaaaacatgtttaagtgaaaaaattataaaacatatttaataccttttatgctgttacataaatttatagtaaaaaaatatttttctatgcattcctttacctttaaagattagtcaaggtgatgaaagggatctttgacaattttattcatgatctctttgtcaaaaagaaatggaagatgtgtagttaaaaaaattaatcaaaggtctgtactaaaagctctgtagctataaagatgattgtgagagttgcatttaataattgtgatgttggccgctgacagctgaagaaaaatgctgtttttgacagagtgtcagttaaatccagacctgaacatagaggtggaagtttctttgcagagagagaagacagggaggtcaaggaaagtgaccccaagaggggttcagatgacagccacagcacccccaggccaacgtccacatgagccttccgcgccctgcacggctgctcaacccgattgtcccatcttttggcaggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtcctatgcagcctccttccttgaggtcccagactgcagcgccccaggcagcgcccggaatgccccgacaggttcctggcagcatttgctacactttggctcccattcaacatatgctggacaagttagctgggttgcagtgtttttaatcagagctaacagggtgagaggagttaaaaaaccaagttggcattttctgtagagcagcaggcatcaatttcgcatcacgatagagaatcaacactgagtccactctcaggctgttgcccaacccacccttcagcgctggggtatggggccagctgcacacttgagcccctcatctgtcaccagtgcccacatggtccacatctcgagggggctgaggcggtgaaccagcaggagccccctatacaggcaggggtctaaggggtccaggggccgccggattccaaatgtcttgaagccagcatggtgcatagggctcagccccagcctcctcaggcacatacccacaaagacatcatcaatggggaagagttcagcatcttccatgatagcctggaggcgccgcactgtggctctggacatgacatatcctcccccaccagcatagggtgggtagtgggtggccctgtacattgagggtgggatgaagtatttgaccttagtgttcctgttgggcagggcttggcggatgacatctcccaccaggaggtcctgggctgggtcccagccatccaggaactctaacacgttggggacgtggacaaagacatcgtcatctccctttagcatgaaatgggcctgggggcaggcagccaccacccagcgctgcaggtgcagctccttgagcgtcaggttgaagaagtcctcagtgaagtcccactggaggatgtcatcaaactccctactctcataggccagcagctgggctgggggagcggatcctgccacccctaggaggaacaccagcttcagctgccggcccctagcccatccccccaccctgccccacgtgctgcggatagccgcacgtcgctccacgtgaccaggctgtgacttgatggccaggagcaagaaggtatccttggaacagcctgaaggctccagcaagatagagaaatttcggcagtgacgataggtcaagaagagacggtgacggctaggcagggacagagaggcgctagacactgtgtggttgggtggacaccggctgtgacggggtgttgggggagcccagaaaggctggtgggccgtggggtctcctgcgggcttggccgccttcctcaggaagagcaggcagccgagcaacagcacagccaagctgtacgagaccagccagcacagcctgcagagcatcgccggtccctgcaaggagagagccacctgagcagggcccagccccgggtccctgtccccaagagttgggcaggagttaacctgcaccccagccgctaagtccctgctggcctctggactttttattctcagcgtatcctcaggctctttccagagtcctccctcccctgaggatgggctaagcacagctgctttgccagcccttgccctcctctgccatcatctgaggactcctgggtctgtttttcccaaaaggacttgcagccactttacagctgacaccataaacgttcccagccattcttccaggaaactcgagcacctgatgagttttaggcacagactcagtttagcttggatcaaattcactaagtgtggaactgacattcagggcttttcaagtgggaagtgaaaccatttcccaaaaaaagcttggtgcctgtggggtcctgtgttgggcgtctccaagatgaccaggagtgcactgcttccctcggaggagaaccagcaccacagggtggccgtggccaccaaagcacacaccctttacacctgcct

SEQ ID NO: 14939 - DNA, 10166 bp, Human
acgcctgtaatcccaacactttgggaggccgaggtgggcagatcacttgatgtcaggggtttgagacgagcctggccaacatggtgaaaccccgtctctactaaaaatacaaaaattagccgggtgtgatggcgggcgcctgtaatcccaggtactctggaggctggggcaggagaaccgcttgaacccgggaggcggaggctgcagtgcgccaagatcgcgccactggactccagcctgggcgacagagcgagactccttatcaaaagtaaactaaaataaaaattaaggcccgcgcggtggctcccgcctgtaatcccagcactttcggaggccgaggcgggcggatcgcaaggtcaggagatcaagaacatcttcgccaacttggggaaacctcgtctctactaaaaatacaaaaattagccgggcgtggtggcgcatctctgtagttccagctactcaggaggctgaggcaggagaatcacttgaacccgggaggcgcaggttgcagtgagccgagatcacgccactgcactccagtctgggctacaagagcgaaactgtctcaaaaaaaaaaaaaaaatgtagacgaacctccaacgaacggctcaccttgcctctcccaggccccaccgggggaggtcgattccatcgactctcaactgccaacccctgaggaggctccgcctttccctcaccctcgtccttctcctaggcggtccttgtttttgccgggcctttgaaagtctcgcgatagctctcccgcttcccataactccgtgcgctctcccctcccgtcctctttccgccatctttccgcgccggtgagtagcactctctgagagctccaatttcatccgtctgccatcggcgccatcctgcaatctaaggttcggtctcggtgtcctgcgaggaggctggtccccaccttggccgaggatcctggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcaggtaaaagctgcatcgtgccggggttggcagtttgctgggtgccaacttggatcttctgggccgcagagtttttctttagacacttttgaacttaaggaatttaagttctactctttactattggcactttggtctttcaaaacttcagtgtagtgtgcggttcttgcccattagaagagagtccagtctgacaagcatgtaaaatgtttctgtttgccactgtggctcttgctgttggacgcaattttaaatggcacgaagatggatgtttaatagttagatgtgttcattgtaggtgagagtgaactgatttaaagtacaatgttaatagtatggaatctgctgattttcagcaatttggaaaatgttgccgatgatactctgcttctgttctgaatcactgatcgactatacccgatgttttccttccggtagctggcagtttctgccagttctcacgttgtcttgtgtcaagtggattttgtcccacattttattatctccagacgttggtgtgtggcacgattcgaagaagagtggttagtgaatgaatgagtttcaaaatgtgcaggctgacgtcccgataacctgttttcaacaaccgtagtaaataggaattttcctgggtggtgggaaatggagaagcagcctgcttagacttgagaaaacttcgccaaggtggggccagaaaggaaaggatacttccgcagtgtaatggttggtgtctgttgatgttggcaatgccagtaaaacctcctgttttgtcttccttgaacagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggtaagtctgctgccgctgtgttttatgttttcatgtgagactctctaagaaatcagtcctgtagaaattaattatgggggaccaaagtatgtctgtcatacctgagaacgaatgcaattgacctgtgggctgtggaggaggggatagtctgaaactgctgaagagtcacttagagtaggactgctggaaaaaggagctctgctaggtgtttgggagctaaatgaatctaagtcattgaaaggactcctgagctcatttcgagaccagcctggccaacatggcaaaaccccgtctctactaaaaaaacaaaaaacaaaaacaaaaatcagccggtcgtggtggcaggcgcctgtagtcccagctctttggaggctgaggcagggagaattgtttgaacccagcaggtggaggttgcagtgagccgagatcggccactgcactccagcctgggcgacagtgcaagactccatctcaaaaaaaaaaaaaagaaagaaaggactcttgagatcttctcagagctctttgagaggaaagattggattattgcacttctttggcacaaagtagtctttgggaatgggaagcagtgaaggaagggtcaaggggaaaatagtttctttcagaattgcaaggtggattgttttgggtattgtctcccaattcttatatgttaggttgtaaaaattagttctgatacagagcaactgtcttccccccaactttttggagaagcagtcactgaggtgatgggagagtgaagaattgagtaggctagagcacagaggtttagctctcaagttgatgtcttttatttaatccagtcagttatcttttgtaggttacattggcgaatttgaaatcattgatgaccacagagctgggaaaattgttgtgaacctcacaggcaggctaaacaaggtaagaacgagtgatctacacatttcaaagctttaagaattttttactgtggcgttaaatgttgtaattgcctttggaaatactgagtagtggtgccatacttgatttatccagttactttaaaaaggtttaaaaattgacacatggaacttcatttgctctcctgggttgattgtgctaggattatgtcagttgacctagtgtttttatggggtataagctgtctcaggagagatggggggtgaaaccaacgctggtactggtatttggatgttaacgctacccacctcactggcttgaacttgggtggctcaaggccattgagccttttgtccaaggtgctgtgtccttcctctcagtgatgtgttgggttttttgaatggaatctttatctttgagtaaatggggctttctaaatagcaatatgaatactttttctgtttttgctggcataggtctttggggtctatgctgcttttcagtttgacttgtcaacaccttaaccaagtaaaactgactttgtggtttaagtgattgcgtgtgttttgggggcaggtgtcttaagctggttgaggtgtccactgtgcttcctgtcaggtttgtagctttcagatttgcaaggaggcagatcctctagttcaggcttgtccaacctgccttattttgttgtattgttttagacttgtagcagcctgaaaccatggtacttagtttctgtctctagtgataaatggaaaagagggatgaggaaggggccttactggcccaactagaaacagaaactaagaacccatgactgtattctctcccttggacacccctgtgtttattgcaacagataggggggaaagagacccagaaggtgagttgctgaagtatttgttaaagatttgaagaactagctgggcacagtgggtcacgcctgtaatcccagcactttgggaggctgaggcaggcggatcacgaggtcaggagtttgagacaagcctggccaacatggtgaaaccctgtctctactaaaaatagaaaaactagccaggcgcagtggcgggcgcttgtaatcccaggtactccggagactgaggcaggagaattgcttgaacctggcaggcggaggttacagtgagctgagatcgcaccactgcactccagcctgggtaacagggcaagactccctaagatttgaagaacttgcaagggtaattttcagtatgtcatgttttgttctagttgtagccattagaaccccacctcaaaataggattgatttatttttatttatatttcttttgagatagtcttgctctggttgaggctggagtgcagtggcgccatcttggctcactgcagcttccctagctcaagccatcctcccacctcagcctcctgagtagctggggaatacaggtgcattccactgtgactgctgatttttctttaacttttttgtagaggtggggtctcgctatgttgcttaggtttgtcttggactcatgggctcaagtgatcctcccacctcagcctcccagagtgctgggattacaggtgtgagtcactgggcccagccgagaaataaatttgaacagagcattctgtaaatggaacttatttgtggcacccttgttctgtggtatgctagtttgaaaaattctagcctacaacagttgatatgcaggccctgctgctctctgcccgttttttgagacggagtctcactctcacccaggttggagtgcagtggcacgatcttggctactgcaacctctgtctcccaggttcaagcgattctcctgcctcagcctccctagtagctgagattacaggtgagtgccaccatgcccggctaatttttgtatctttggtaaagacggggtttcgccatgttggccaggctggtctgggactcctgacctcaggtgatccaccgcgcctggcctgttctgtgactttcgacaaagcaaacaatttttggtttcttggaatttcatttctccccatttaaaagagaacgtccccctccatcgctttcatgcaagacatggacctacccttagcgtggaaattgagcttggaagtaaggtagtgtgtaaagactagattgattaaaattctggccttgatcacatcctcttacgattcttctgggttgggggagggtatgctgttttaattctaccagaatgagaagaatttttgctgctggaatcaacataaaacttggatgcagcgtgcggcagactttggaaagatctttcactatagcttgcttggataaaactggttttcccatattcctatccctgcatttctttcatctgccgtgagattgtccttgttagtcaagtcacagcatagctgatggggtaatagtaggagaacttaagcaggcttcctggcgtagagcagttgggcctttctgacaagcccattttcagtttctgtgggtcaatctctgcttttggaagtgtttttcaagtgtgcctgtgattttagagcagattttgtgagcagagggtcttcagttagtggacatcagttagtggactttcttcagtagtgttttagggctggcatgtagttgagtgatggcagcccttggcgagcttttacttgggaggatcattgttgccatgtcccagtagccacgagatgagataattgcaggccctttgctctttctgccttccatcattctgtcagatttgtttggaaaaatttgtctggggctgtaggacattgtttcttggaaatatgtaacggtacttcattggtgggagcagcgttcttagttcagtgcctggacagcgtgttccttagatattctaataatttgtagagcttcaggatttgagaccctatgattttatttcagccttattatgtaagaaagggttggctgtagtctctcttgtcgagacttgatctctaggctatgtaaaatctgatcatcctggacagctctccagccaacagggagcacgccagtggcctgacactgccatgtattgccttgttccatctctttgcatgcctttgctttttctcctaggcaggcgtagtcttacttaggtgtattttttgaaaagtatgtcaagcattgtgcacagaataagtacccatctgaatgctgggttggttggtttggaggactgtttatttatgaatgtcatcttgtgttactcagtttttctgttattggtaaagtgaagaatgtttttgttgttgttgttattttatagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggtcgtgtccactttcatgtctgcccttttggctcactgcagatagttccctgtgatcccagatgagggccagaatcagttctaagcctaggcctttgggaaaacttagtttgggagtctttgtccttaaaagcctatctgagttcaaacccttgtttttctgctttaaagccatgagatcttgggcaagtcacagccttgatttcttcatccgtaaaagtggtaatagttcctctgtttatcacctgatttaattttggtaaagcactttatgagctgacacagtaaatgtgtatctttgtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagtttttttttttttttttcttttttggagacagagtctgactctattgctcaggctggagtgcagtggcgcgatcttggcccactgcaacctccacctcccgggttcaagtgattgtcctgtctcagccgcctgagtaactgggattacaagtgtgtgtcgccacatccggctaatttttatattttagtagagacagggtttcgccatgttgcccaggctggtcttgagttctgggcctcaagtgatcagcctacctcggcctcccgaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatatgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcagcatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggtgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgataggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgct

SEQ ID NO: 14940 - DNA, 5464 bp, Human
ctagatgccttttgtttcacctaccatctcttcccccctttttttccaaccaaggtgttctaagattagacatatatttctattttagcattgaccacatcatattggtgattgttatgtactgtctatctccattgctggcctgtgaacttcatgagggaagccctgtcttagtgattatggcatctccagtgcctgcaaaatatgggtgactaaatgttgatttagggaatgaatgaataagtagcagcccagatcataaatagaagcacaattcaaatagctgaaatgcattagtaccatcgaatgtgttttccttccttgtgaaatccttgtgaaaaacaacatgaagaaccgaaagaaatctttacatgaaggtacttcatttgcaaatgaaacatatatagggcattggcctaataacttaaatctgctttcctgggagggctatttctgagtcaaacacattaggaagatgaccacactcacctccctccccaattcttgttagaaatattacggaaattagagtctgcatgcctgaaagtcagtaacgtgtagcttgagtttgtgaattggcattgtgtctatgctgtcagttaattattttgaagttagtagattaattaatggttaatgattatgtgtgaatgatgcacaagcctctttttccaatattaaatttaataattaataatttcatattatttatgagtcaaaggcagtcttatggaacctcctttctcaagaaaatgtaaaacaattccatttttaatttagcactgagattgctctttctttgtcatagtaattatgggcttttctgccagggtcccatttttgcttctactttacaacatggtcatggctgaatagctttaatcaggcaccaattagtcccaactctataactcatttaggctgggtctttggtggttgtgctttctcctttcaaactgggagggaaatattagaaaagtaagagcaaacgatctcaatccctgttgaataatttgtaaagagatatttctgtaacctgcccaataaactggttatcatattaaactcatttttagcagcttatattcacttaagcattgcaccagatggtggctgtcaaaatgtttcttataattagcatcagtaaacttctctcgggcctttgaaattcattgcaaatcacatgttgtctataatcataagattggaaatgttattaatatcctgctcagtattttgctacagtagtttttgtaaaactgcatggatcaatagagccaacttttctgtactgtgctgtctcaaaggcagttaagtggtaaatgtatctatatctagatgtacaaattgatttgatcattttcatagggttcagtaatcaactctcaaaaataaagaccagccaaaccatttatttagttgagcctacaaatgttctgttaatattaacatatctagcaaaataaccattttgaatcacatcatattccactgaacttggtgtctcagttattgaattagtcagatctcttttggttgaaaatgacagaacccctacttgaacttgtttatgaagaggaaacgggattgaaatgagagtacatttcatatgttcttaccacaaaatatgattcatatttgaggtgatgaatatattaattagcttgattcaaaaattccacattgtattcagaaatcataatatcattttgtaccccataaatatatacaactataatttgtcattttacaattcaaaattaaaagaaatgggagccgaaccggacggcggcggcggtggcgggaggctgcagcgcgcgggggtctcccgcgtcccctccgcctcgcccggagctagcgccttcgctcagccgagctcccaccccacccccttttttccgaaggcgctgggcggcgccaccctccggccggagccaggcactgcccaaccccctccgactttcaatgttccacactccccggccaggccagagcctcctcagcttctttttgtctctcccccctcccctcccccaacagctgcgtccatttccttaaggaagggtttttttttctctctccctccctcacaccgtagcggcgcgcgagcgggccgggcgggtggccggccgagttttccaagagttagcttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaaaaattcagaaggagctagctgaaataacccttgatcctcctcctaattgcagtgctgggcctaaaggagataacatttgtgaatggagatcaactatacttggtccactgggttctgtatatgaaggtggtgtgttttttctggatatcacattttcatcagattatccatttaagccaccaaaggttactttccgcaccagaatcgatcactgcaacatcaacagtcagggagtcatctgtctggacatccttaaagacaactggagtcccgctttgactgtttcaaaggttttgctgtctatttgttcccttttaatggactgcaaccctgtggatcctctggttggaagcatagccactcagtatttgaccaacagagcagaacacgacaggatagccagacagaggaccaagagatacgcaacgtaattcacataatttgtatgcagtgtgaaggagcagaaggcatcttctcactgtgctgcaaatctttatagtctttacaatacggacttctgtgtatatgttatactgattctactctgcttttatcctttggagcctgggagactccccaaaaaggtaaatgctatcaagagtagaactttgtagctgtagattagttatgttgaaaacgcctacttgcaagtcttgcttctttgggatatcaaaatgtattttgtgatgtactaaggatactggtcctgaagtctaccaaatattatagtgcgttttagcctaatgcattatctgtatgaacttataaaagtagctgtagatgactaggaattatgtcatttgtattaaacccagatcaatttctgagtatgtggttcatgctgttgtgaaaaatgttttaccttttacctttgtcagtttgtaatgagaggatttccttttaccctttgtagctcagagagcaccggatgtatcatctcaaacacaataaacatgctcctgaaggcatagtttcctgtcgtaatattttaagtcggtcttgttagaaggtgtgtctgagatgactgttgatgaaataaaaatgtggctatgaagattactaaagactagcacaaataaaccaattcttgaattgaaaacatttttaaaaaattaaagacatggcactgggaatcttagtaaccaaacttctgaggtgtactgaagggtcccagggattattaaggacagaaacttgcttgaagagcatctaagtttgtgtttttagtgctccttagagaaacaagtaagggagcatgagaagcatgacagaaaagggtacgaagccaagcaagaggctgttccaagccaagtctcagcgtcaaccaaatcctacaagggagttctgaagtgtaaattataactcagagtttgctccaaccagaggcaagggagtttggttttcatacacctgcaccagttagttaaaccccactctcacctggggaaacataacccccaagcacttctctctccacctatcagggcaaagagctctagtagccccaaagatgacatcctaaaagaatcacaggtatggaccattagagacaaagcacacagaagctggggaaggagtacgcaggatgattaaagggattatcagagggctcatggtgggatgctgagagtgtccatgacaaaccctatttaaattattttttgaccttttctctgcctgttgtctttaccttttccccaaaatactagcttcctccatgagccagggaacatggttgtcaattactcttaagtatcacatcctgcaggtttcaccaccaaattggaagctttgtactcagtgccagttaggaaagtcatgaggaaagaagaacttgtattggcctggcttgaatacagtgctcacttttgaaccaatctagccttggggacagggtgatataaaaacatggtggccctacaagagctacatttgaagtaaagtaagaagcagtttctaaaagaagaagggctgtgatattgctagaagaaggtagatatgctgatgagactaaaaagaaaccaaacccacttggttggagaatggggttgtcatggtgagagttacgtgttcagtccttataggacttgtcagtgctctacatagagaacctagttaagattgcatccttactataagtgggtctgcaggtgccagtttctggtcacaaaaaaaatatgcatatgaaagaagaaattgcatattatttgcagaaaaaatctcaaatggacaccctgttggggtacatacaaacatgaattcagtcttcattaatttagtctattggatccttatgcatggatttccttgttaaatacaaaagggattttcaatgtaggaaatatacagctggagggggactggaccatttagattacctcaatttattctcttagcctgagttttctttgtgaggctacagatgcttaataactgtttaatccaactagaggctcttctctctagtatcttagaggtgagatacctacatttatttcttcagtttaaagagatgctgtctttgctcatttaacaccactttcaacctatgtctctgcttctgtttatcaagaatttttagtgtaacatgctctgatattaacatagtcttgcatgaatattgcaatgtgcagagggacagtgttgttatcacgtatcagcagttggtgtttattggtgataaatgagtttcgttcccattgagagcaatatccctggtttttactctattatctaggtagagatgaaagatataatatatccttaaagcggtattcatacagttatccagttaatgaggcattaagggaaggggttgtggagagacacacacacagaagggggaagagcggcggagagagacacacacaaagagagacactcaggtacagagacacacagagacagagaggaaaggagagacatgtagagaggcagagagagagaagcaaggaaagagagaacacaaaagagaagcagaatctgaaaatactgtgaatcctgtgcagtatatctccagggttttgctgtcctataatttgtaagaaaatattatcagactgggtaaagtggtgaatcattagtatttatgatgaacaaatttccaagattg

SEQ ID NO: 14941 - DNA, 23672 bp, Human; identical to SEQ ID NO: 12575

SEQ ID NO: 14942 - DNA, 43896 bp, Human
gtgaatctgaaattttattcccgagaaccagaggtcagaaaaagctggggtcagaaagtgaagcttgttggccggaaatgagaaattcctctttggatgtgctgagggtgaagtgcttgcaagatgtccagtggggggaaaaaaaaaacaaaacctaagaaagtaagtcttgagtttcggagagtaatcagaaataataatgtagtgctggctagtcttcttactggtaatagttaaagctgtgacagaaggcaagatcattaaaattgcgaagataatttttttaaaaaaagaagagcctgagatatatctatatttaggaatgagaaggaggaagagaaggtaacagtaactaagaaagagaaattagttaagttaagggaatcaggtaagtttagtgtcatggaagccaaaggagaagagagtttcagaaaggaaatgatcagcagtgacaaaggctgcagacagatcctaagaaatgaattaaagatattttggacttggacctaagggcgtgcctcagagagacatgtcagtagaagagtggtagaagccagatgggaaagcaacaggtggagtgatgaatgagaaagaacaggcaggtagaacaagtcacacctttgagaagttcagcatcacactaaagaagaaaggtggaatttgaggtattggcaaaattgaagggacatttcaggatgagagatgcattgaaaatgaggcaggaaaagaagaaacaattctcctcggaatgaggagtgaataggagggaaaatttgacattgatgaagctaaggtagaatgatttttagtaaagtaggaggtaagagcatctgctgagagggaatgtgacaatttggtgacctggagagaaaaatctgcaagagtcactgtggaaagtaaacgaaaggacttcaatacattggaaaacggtactttaaagaaatagcagctttaaaggtgatatttcttccaatttagtctcaagactgtgcaatctggaatcctcctctatcttcattctggtcaaatcagtgtctcaccttggtgacctagcgcatggtttctttacatctaatatccttaccacttttatctaataatttctaccttttatccaaatctcacatcttctgtagaaacttccttgattaactcaacctgttgtagtttagttccttttctgaaactcttctgggactttcagtatttattacagaaaaagtgaagttctcagaaagaattgccttttaatagcaatcttctgagcacacaaatcttaaccttgaggattagtagcttaattggactatgtaagtgcttgtggtctttttagatctatgcgagaggaaacatggccggtccttcattgcgttcttctgagcgcactggatagatcaatttttggaggccctctggtgcctgacatgtagtagcagttaacatttgctgaactccaaatacgttctagataactcagcacatagtggaaacccaatgcatgtttgataaattccccaccttttgtaattccttggggtgggatagagacgagctctgggcaagaatatcagttttcaaactccaggaaagcatactggacctagtgtcatggaaagtggatcatttttgcggaggctctctgaacctcgcagtatccaaggtttccaggctagctggactgtgtcttgccataacccttatgtgtttatgaaaagaaaaaagaattctggcttcaaattcaaattacctttccacttaggggaaatggttggcagaggagaaaataaacgattgcgacatgttacgaagaatgaggactagcaaagaggaaggagcttaggtaaacagtgctgctttatttctgctgttaatcattcattgggcccgtcaaaagtttctgcccatctatttccatcaaccgtccttgaccagccaaccacatggctgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaaggtcggtggactactaaacccttggggaagcttggaggaaaggctggtggtttggccctttaaggagtgcaggattagaaggataaaacagagacaaaagcttggaggtgttttcagcagaaatcttttcaggagcactgtattagggggatgtaagacttgagacgtactttaaaccctatctgaacctcaagttttaaaaattataaatggaggaataatattgcattctaataaaataagctaaagaagaagaggtgtaaggtgttgctcttgttactgtatctaaaagacagatgtgttggtttgttgatctttcaccaccttcccacatcagagttgaggcaaggggtcaatcagacttttcaaagggttcacaggaagcttgcttttcttagtctacattctgaaaactggggccatttctattttgagatttgattaaccactccaaatctcctccaccactgacagcaaagatgtttagatttggtaataaggaggacactggccagcctccagttggtttctgaagctagcagtcttagtcgtcctcatcttctttactttctgaatttgacgatgctgataacccttccttcttgaaattctcttcttccttggttggccaggatacagtaccattctggtcctcattttaattcttcaaccacttgtctctttgctgattcctattctatctctaaatatggtaacaccaaaagaataaaaagtagactacagaagaggcagaagcatcaaagaaggttggcattaagcttagagatatgtttgaatgtagtatgagcacagaataaaggggctgatagaaaaataaagagatttggccaggtacggtggctcactcctgtaatcccagcactttgggaggccgaggctggcggatcacctgaggtcgggagttcgagaccagcctgaccaacatggagaacccctgtctctactaaaattacaaaattagccaggcatggtggcacatgtctgtaatcccagctacttgggaggctgaggcaggaggatcatttgaaccagggaggcagaggttggggtgagctgagatcgtgccattgcactctagtctgggcaacaagagtgaaactccacctcaaaaaaaaaaaaaaaagaaaaaaaaaagagattctaggaagggtggggaaagtgtgggagccagttctttctggagtttgtaagtgatataattgagagcccaggtataaggaagaagacactcagcccgagactggagaaaaatactatcctttcacaaggtatctgcattttaaaagggggaagttagacaaaataaatattaacttaaaaagtaacttctcatggaaggagaaatttgaggactaaagatttttccagtgactctcaaattgcactgcattgctaagtgctgatattatttttcacaagggacccgccatgctgactaaagttcttgagttggttccatttctgcaggaatttaaaaggtgaagtccttgaaatatgaaagttggctagagtagtctcagcttttcagtgagcagttacagaattgcagaatttgttcatctaggtttaatgtcattattttagagatggagggaactgatatccaagaagctgatatagcttcttcaagatcacagacttagactgtggtattgctggaactccaacttgtgtcttctcagctcgcaagttctagcctccattcccatactctgtggccagctggtttctgctgagggaccaccaggagtagttatggtgaactgcaaatgccgtagttggagaagagttaggatgcatcctgatggtttgttagggaagtctagtcactgtattatctctcttcaaaactgacaaagcatttcacacacattatttcatttggtcctcagtgagacagtcattctcattctaaagataaaattaaattgactttcattccttttagatttattattgtttattctgtcttattccttcctccgtgtaagttttttttttttttttgaaacggagtctcgctttgttgcccagactggagtgcggtggtgcaatctctgctcactgcaagctccgtctcccgggttcacaggccattctcctgcctcagcctcccgagtagctgggactacaggcgcccgccaccacgcccagctaattttttgtctttttagtagagacagggtttcaccgtgttagccaggatggtctcgacttcctgacctcgtgatctgcctgccttggcctcccaaagtgctgggattacaggcgtgagccactgcacccggcctcctctgtgtaagttttaagctagttaaattctggtgctcaaattaggtctttctaaaggcagtgaaagaaatctctgcgaaataaggaggaactcttttctcttcctctgcatctgcaaaaaagcagatgataatctgcgtgataaaactgaccttgcaaatgtttttttttaacaaaggagtcacggggttatatagaccaattacaataccacgttagagatggaaagttgaataaacaccttccttgtcttcaaggaattcacaatgtatttcgggaggcaaaagcaaatagatagttaggatacaaaacaatgctacaattaaggtattagccaagtactagaagaacagaaaacactggcatttcatgatgaagtcaggcaatgcttcaccaaggaggtgacatttgatctgaatagtgagtaaaggaatagtgagtaaaggagaagttggaggtaagagcattaatgcatgggagacattaactgcaaatgcttgcaggtgttttttaaaaaaatcctggctttgtatggtggctcacgcctataattccagcactttgggaggccgaggtgggaggttcacttgaggccaggagttcaagaccagcttgagcaacatagtgagacccctgtctttacaaaaaattaaaaaattagctgggtgtgatggcacgctcctgtggtcccagctactggggagactgaggtgggagcatcattcgagtccaggaggttgaggctgcagtgagctgtgattgcaccacttcactccagcttgggtgacacagagtgagaccctgtctcaaaaaagaaatccagaatgtttttggggaagggtaagtgcctccttgagactgaagcatggtgttctaagtgagaaatgatgggaaaactgggacagataggggaacctatggaaactgggaaccatgaatgtttttaagcagagtaacaacacataaattgctttttagggacataatggcatcaacatggaagctggcttataaatgtttgaaggcttttgcagtggtctagggtgaggggaagggaattataggaacctaaacctggactatggaagtggagtgttggagagagtggcagattctggtgcagctgctatgaccaacttgataggacttgacgactctgaatagtgcaaggaggtgagacagaggaggcaataatgacttggatttctagtctgggaggctgggtggagattgtcaccttcactgagacagaaagcacagatattaagtagtgttggaggaacatagtgaatttagtttgaaacatgttaaattcaaggtgcctgggagatacaaatgaagtgattggaaatattgatttgaaccttgggaattttaacttaaattattattattattattatttgcttaaatgagaaatctaacagagtcaaaaagttttagtttactttcaagtttgcagataaagaggaaagtgtaataattatttctggatttggcaaggaaaactcacaagcacttataactttcagtaaacagaaatgtttatttaaatattattccagaaaaaaaaattcactaagataaccagtcagaattacacttttctgaggttaaaattactgtcatgtggcagagcaatctctaaaatccaggaacgactcctttgttagaaaaaacatttgcaaggtcagttttgtcacgtagattatcatctgcttttttgcagctgcagaggaaaagagttcctccttattttacagagatttatttcattgcctttagaaagacgtaatttgagcaccagaatttaactagttagcaaccagagtaaagaagacaagcctgaatagcttaaaacttacacggaggaaggaataagacagaataaaataattattaacaattgaatttatggagcatggaagtttttgcatgaaccagagacaattaggcccagaggtctgtgggtgattcattttatttatttatttatttttgagacggagtctctctgtcgcccaggctggagtgcagtggtgtgatctcggatcactgtaacctttgcctcccgggttcaagcgattaacctgcctcagcctcctgagtagctgggattacaggcgtgcaccaccacacccagctaatttttgtatttttagtagagacggggtttcaccatgttagtcaggccggtcttgaactcctgacctcgtgatctgcccgcctcagcctcccaaagtgctgggattacaggcgtgagctaccgcgtctgacctgtgggtgattcaggtatgatgattaaagttatggatgtggatgacttcctttcaggaagatagttgagggcaagggaagacaaagccccaggacagccccagaggccccagcattcctctgctgtgcatgacacattagatctcactgtaccaaaggccacagtggagaccagatccagggcttctagccggaagttcagtggatgctcctctgcactggggtgtaattaaagtccctggtgatgcaaccatttattgcaattttaaatcattatgatgacaatgttttgacatccaggagtttggcttctgacagagtgacattccaatgccaattctatgaaactcttccctataatttcttttgaatgtttactatgtgctgtccacacaccatgccaagcccctctcagaaattccgagatataattacagttatccttcttattttataataaaggaaactgaggcttagaggaactgagtgttttgtccatgggactcggttcccatgtggtagagccaggacgccaactcacatgttctgggtgtgactccagagcccatgcccaaggtcttggccacactgtcctcctctgtccccagctctgtggccatggcctaggtgtgaggatgaagtaaagggagtgaaataacttcctcatcacagtgtagggtctgcatttgtctgtatctcctgtcataacctgtggaaggaggagaaccagtttttgcctactgcttccctccttcactgtcctcccttgactagttgatgatatgatgacttcagtttaagaatggaagagcctagagtaaaattatttgggccagttctcattaaaatacaggtgtttgccttgctttaaaatcaggtaaaatcagtccttaacaaagcatacactgtaaggggagacactgatatggcacagtactacttttctttggaacacacgttatcactaggagcttttggatttaaattcaatgcacattttgtgagcactttaacttcatgaggcgcaggctaggtactattgtggggcagaaataaatgggagcatactctgtcatttcaaggatcttgtggtttagtggtgaaggcagacttcagatgtgagttacagaccaagtccgaatcagagttataaatacaaaattgtacttggtatgtggaggcttgcttggataggagggaatgctggagaagggactggcagaatgagtaggaattaaagaggaaaaagagagagggtagatgatgtggacaggaatgggagataggaaagtgctgggaatggtaaggaattctggttgtccaggatagctggagcctaaggggtcagaccacaataccgaaaagttagtcatcaaagccaattgagtgaatgccagtacttgaaggatcagttcatagaaataaatttgctgaatttatcaaagtatcaatttatctaacattgtttcaagaaacattcattttggaggccaggcatggtggcttatgcctgtaatcccagcactttgggaggccgaggcgggagaattgcttgaggccaggagtttgagaccagcctgggcaacatagtaagatcacatctctattacaattttagaaaagaaaaagaaaaagaaatcattttgagtattcaatgagtataaatatatcctttttgaatgtagctaatgaatacatattttagtggcatttaagatatttttgttcaacttcttgaagctaatgatttaatcttatggttgtatttttgtaaatatagtcatgaatatttttctgaacatattcaacatatatatttttcttgtgaatgtaataacaactgcaacaattcctaggggaaatttccactttctactcttatccttttgatttttcatagtcaattctattttgccaccccactggtgtttttaatctctttcttcaatttcactgaaattcaataaacacaacaaatctactcattgtcaaaaattgaagaaactttttcccatagttttcatagttcataacatatcttattgggtgggagaaatttgtcacattttatgaatttcacagatgatgagtgaggtggttttcatgatatgcaacctgcctggctctcagctgtctccagcttcacaagattgtgagggcagagaggagcatagagttaggaaggaggataatgggaaaaaagagggggaaactgagtagaaaggggaagtatgaagtcccagaatgttggtcctggctcctcccaacctctctagaccacctggattcattcagtacaaagtctgtgaacacatttccagtaagtgactacaactggtaaattgctcgttaggtgaatttacgtattggcagaattgccccggtggggatgtatagagctcatgggacaggacgtgtgtgacatggggttcccacagctgacaacaggtggagggatggcttcatcagaactaagttttagaaagagaagaagcttatgtgagtctttactcaatgaagaaattagaccccacaaagaatgaagggcactataaacttcccttctcccacacagtttctctccaagatgtttcagtcccacattatgtaagactggcccatattactgagaccagctttatgttgagggactgaacattaccttagatatacattacattacagtcctacattatgtgggactgaaacatcttggggagaaatattgattgaagggactccctttacctaaatgtatatgggctttgtatgaattatggatgcacgagagcgtccaaccatctggatctaacaaagatgtcaaagtaaaggatgaaattcactattttatgggagtgaatttggttaacttcatatattcctttgaagacaaggactatttcttttcttaattttttatttttatagatttacagtacagagatttcttaaaaaactaaaaatagaactcccctttgattcccactattgagtatctacccaaaggaaagggactttttcctaacacaaacttaggatatgttgtgttctccaaagggaatgggaagtggtgatgaagattaaaaaaaaaagtccttactaattttgctttaaacaagtctatatagtctgatttaaaaataaaagtgcatttgccatgtatatttttcatatatatatatgtgtgtgtgtgtgtttatgatcatttttcaaaactgcaaattgcttcatggtttattgcctttgtcaatagttctcacaaggaactcccaatacttctatacggcgactcaactctttctctctatcccatcattttcctgcctttttgttttttttttttttttttatgtttgtacctttcttttaagtcctctgtcatttctttgttagatcatctggccaattgcaagtcttctcactcaacctccctgtttctttcctctaatccctttaatttatcttgtgcatgtctgccataatgatcttaaagcataataattatgtcattcctcagcttaaaaacaaacattcacatcaaaaacaagcacttttattccccaaggagtaaagtctatgaatttcctaaacttgacgtttacatcccactcagacacatctgtaaactgtcccttccccatctcagacattcagccaaattggaatattatctattgttccctcaacatgccctgcatccattctgcagtgtcttcagtatacctagtgcagatgcagtctcctctgcaaagcccactccctccctccacttggaatcaatctctcttctgagctcacagcttctgcagaggccaatccttactgtcttgtgctgtaacatttgtgctcaggggtttttttgttttgtttccactccaggctgtcatttccttgaagacatggatcccataacatttattctagtgctttatgacaagttggaattcaatgactatttattaaattgagttctttcagcagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggtgagtagtgggaaacaagctcaaatcagcaacaaacaatgaagatcatctgtgcattcacttttaaggctaaaaaaaatgatgactgagcttctagcagagacccagcttcatcaacaagtggtttatttgacaggctagaacttagggaaatttgctttacacataaaggaaatagtgttatagacactttcccctagatttttatttctccaggaaagaatttctctcccaaccatctatatggatgataatatggacagatctatattatctattactatgactaaacaattttcactgtttgtgggtttattcagggggtgcttaaaaagtaaatcagcctggtacttaattcttgcaaaaaaagcaaagttaagatttttatgcttcaagggctccatgcttcttcctccatatcattcaaaatcaaacagatgtaaaaaaaataaattaaaaatgttatttttacccatttcccagccaccctgtttcccttccctgaggcaaccaaagttatataatgttatttgaatacaataatatgtttctgttgaggcaacttgtagtgacttctgactttgcacagatgcatttgagtcagcagatatggggagtcaggttggtgaagttcatgtctttcttctttttcagataaattatcccatatgtagcagagaagggaaaaaaattctgccttttatcattattgtttattgttatcattgtcattatcatttgtgaacaaatatatattactgatcactcactaggtgtattgaacagagagtataataggagttatgatttttcttgactagagatcattcttgaaaagaacgatccctgctctaaacatcacacttcagaaacaataagatgctgtgtcccaaggtataagttttggtgctccttctcattttggtgtccaggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctgtaagtatcaacatttatttttttcctttgcttttcctatctttggaaagttgtctcagaaactaaattttctgaatctttagtcaccaagaagacagtttgtcaattactgatttcaatgtacatacttgtggcattttttgaaaaagcaaaacagaaaaattaggggtagttaattgcattgaaaaataactctgttctttttttttttttttttttttttttgagacagagtctagctctgtctcccaggctggagtgcagtggtggaatcttggctccctgcaacctctgcctcctggtttcaagtgactctcctgcctcagcctcctgagtagctggaattacaggcgtgcaccaccacacctggttaatttttctgttttaagtagatacagggtttcaccatattggctagactggtctcaaactcctgacctcaagtgatctgcctgcctcggcttcccaaagtgctgatattacaggtatgagccactgggcctggttagaagtctattctttataaagtaatccaccaaacacttctttcaagaaaagaaccacaaatttcattatgatctattgaaaatcagattcactttttaaaaaattataaaaaaggtaggtggctagaaagaggcaatgcagttttcaaaagaacctcactcaaaatatttgctgtgttttgaagaaaagttataattcactgtcagttgggaatgcattctgtgatgttttccaatagcaggggtatacaatcaatactttctcttttttgttccttttgtgacatgcattttttagtggcctaggttctaagtacatgccatagacatagaatgaagcaaagctctcccgtccctggtcagcttattaagtcctggaccacgtgttctgctgctgcaattatttaactggtcatttttctctattggtaaaatgtaccagaaaaaaaggtgatcaaattttgtattaattttgaggtgagtcagggttagaaataagtttgaatctaaatctctctgtgtttctggaagcagaggtgaaccttggttaatttcttttcttttctaatgccatatctgtgagtacttggaagtactaatcatcatttaaatttttctcccagacaaacgatgcagacacccaggagagttacgtaatgggcaagtagagattaagacagatttatcttttggatcacaaatagaattcagctgttcagaagggtgagtgtgaggtaatctatgaacaattcttttatacttatttaaaaaatagctgaagtgttcgtatatttcaaaatttaaaatgatgtaaaaagatagacgttgagaattctcatttccatcctatctccatacaccacattccttcccgtcctcaagcaaagatctatttttattggttcgtatatatctttctagtgtttccttatataaatacaagctaagaagttagcatatattcttattttcccccctttcctctaatgaacctagtattgaatcttgctttattgtttacttatcaatgtatactggagatatttccatgtttgcgcatagagagtttcctcattaatttctttttacaactgcatagaatgttgttgtgtagttgtgtcatggctttgccgtccttgtgatggatccatggatgtttctaatcttttgctattctgaacaatgctctgaagtattctcttgtatgtgtgtcattttatacatatgtagttacatctgcaggatagcttcctagaggaggcctttctggctcaaagagtatgtatatttgaaaatttaaaagatattgtcagactgctttccctaagggtttcatggttttgcagagtatgtaaatgtctgtctctccacaaactctccaactgtgttgtcaaactttcgaaaacttgtcaaatttttgaatttttcccaatgtaagaggtgaaaataaaatctcactatagtttcactgtacatttctcttattgtcagggaggttaagtatagttttatatgtccaggggatgtttgtatttatttgtgcactagttagcatgtctgatgcctggttgttgtttttttttccttaacttgttgaactttttattcttaagttttaggatgtatacatttagacatacacatgagtctgtgcattgcaggatttaggccttgattctgatatatactgtaacttttcccacagtgtgtgtgtgtgtgtgtgtgtgtgtgtgtgtgtgtgtgtatgtatatgtataatgtttttgacttggctattggtattttttccccttaaggagaaattatttgtatttatgttgttaaattcatcaatttcccttttagaaatggcttttggattttatgtcctaaggccttccccaatataaggtttaaaaaaaatcgcctatatttcctctacttcttttatattttcatattttttaatattcaaagctttaatttatttggagttaatatacagtatacagtatgaggtacagattttagactatatcttttcatattgctttcctgttacgccaacaccacttatttaaaagtttgcctttactgatttaagatgctctttgatactatataaaattcatatacttatctaggtctatttctggactttctattcaatgcccgtatttttcctgtacatttatgtacgcatttcacagtcatttaataattgaagctttataatatgttttaatagccaatatgggtagagctatcttattgctcttcttttttgaagttttcctgacagtatgtatttatttttctataagaactttaaagttagacatattttaaaatcagtgttagattagttttaaaattaattttaggtgaagtgcagtggctcacacctgtaatcccagcactttggaagaccaaggtgggaagatctcttgagtccaggagttcgagaccagcccgggcaacacagggagaccttgtctctacaagaaattaaaaaaattagctgagtgtggtagcacgcacttctagtcccagctatgcaacaggctgaggtgggaggatcacttgagcctgggaggtcgaggctgcagtgagccatgatagtgccactgcactacaacctgggtgacagggcaagacctcatctcgaaaaataaactggtaaaattaactttaggagaatagatattttataatgttgactctctctagataagaatatgttaccatagagaaggcaaaactattcctctaccctcttagggtctccaccaggcctgagaattaagttgacatgaaacagattaacaggagaaaagcacacaggttttattttaacaagtacataggaaacttcacaggaaaatgaagacccaaaaagtggtctttgtacaaagtttctttgtacagatttctcttggccttgactccctgcctctggtgataagagtgttcttttccttcaggtacagggaaggcatctttcctgtgagagtttcatgtcctgccttcaggaagaaaaggggaggtcagagtgcccttcctgcatcttgctgtgtttcaagtgcttttaactcaaaaaacaatctttatgccaaactggtctattttggcatattctgctaccctttgctatgctttcctcagttcgtcttagtctttttttccttgtttcttcatgtgtgtttcagctttcctcacatagattttgcatttcttgaagagtttaaacctctggcaaaaccaaacaaaaaatgtttttggtattttaaatggattatttatccattttgtattgtaactagtttatcatctatctatcatctatctatctgtctgtctgtctgtctgtctgtctatctatatctatctatctatcatctatctatctatcatctgtctctatctatctatctatctatctatctatctatctatcatctatctactattgatttctgcatgttagtttgatatctcagccaactttctaaatttattatgcattagttcattctcatgctgctatgaagaaatacccaagactgggtaatttataaagaaaagaggtttaatttactcacagttccacatggctggtaaggcctcaggaaacttacaatcatcgcagaaggcaaaggggaagaaaggcaccttcttcacatggcggcagggaggagaagtgttgagtaaagggggaaaagcccctcataaaaccaacagacctcatgagaaactcactcactatcacgagaatagcattggggtaactgcccccatgattcaattacttcccactacattcctcccatgacacatggggattataggaactacaattcaatatgagttttgggtggggacacagccaaaccatgtcatattatttgtaaaaatttaaaaaaattctttcagttgaattctcttaggattatctggtttgtaatcacagcatttcaatgattcttttacctcctacttcccaatttttagatttccattttctttttcttatctacttatgttaattatgtcagtcaggatttacctggagaaatagaaccgcaggatttattgtagggacctgacttgacataggtgtgggagatagttaaatggtgtttacaggaggctgttccttcaatgtctgttgctgtggcctgaagtaagcagggcagggactcaggaaggcaagatagacatgaactggaattcattccagtttacaatggtgggctttactcgctcatctttgcaggttccacgtttgtccttgaagcactcagttcatgtctatctaacacgtttctgttacttattccatattctctttgccctcagcaagcacttcatctgacgttggttccttgcccaatggggtcacctaaacttttattcttgaatggtctgggccatcagcagtcctgcctgatttgggttattatagttttttgttgattttaattatagggcattggagtgtaagggggtgcacccagtatgtctgggtgccctgcattccagacatactcatctttaccatcactgtgcagaagcaatctaatttttcccttcattatcaggattagtcacaccaaccatcagagtggactccttctttgccttaccttcacttgcatgagggtccagagttgacaggtctcaacctccaagcttaatttagggttttcaggtaaaatacaggatgcccagttaaatttgattttcgggtaaacaacaaataattttagtgtatgttccatgcaacatttggatcacacttaaactaaaaaaagtgttcattgtttacatgaaattcacatttaactaggcaccctgtatttgtatgtgctaaatccagcaactctaatttttggaactcttgctgtgtcccccagtagaagcattcttccactgaagacttccaaactgactgggccaggtgcagtggctcacgcctgtaattccaacactttgagaggttgaggtgggaagatcacctgagcccaggagttcaagaccagcctgagcaacatagcgaaacccatctctaaagaataaaaaaatttaaaaaacagaaaataaaagaaataaaaagacttctagattaaccaagaatgttacttatttttatgttttaaaatttacagttgttttatggcgcatcatgatatacaatcaactttcattaatatttcaacaggcactggaatgaaggattttctttattagtagtatatagagtttgctatatacacatcagatttactttctttttttgagacaagttctccctctatcacacaggctggagtgcagtggtgcagtcttggcttactgtagcctggactgccctggctcaagcaatcctcttgcctcagccttctgagtagctaggcctacaggcatgtgccatgatgcctggctaaagttcaaacttttgtagagatgaggtcttgttatgttgctcatgcttgtctagaacacctgggctcaatggattctcttgccccggtcttccaaactgctgagattacaggcatgagccactgttctcagtcagatctactttcttgataagttgttttgaatattttattatgcttgtctttatataccttaagcatgaagataggagttaaagtaaattaataattttataattattttaaccattataaaataatttaatgataattagcatattttgattatttttcttgtctcatatacttctgttttattaaaattgctgctacatacatattttgctacataaagattcatagctcttcactgaaaatcaaaatctttaacatataaagtacccattgtgtgtcatttaataatcttggttctgatgtccaacttatgggatattaaaattattatctttggttttcttttgatttgaatttgcttggtataattttatgctgtcttttatttttaatctgtctgaaacacttttaggtttgtctcctgtatataacagagctgaattttctccaattaaaagctgtttttctttcattaggagtttacatttattgatgtgagtgatacttatagacttggttttgtcatattatttcatattttgttatatatgtatgtgtatatttattttctattaaaaatatatggtggtatttaggaaggttcaaaatttgtttctagtggtgacctatatacatttaaatttatataatatcattattcctctttatctttagacagtttaaattggttccttgttataaacaacaagaaacttatcttgtattcttccccttccttcaccccttctatcttccctaccagtaaatttgtatcatttgtattatcttagtgtttactttgtatttaacattaatgtgaaatattcatatgtgtctatggttgctttcactctcaactttgcaaatgatcaggcaataagggaatttattttaccctctcttccctgtctctattttttcttagttatactatttcagtgctgtctgagcatataacatttatatttccttcagtcacacttaaaatcacatttgttttttcttagatctgcatgtacaatatttgctaccatttttgtttattttggctaaagttgccattgtcatctcttggttggctgtagtttgtcctatggtggtttccaaaaaaaagtcccaagtgaaaattattctttgagttcttgcaggttcagataatatatctgaggcattgatacctagaagataatggggcttgatatagtccttggctcatcctttcttttcttggatgtcttataggtactgctgcactatcttttgctagtgaatactactgatctgaaatttcttctcatatggcttgatctttgtttgactatctaaattattattctttatctttgaaacctaatacttttacttttagttgttttggtagaaatcacttggtttaattttttgctactatgtgatgtgcaattttaatatgtagattgatgtattgttttattttagtaacatttacttgaaatatatatattttttgagtcaaggtctcactccctttgcccaggctggagtgcagtggcacgatcatagctcactgcagcctcaacttcctgggctcaagcaatcctcccacctcagcctctcaagtagctgggactacaggacagcaccaccatgcccagctgatttttgtatttttaatagagatggggttttgtcatattggccaggctggtcttgaactcctggtctcaaagaattcacctgcctcagcctcccaaagtactggtattacaggtataagccaccacacctggcctgaaacaaatttttaaaaagctattttgttctacttggattccttctttaggttatccaattaagcctatgttgattctcttttgcttgttacctatatctattagttttctcttatcttttccgtttgtttcatttttgttgattttctcatttttatcctctgttttccttattgtgtatggcttccataagggaaagtgaaaagaatcagaactaagatgctgttgaaacactaaggtgttcccattgaaacaaccagaaacaatattttgcacttagtctctgggctaggttggaaaaactacattttaaagaaattttaaagtaaagaaatacttaattgtagttgtagttgagatatattttcttgaagttattattcaataaattccacaggctcttagattgctgaaggtgacatttgctttagtgttctatcacattgtaagtttattccttgatgatgctacaatttgatatcattgatgattatcaatatccttgatgatgctacaatttgtaatcattcatatcttttgtttttttctgttagcataagatagagggcaggaagacgaactgaggaaagagtaggacatatcaagagccgtaaaaatggaagtggtgaactgaaagctaatgatgtatgggaataagacacccacctggaagtcagaggaagcttcaagccaaagatggggagattgtggactcagtaatctagctggtactctcacccagagacaaccacagaacacgctgaagccagccttttattgttgtgcttgagctctggatgaactgcattcctgatccctagtagatgctcagtaacagattaaggaatgagggtccaaaggaaaaaacacacgcatctcattgcagtaatgaaattttactgaatggagtgcttaatgggaaatgatatccaagaacatatgatttccttattttaatattgagtaacaattctatttgctcagacctctttaatttaatttagggtaggaggaattccattaaaatctttgatctatcttattcagatttttcttaattggctcaaccactagtcgttgtgaagtccaagatagaggagttggctggagtcatcctctcccacaatgtgaaagtaagtaaagactcttctgacttgactatcaatttaaactctgttaggtaataaagtccctgtgcatctttacaggtatgtgtaccttccattagaatttgcatgaattttagatttatcatgatgccttcgctgagtatttctttctcttcactcacttacctcagttgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaagtaagtcataatgatgaattctgcatcaaaatgtttgctctcttttgtttaaaagagaaagaaaggtaaatttattggggggcaaatggaaaattcaaagataaactaactatcgctctgatgcaatcatttatttggccacctgatacttattgcatgtttgtttagaatataaaagccataaaaatgggagtggtgaactgggagctaacagtatatgggaacaaacagcaacaacatctcactggtttggtgaagtaaaagtttattctcatttacactgagtttgttccatgtccaggagactctccagggcagccgtagtctgtgttagcttagcaactagctcagcaagccaggttgctttgatcttatggcacctccatttcaaaatgtgccttcacagtctcttcagtagacgaagagagaaaggccaattgtgtcctggctaagagctttggcctggaagcaaccacatatcactttccattacagccttttgtctcaaactagagagtagcctcagaggactggggaatgtagccttggtctgttcaagaagcggaaatgaaaatataatttgcacctataagatgaaacacatatgcctgtagggcaagcaaaacctgagtgccagaagggcaacaggacaaagcaagtgataattgagtcaaaagatatgttagttagtgtgctagtctaaggaatcttactttatattactaagtttacacagtattgcttactaacccaccacaggacacaatcagacgaggggcacaaaagagcaggatactgccaacagtgcaaaatgcctggagttagatctgcaacaagtgaaagcggcaatagctgagggcagaaaagtgggcaggggccaggttatgaagggccttgtgtttcagtctcaggcattcagaacaatcatggaggggagactttgaaaggctttaacaaggggaataaatgtgctgcattttagaaagataactctggctgtgggacaacaacctgaagtgggacaaaacttaactgacagtcacctgctatggcttgaatgtgcatctccaaactcatgataaaacctaagacccaatgtgatcgttttaacaggtggaacttttggggaagtgattaagtcatgagggatccaccctcatgaatgggattagtgcccttataaaagaggttgaagggagagcgctagtctcttttgcccttctgtcttgtgaggacagagctttcatcccttcccccatgtgaggacgcagcaagaaggcaccatcttgaaaggggagagcaagcagacattgaatctgatggtggctagatcttgagcttcccagcctccagaactgtgagaaagaaatttccataatttataaactagtgaaagtattttgttatagcagcaggaacagactaagacagcacctgtgcaaccctccagccaaaaactgaaggtggcttcagcggtagcatggcagtggggctggacagaagttaagggattgtagaggaattaaagtagcagaattgccaggactggatgactgccaggatgtgggtgaggggtgtgagatagggggcggcttgttttctgcttgtcggggcatgggtctctgatcccctgggctgcctctgcactatgtaattaccatgggccacggacccataaccaaaatcatctaggaaattaggccattatactgaaagttttgggggccttggaaatatgtttctgctgggttatgtatgactgatttttattggtagggaagttggaggagctatccacagtcatctcgaagaaggaccaatgtaatgaaaactcattttaaaagctgaaattatatattttatatatatacacacacatacatatgtgtatatataaatatatattatatcaaatataaaaatatataatatataatactattggtatagtgttatatattctataagactatattatagaatatataaaatatataataagtatcattaacataatataaataatttcagcttttaaaagcctcagtaaaatgagtttccattacattggtctttctatgaggtaattgtggataacttcttcaacttctccaccaataaaaactagtactgaaaggattacatatatatatatattatatatacagatatatatgtatgcgtttgtgtatgtgtattcactttaaaatgtttcccttgtatctacttgacatgcacattcaacaggcatttgtgttgcacttgtaactggattagcagtggcagtaatatccttattaccatctatcttttaaaatccacttgtcttttctcatgattctttagaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccagtaagtatggactgtgacagaatttcaatgtttggcatctaaaggtaccccgtactgttaatacgggtatacttgcatgcataggcctactatgaattacagtaaaaatttacatctagatcaataatttcctttatttttttcttgttggaaagaagaatgattttagtgcactctgcaaggtcatatattgtcacacaaaactgccacataccacaagactgtgcacattccaaccttaaagggaggtgttaacattgtagatactatggatttgtatatttatttcaataattttatggaatttgatagaaaattgtcttattctaacaaaatcattatattattataattactttgaaagacaaataataaattgtcctgaggaaaaatgccttttataacttgtacaaaagtattgtgtgaactggttatgattccaacactctgaagttataaactcgtggattattaaaaataatgacaatagtaataatgataacttggcactagactaggtgcataacaaggattaactcaacaaatcctcccaacaattgtgggcactatgattatccttatgttacagatgagaaactgttcacagaggttaaaagacttgctcaaggttatacaactggtaagagaaggaagccactgatgccttgtgctctaagttttgccctcacgaaatgtcaagaacttctggggatttctggagcagtggtggaggagtttggggaaacctctctcctgaagaggtatccaccaagctggtcaaaattagcaaagaaaaccattcaaagtctctggagagtgatcaaagggattacaacaaaccgagaagcatttattcagcaaaaatatggagacttgataggaacagtgggaggacattgcattagaactaggggctgcaacagctctaccttgcgggaggatgttttctgtgggctcatcccacaagtggcaattcccatcttctccagctccctggggtaaaaaagttatttggggtggatttggcagccagtgaaaattacatgacagtatttttcaaagatccatgctgtggaagtcgaatattgaatcggtgccagcaaacatgcatcagtgtctgttccttcacccccaactccgattatatggggaggatctaagtggggcagctggtaagaagtcagtcccccctttttcatggctctatgttgcacgagaactattccagttggctcagcagccaagtggcatctcccatcttccccagcttcctagaatggaagaactattatgggtaggttgacagctatgaatattggcagttattattctccccagctctgcgctgtggaatatgtgtacttggtggtgggcgcagctgggtggcagtgccagttcctacttcccccttttctcttctcacagctcctacaccataagaagaactctagtgcagtgcctgggaaagaatgagttttctaatttcccccagctcctgatctataggacagacattcttccagggcagatttggagcaagcttcaaagactgtaaacactctgcccctttcaaggaactttaattggattagactgtgaagcatattatgccccagggagttgctgaaaaaagtagaacaatcagataaagattgctggaggccaatggttgtatgtaataccaacagaggtagaccacccaaagtctcaatgagaaagagacagtcaaagagaaaaccacagttatctctggcagttaaaaagactgtgtacatgcccaagtctgtgctgtctgaggcatgctgttagatgttgcacactttgaaggaaacagacttaactgaactagtccaattatgtcactaaacaaacaagaaaatgaggaaacaacaacagatcccaaaggtggtaagggagaatcaatatccaaagttgctgcaatgtattatctaacatgttctgttttcaaaaaaaaaattgtcagatgtgcaaagaaacaggaaagagtgacccatgtaaagggaaaaagccaacaatagaaactgtttttgagggagcccagagaatggacttagcaggaaagttcaaagaatcacaaagcagctattataaatatgtcccaagaactaaaggaaacaatatttaaagaattaagtaaatgtattatgacagttttatcaaatagaaaatattgataaagatagaaattattttaaaaagaaatggaaattctagagttgaaaaacacagtaagtaaaatgaaaaattcaaaagaggaactcaacagtagatttgagttggaaaaagaatcagtgaatttgaagataaattgagattatgcaatttgaagcacagagatgaaaagaatgaggaaaaataaatggcatcagagaaatgtgggacaccattaagtgtaccaacatatgtataatgagagtcccagaaagatgagagaaagagaaaggagataaaaacctatacaaaggaaaaatggctgaaaatatcacaaatttgaccaaaaaaaaaaaaaaaacccaaacaaaagaacaaaacaacacattaatctacatatccaagaagcttgttgaactcaagtaggatattgcaaaaaggtctagaccttgagacattataatcaaaatgttgaaaaccaagaatgaagagaaaatcttgaaagcagcaagagaagagcaacgcatcatgtacaatgtaaccccagtaagattaacatctgattccttatcagaaagaatggaggctagaaagcagctagatgacacattcaaagtgcagaaagataaaaacctcaaccaagaatccaacaacatattttgcacttacatatattacaaactgcacaataaatttttataattattgttttatataatttcatgtttcatgtcttttatagtagctgagagaagaaaggagggcaagtatatatttagagagtttattatgttaatcttcttattcttcatttctggcgctctttatttcttcctgtagattcaagttaccatctggtgtcatttctgtactataatacagctttgttccctcctacctttcttgtgatgttattgtcaaatatattgcatttctgtatgttataggcttaataatgcaattatatacatattgttttatgcaattgctgtttaaatcagctaagagaaggaaggagtagtaatatatattatactgtggttcaaattactgacataatgacctctgctgatgctcattgttttactgtgtggattcaaattaccgtctggtgtcaattgctttcagtctgaacaatttcctttagcatttcttgtaaggatagccttctagtaacaatcagataccacttcacatccagcagaatggctgtaataaaaaagatagacaataacaaatgttggtgaggatgtggaaaaattagaactctcatacactgctaataggaatgtaaattggtgcaaccattttggaaaagagtttttgcagtcctgctgaagtttaaccatggagttaccatatgactctaattaccctcctgggtatctacccaagataaatgaaaacatatgtccacacacaaaaattttacatgaagattcatagcagcattattcataatagccaaacaacccaaatgcccatcaaatgaataatgaataaacaaaaagtggtttatccataaaatagattatatcatttggcaataaaaatgaaaaataaaaagtactaatgtatgctacaacatggatgaaccttgaaaatattatgctaactgaaataagccagtcacaaaaagtacatgtattgtgtgattccatttatttaaaatgctcagattaggcaaatccataaagaaaaaaatagattagtggttgtcaggacctagggggaggtggaaatagggagtgactgataatgaatatgaggtttcttcttgggttgataaaaatattctgaaattagttaatggtgatggttgcacaactctgtatatactaaaaaccattgaattgcacattctaaatgggtgaatttatttgttgtgactttaatctgaataatgctgttaaaaaagaacttttatattccatttcaataatcatccaacgtggtagatgtttgcattatattttcatatcatatgaatcagtagcattgggaaagagagaagaggacaagatccaaggcccaggctcaaaaaatgtttggagcttggtttttttcttgccaagtcattcctggtatcatctggatgaggggaacggctcctgtttattttccccaatcaatcagtaaacatagttagatttgtttgtgacagttttcctgccatgcttcagttcagaaactaaaatctctgaaatgtaaagaagaggaatgagaattaaaattattatacttggcacagcacatggaaaccacttgggagtgcccttagtgaagagcctctctggaggtgtgcacatttgagcgaatgtccatgtgtgttttctggtgtggttgatacatcaggccttgcaggctggttccaggctgaatgaacgtatgaccccctttgataggacaggcttattgactgctgtggcagccctagtaatagcgtccttttgttcttcttcttcttctttcatgagtagatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgagggtgagtttttgttttttaatatttttgtatattaaatgtccagtatgtgctaggattctctaccttaaatgaatataattttatccctcacaacaagtttagaattaagttaattcaacagattagtaaactgttagtgccagaaggggaccataaacatgttacagtttgaggcactgagaaattgtaacctttccttatcccagttcagaatcaaatgagaagtagacacagaagtcaaacattatgcagattatgtattagttttcttactggtaaaactagaatggagaatacagctcaactattgtcagagtcaggcttccttcatagcccttacctccccagtatgggctttggggtgtttggcagaagacaagtttgtgaaacagtcatgagcgtaaccagctgcagggtgacttgtgtctcatgtctcttgaaccatgagatggcagggcttcctgatctgcctctagaagacaaatcctgactcgtgactgagcattctcacttcgtaaggatagaaaggagacttcctccagtttctctggtaggagacgcacctcttttatttgtggaaatgagtgagggactgaacgacaagtggatactatattatgagcctcagtggaacagacaagagaggaagaaaatgctttcttctatccatctatcagaaccttgccactttagaggtgaagacactgaggccaagaatacagggaattttatgctgcatatcagaatttcaacaatctgtgaaatgcataaataatgaaaagtggtagtttagatcaacctgtcagaagattacttatttcatattaagacttaacaaagtttaattgcagttattcagactcattttggggaaatagaataaaagattttaataaaaggactgaattaaaaatatacttaataaaacttaccgccattacttaaataacaaaaagtattgcttataaatgtttaaaaacctcctttatagttgtatttaggctaggtgcggtggctcctacctataatcccagtactttgggaggctgaggcgggaggattgcttgagcccacgagtttgagaccagcctgggcaatagagtgagacccttgtctctacaaataatttaaaaaattagcgggatgtggtggcacacgtctgtaatcccagctactcaggacgctgaggtaggaggataacttgaggctaagaggccaaagctgcagtgagccgagatcatgccactgcattccagcctggatgacagagcaggacccagttgtttacatttatttgatcccctatgatcttattgatttaattatttaataaagaatatttttaaccattttaaaagcagaagtgaagtagtatttatccaagttatgaaacctgatcaaatgtgaatttagactcatgacttacatatttaaaagtattttctgcactgcaaagcatttcataaatattattgttgttttaatatccaaaccatatgattgctgaatatttttattataattcctaaacaaatgagcactggaagtgtttgagtatgtccaaaagaccccattttaatactggtcgagttactgacatggagaatgtaatattttattctgttttgatgttttctcttacatcagacaatagcaagttttttcttaaagtatttctactaatgaataaaaaaatatgtccctatagcagctcttactgtattaaaaaattaaagaatttggccagatgtggtggctcacatgtgtgaccccagcactttgggaggccgaggtggggggccacttgaggccaggagtttgagatcagcctgggtaacatagtgagaccccttgtctaccaaaaaattaaaaacttagtgggtgtggtggcacacacctgtagtcccagctactcaggaggcttaggtgggagaattgcttgagcccaggagtttgagactgtagtgagccataattgtgccctgtactccagcctaagtgataaagcaagatcttgccatttaaatggctatttctctcaaattttgcatcaaaaaagaaaaatccttgaaataagcagtaatttaaattttttcgtatgctttagctcttaggtggatataaacttttgaaaactttcttcttccttgtgacttgagaagtataagttaatagagagtttaataatgaagccataagtaaatggatgttgtttgtcattgcccttgaataattttgaaaatttacattttcatattggttaaatttttttaaatattttttattttttagagacaagatcgcactctgttgcccaggctggtctcaaactcctgggctcaagcaatcctcccattttgaactcccaaagcactgggattataggcatgagctaccacacctggctcttcatataagtttaatccaacttttcattttggaggctcctaatgaaatgcttagttggaaggaaataactggattagaggactttagcaaataaggggggaaagagcagacttggagtgtcttgggtctccctttctgtttccccaatctctcttcagtggtgagatcgtccaaagatggaaatgaggttgttagccatagaagcttcctcatggtgattttactaaccatgcacctcacattttatttttcagcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacagtaagagttcatagaattatcttattctgggagtttcttcatatcagtgtgatggagattattaagagaaggtttaaaattaggtaaaaaaattcatataccttgcatgattcttggaatgggtccaactttctccttcttcctcattgtgtgttccctttcttttggcctcttcagtttcctcttttctgaatcagtgaaaatagacaacatgtaataaataagctggacttttcaagttatgtgtttttgtttctttgtattattctctttcttcccttatttctggtccatatgtctcaatctgcagaagaagaactgtcgaaatctattgaatctgcctttctgaacttgtttccttcttcttcctcaaacagcagccttctgttacctctgagccctccagtcagaccatcacccagtgtagaatgcctccttctgcttctccaaaaggctcaagtgggccaggcatggtggctcacacctgtaatcccagcactttgggaggctgaggtggggagatcacctgaggtcaggagttcaagactagcctggccaatatggcgaaacctggtctctgttaaaaatacaaaaaattagccaggcatggtggcgtgggcctgtagtcccagctactcaggaggctgaggcaggagaatcacttgacctcgggaggcggaggttgcagtgagccgagatcacgccactgcattccagcctgggctacagagcgagaatttgtcccaaaaagaaaaaaaaaaggctcaagtgttaatgcattccaccctcctccctgtgcttgatatctctatctagcaatggtgagggctcattacccctattaggagcccaaagtgatcaggcattagttgcagcttatccatcaataggaaaattcctatctcccacttgtagaaatgttcccactttgccaaccaggtcttttaaacctgcaggtcccagagcttcagagatgtgaagcacaaatttcccaagtaggtcacttagactggtagccaatggggccactcatgcttccatcccctggttcctggacccatgcatttattttactggggacccagagccatataaaagtcgatatgattcaaaataaatacagcattttggaagatagtatcccatcactgtcaagcattgcctcccagctggcacttcaactgtgcctttaataggccattcagtgttttcacaggttggcaggttctgaatgatgcagtatgtgatttgagtagtggattccatgagcatggtcccaacaacacaccttctttgctgtgagtgggttttctagttggatgtagtggatcctatgccaatgccaattgttcagacactctataacccttaagatgaccgtgctgactgaggttctgcaaggaagaaaggcaaacccatgcctgcaatatttgtctagttctatcagaatacacttctcttcctttcatggtagaagaggtccaatgtagtcaacttgctaggaagtggctttttggttgcctcaagtgatggtatcatactagggacttagcattgttgttggcacgttggagattcagtgacaacagtgagccttggtgagtgggagcccatgctgttgggcccatgcttgtcttccatgcatgccaccacaaccactctgctcctcttcctcttgtgccagcacccatgaggccaataacagagaatggcttacttcaactggctgagacttttttacttggttgtttaataccttttctactggggatgctctggtgttaacacacaaaataaagatcttcacacttcctgcccactctcatatgtccacttacctgctcctaccccagatctctttgtgcccaatcttccaatctttcttcttacaggactaggaccttgaccagacaagccattcattccatgccctgaatcctaatttagcctatccttaggccactttctttgggtgcaccatctatagcactttctttcaggaagattaccccttacaaattgtctttcaggactgaccttgattgggctgtaatgcagcttccattcattttagcttgtacacaccaaaggagtgaagggcatgccatttcaaaatatgctgaattggtatgttgaatatttcaagtggaaaacattagaggaattggagtttcagaaagggctagctgtcctgtctctttttgcatgcacgagccataaagattgctctgggaacagtaccctccccctactagagcaagaaaatcaccctcatcaccagagactgggaattaggggctgcagtggacctgaatactaaacttcccaaagtagtttttatcttccactagttttacagcccctccctatacatctcttagtgactctcctagaaatttattgctcctagccaaatcctctttgtcctgtcatttcttcttaaatttattgttctttgtttacaaagtataaaatatcttgctttggccacttcttcagactttaccctcttgggaagatccccatgtatgtataaaatttgtgtgcttttcccttgttaatctacctagtgtcaatttgatttctagatccagccgaagagcccacataagagctaaggggattaggggtggaggtgatctctcacttctctacaacacatactgtgaacccaaaatgtctgagacaggtctcaatcaatttagaaaatttatgttgctaaggttaaggacgcgcctgcgacagcctcaggaggtcctgatgacatgtggccaaggtggtcggggtacagcttgcttttatacattttagggagacataatacatgtaagatttatactggtttgatctggaagggtgggagaactcaaagtggtgtcggggaaggaggagtggggctgggcttctggatcataggtagattttctgattggtaattggttgaattattatcagaagaaaggaatatctggtttatgataaggggttgtggagatatgttttgttttgttttgttttgttttgttttgttttgttttgttttgagacagagtttctccctgttgcctaagctggagtgcagtggtgcgatctcggctcacggcaacctccacctcctgggttcaagagattcttgtgcctcagcctcccgagtagctgggattacaggcacatgccactgggcccagctaatttttgtatttttagtagagacagcgtttcaccatgttggccaggctggtcttgaactcctgacctgaagtgatccgcccacctcggcctcccgaagtgctggggttacaggcatgaaccaccgcactgagccataaatgtttcttattagatttaagatctgtgttggtgttaatgttggaggggtataatggggaatgtccaaccctctcttccaacatggcctgaacaagatgttcaggttaactctggaatgccttggccgagaggaagggtccattcagatggttgggggaccttagaattttatttttggtttacaataccaaaaatatttatctgtgaaccacgttcagagttttccccatccggacagtttggttatactggataactggtatagccacaactgtgagctaaagaagaggcactcctgccatagtggctgggcacaggtaggaattgggttttctgtttgtgcagcttgcctgtgccaccttttactgcccatgctcaatcccagatgctctacttccatcttataatgaatggttgcctgcttataacctgatgggtctgacagacttggcttatgatgggtgattctggctgcatgatcacttgatgacccaatgttgggagctttctctatcaggacctggtagcatgccaagagttatatttcagaaagcatacagtcctctactgcagtgcatggccttgcttcaggatctcaaggatctatggtgtaactgtcctgttgacatttacatcttttcctactacaaccaccttcaaatacactaggttctgctgggtcctaaggctcaagcaacaggataatttcactgcagactagacctgctgttaagcactttcctaacatgggccccgctcaaacctggcaatcatttgtcccccctagcctatgggttggagcagtaaccccagtatgaattatgctgcctctagaatctgaaaagtcctatttaggtgctgtactgcattcttcagagtgggatgtgcaatttgcaataatttgactttagtttggatgggatatcttagtgttccctgaaccttggacctctgaaaattttattgatgtggcaaacacctgactctattttttattgtatttttttactttggagcatcatcatgctaatacctcttgcttatctgggggaattaacatgatgccattgatatattggatcaatgtcatgttctgtggatatccagacggtcaagatatattcagactctattatgacatgggcaagagggttatcatagcccaaaacctgcaaatgtacactcctcacaccttccatgtatatgcaaactgtttctgctaggaaaggaaagaagggcctctgctgaatcagtgacctcgtttacttgaagccacattaatctgccctagcaaagataccacatctggtgcaatggctgcaataggaactaaaatgtggtgtctttttttcagtggtatactgtagttcttcagaatccttctaatttttgtagtagacagataagaatttaatggaaatatcacagggatgaccactcccatgtctttagctatttgaacggcactaattttcatgtttctctcccacccctgggagatattgtggtggtgtttttttctttaaatttactttatttgccttggggagagggtgagatgggtggacagtagcaattgctttcacttggtcttcctgcataagatggctcttaccccgcaggtcaagaacccaatataggggctgggccaactaccaattttgtctattctgactatacgttcaaggataaggtagatgaccacaaactggtctaataggagagctataatggttccaggtatcaatgtcaactcaagccctgtgtgcaataatttttgaattattgtacctcttttatcagtgcagttacctacgtaaataaacataggtcctcttggaggactggcagattcattactgtgcaaaccttccaagattttgtagcatcttcactcctggcaactggcttcatcttcaattaatgattaccaggctggaaaactgtcctaggtttatatattgggcaaaggattgtgactttttattgggccaaatgctgttggtcccttgatcatccatccttaatttcttttgatggtacaaataaagtgtatattgttgttggctgctcatctgttttcacccctaagaatgctatggtttaatcttcataactctcaggcacccctggttgcctctctgaccttgcaattcattataatggttgcatttatttagcttctgaggcatatgagcagctttctgactgctatggctatcagtgaacctttttcattaatgaccttttttgtcatcagctccagcatttgatgctggttctcctcttttcagggaattccttatagctttggtaaatattgttccctctaggacttcccatgtggcataactacctggtgcgtttttcagtgtacacaaatgtccactccagcatgctcacttccctgagtcatttaatcccttcttataccatctgccatggcaatcccagcatttcagtctgacttattgtgggccatcagcttttccatgcttccaggagcatcttattgtagtacttataactgccatagtccactggtatagtactttgtccgacattcctgctgctctgcttttttttttttttttaactttctcatgcagtgtttgtggacctgatagtgttccctttcagagaggtgctctgcaccatgtcctcttgactatttcaatgttcaagtcaccatattcatttatccaatgagctcttttctatagttttttaaaatgcaatattttcttcttgggcatggatggacagtactgattggggagcaatgactcagagattgtggatgatataacatccttacagtttctcacagatgcaaatctctgcatttagcctgaaagtgactaagtgtactatgagtatgatatgacctaaggctgaattcaaccttcatgccaaaatggctcctaaacaatggaaagttgagtgaacttgtcaataagatgaaggaaaacctaagggctatatctcgagcctttctatggttgcccagcttgaggcttacaggaggagagcagaagtgtctgggtttggctacgtgctcttacaggcagcgaggatagaaggacagaatgaagcctcctacaaactacatgtattctgcaatgtgctactttatacactttacaaactaatgctctctcacttttttgtctctccctcaagtttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaaggtaactccagcttccttttcagctcaagattaagtgggtggacgtgtcctgagagcactgagagctaagtttcttccctgtcagaggcagcatgaaaacatttgatttgatttatattaaataatcaatatatgcaaatggtacccaatgcaaaaactacaaagggcacacacaaacattaatctcctccatttctttctcccaatcacaaaattcagccttcttggggcagcccataccaggtttcttgtatatttccagaaatattctaaaagtatcacattttatcttagtgtacctgtggcctgtggcaaagtttccatagaaacttgctctagtatgaatataggctcccctgagtgaattctaaatatcatgagtgacagttatttccaccagagtctcgtgcagggcatgcaccacctgctatgatatagatggtgtgtgttggtgtgaggggtcagggagggtgaagggggactcgtagtttgcagcagttgtggggacaggaggagttgagatcaggtctgatttttacatgaatagaagtttgctgtcaacatgcatgactttgctgtcaaaaacttcagtatttatttgccatcattgtttcttttgtacacaggagaataatagtcaagaaggaaattttttttattatactttaagttctggatgacatgtacagaacatgcagttttgttacaaaagtatacatgtgccctggtggtttgctgcacccatcaacctgtcacctacattaggtatttctcctaatgttatctctccccttgccccccaccccccgacaggccccagtgtgtgatgttcccctccctgtgtccatgtgttctcattgttcaactcccacttatgagtgagaacatgcagtgtttggttttctgatcttgtgatagcttgctgagaatgatggtttccagcttcatccatgtccctgcaaaggacatgaactcattcttttttgtggctgcatagtattccatggtgtatatgtgccacagtttcttaatccagtctatcattgatggacatttgggttggttccaagtctttgctattgtgaatagtgctgcaataaacatacgtgtgcatgtgtctttatcatagaatgatttataatcctttgggtatatgcccagtaatgggattgctgggtcaaatggtaattctagttctagatccttgagaaattgccacactgttttccacaatggttgaactaatttacactccaccaacagtgtaaaagcattcctatttttccacaacctctccagcatctgttgtttcctgactttttaatgatcaccatcctaactggtgtgagatgttatctcattgtggttttgatttgcatttctctaatgaccagtgatgatgagtattttttcataggtctgttggctgcataaatgtctgcaagaaggaaatttttatacttagaatcttgcagcaatcaaaactgtgagtgacagttacctcgttagttgggattctggggtcacataccttcttttagaaatatcctgtcatggaaacaacatgctggagaggatgtggagaaataggaacacttttacactgttggtgggagtgtaaattagttcaaccattgtggaagacagtgtggcgattcctcaaggatctagaactaaaatacgatttgacccagcaatcccattactgggtatatatgcaaaggattataaatcattctactataaagacacatgcacatgtatgtttattgcagcactattcacagtagcaaagacttgagaccaacccaaatgcccatcaatgatagactggataaagaaaatgtggcacatatacaccatggaatactgtgcagccataaaaaagaatgagttcatgtccttttcagggacatggatgaagctggaaaccattattctcagcaaactaatgcaggaacagaaaaccaaacaccacatgttctcactcataggtgggagctgaaaaatgagaacacatggacacagggaggggaacatcacacactggggcctgtcagggggtggggggcaaggggagggatagcattaggagaaatacctaatgtagatgatgggttgatgggtgcagtaaaccaccatggcacatgcatacctatgtaacaaacctgtagattctgcacatgtatcccagaacttaaagtataataaaaaaagaaatatgttgtcatattatatgaaaatgttattactttgagcaagtgtcttaatgtatctcagctgtctcttagataaaatgggaataataacagtgctcatttcatagggctgccaggagacttaaatgatagcaacataaagtgcctagcagaagtctgataggtagtcatactcaataaaatgctaatatgaatgttttcaaatgaagagaaagatagaacaattagcagaactaaatacagttcattcttattatccgagactgttatcatgtccttcttcatagatttacagatttcttaaaaatatgtttccattacagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggtaagtggcacaattcaaggaagttctgtgctgtcgacccctaaaaatggtggcatcccccagagctctgtaccactcaacaatggtgaaatctgacttgtcaggattcatttctgagccactcccactcaaagaaactctttttgtcttgaagcattctggtaagttaggggtggcaagttctcctgttctcacttgagaacaggaaaaactgagcccttacagagcagggtttcatagacccagtagtactgatttctagcctaacttttgctaagctatataatatattgttgttccatttctggatggtcagcaaaaacagcctctgttaccatgggggccttctggacagctgtctcagaacagatccatgttcccctggggaagactgtggtgggacccaagtgatttcttgttttcccagcctcaaccaccagtctgaggttggtcttggttcaatcctgtagtccttccactgtcaggatccaccctcctttatgattagaagagaagcttctcaatcacacccaccacttatatcttttaggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaactattttgtctttgtggtcatttaggactctgtgaaataagcgtccttaaaaaacccataatataaagttaatacattaatacatttgttttactgtttgggccacaaataataggtacttgggttttcttttttttttttttttttttgagacagactctcactccgttgcccaggttggactgcagtggcacaatcttggctcactgcaacctccacctcccaggttcacacaattctcctgccttagcctcctgagtagctgggattacaggtgtgtgccatcatgcccagctaatttttgtatttttagtagagacggggtttcaccactttggccaggttggtctcgaactcctgacctcaagtgatctgcccaccttggcctcccaaagtgctgggattaccggtgtgagccaccatgcctggccatacttgggttcttatcgtggacagactgcctttactccacagtttcatgtgtgcacagcactcatgtcctccctggtgaggttaaatgtcaacacaccctcaaagcctcccccattctcccgctctgggggagtcacgccttcccctgagcccctgtgcacgttgtctctttgactcatgccacatctccactattgccttccatgaaggaagtttgcttttgtgtctgacttcctcattccaaccccagagaaggaacttcgaaagacagatgaagatgaagcccacatgtcagtcctctgcatattctcaattcttctatctgatttggtcaccattttccttaatattaagttaaaacaggttgagcaactgccccacacaggaagagatatcccatatcaaacttccttatatttctgggtactctaggaacttttattcctttaagtcatcactttttctgactcttgcttcctgtgcagtctctttctcactcttatctcagctcctctggctgtcttttctctccctgcacacagaactctggccttttgaacattggcctttttggcttaattttcccaaaattatgtgaaggaaatggcattatggcaggctttcactgaactttagatgtaacagaggaggtggtgctgttggagaaacccactgctatagtttgagtgtttgtaccctccaaactcatgttgaaagtaaatccccaatgtggaactattgaaaggtggggtttttaagaggtgactggttcatgggggttctgtcctgatgaatggattaaaccattcatagatgaatattttgtgtgctaatgagaagaatgtgttttcgcagctgttatcacagaagtgggactggtggctttataagaagaggaagagagacctgagttagtatgctcagcccccttgccatgtaatgccctgtgccaccttgggcccctgcaaagtccccaccaagaaggtcctcaccagatgctgagccgtggccttggatttcccagccttgagaattgtaaaaaataattttttttgtttataaattacccagtttcaggtattctgttataagcaacagaaaatagactaagacatccacttaacatcaaacgtatctatccatgatcttaaaagccattacctactaggctactaggcatttcttggtttaatgtttatttttgaatttcccctgatacaagaatttgtgagcaactagtttccctgaaaggtggttccagaaaacactgtaagtgagtgggcagtaagatggagaagggaagaaagcccattagggaacattgttgagggggttatttcattgccaactgggactcaatcatgctggaagcatctgagagcatgtagaacccaactctgagttgtcctcctcaggaaaaagacctgggtatttttctgcctattctcttctctcactggtgaagttttgctccagtagcaatggctcccagacccaagggatctacactgttggctggctgagcaggctccaaggatggggctcaccatcagtcagagaga

SEQ ID NO: 14943 - DNA, 14514 bp, Human
tagagtttctggatgacagtttttttcatttatttctgcattactttcattcatttaacagacaactgctttgcaatatgaagcaccgtggaagggaatacaaatacaaatcagacacaaaccctgtcctggagttagcagtttcctgtgggaataaaggggaggaaaaaaacacctttcctctaccatattgtattcagtggctgggacctgcaaattagactaagacagattaacaggagagaaaattctatttatacatgtaacttgagtacatgtgggaaaactcagtgataagtaattcaaaaagttggttagaattggggcttatacatcatcttaataggtgaaggtggggagaagaaaggcgcttacaagaaaacagattattggccgggtgcggtggctcatgcctataatcccagcactttgggaggccaaggcgggtggatcatttgaggtcaggagttcaagaccagtttggccaacatggtgaaaccccatctctactaaaaatacaaaaattagccaggcgtggtagcgcatgcctgtaatctcagctactcgggagactgaggcacaagaatggcctgaacctggcaggtggaggttgcagtgagccaagatcatgccaagacaccatctcaaacaaaaaagaaaacagattattttttggaaaggcaagtgggttttcaggggaaaagtaggaaattagaaagttttgtgataatgtttgtgtatataagtacgagtgttctttctgtctccttcaaggccatgaaatttctctggagaaggaatttgaaatatgttttactcatgctctcccctccaggatagacctaccctgaaaaggaatttatggcaaccttatctccaaggttgctgcctttagtcagataaggaaagcccccaaaatctctgttcctttccatatcactgaatctcaaatatcttcagcttaaaagaatcttaacgccaaatatttgggggtggcatatcctgattcctttcaggagaaagacatagattaatcatcacaaacagtagtaatggatggagaagagaagaacatttgcaaccttactgtgtccttaatgctttattattctattaaaacctgaaattttgtaggaatttttccccagtttcataattacagcacagagaaccaaccaagggttatagtagtcacaagcaagatgatatgggatccctcaaaacaattttacatgccttaattcctgagaccaaagcattctcctcacctctctctttactcatttggttaactctggactcaggccaaatcctgtccctggaagagccacaaagtaggaagcctgggtacaggcctggcaagcgagaacaatgtgtcactgcaggactttggagctctcagctttggagtcagttaagaccagttccttgctgggaagccctaactctggagggacagagacaggtaaggttagtttacttccttgagctttcgtcttcagtgctgcttacagccttaggatatctggtattcaggaaaggaggatgaggtagcattcaaaattgtgttctacctgggcaagaaccagggattgacagcccgttctctttccccagtgctggccagagttacagaagttggactgtaaacattggcaactattgacagaagtcaaggtcatggcaagaccatttggcccatgtttgttggggaaggataagcctgcgtttcaaaaagactggtcaactggatttgcattcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatggtacgtatgctttccttcaactcagcttacaggcatttggtgtccgtttgcggtgttttgaggaactctgtctagggctttaaggaagtttacatttataatatctttattcttctattgaaaaatctcaaattggcctaatgctctgcactcaataggagcttagtgtacatttaatgataaccctgatctctgaagtgggtggttactgtttttttactttccctttctgttctgggagcaaaaagagtaccaatttcaaaatcctgggaggtcttacttgttataaactccaggatcgctatttgtgtaggggactatttgtttagaagtggacaacttgtggttgaatttgagtaaaattcctgttatacttttgaaaataaaacttcggaaatccggccgggcgcagcggctcaagcctgtaatcccggcactttgagaggccgaggtgggcggatcacgaggtcaagagatcgagaccatcctggctaagacagtgaaaccccgtctctgctgaaaatacaaaaaattagctgggcgtggtggcgggtgcctgtagtcccggctacttgggagtagaatacagagtacttgggaagagcacaggaatcaggatcaataatccagcaaaaagacatgagaatggggaaatctaataagggttctctgacagcacatgatatgccaagtgaatctgttttcttttttcttccagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgctgtgagttagatctttctgtatctttgcccatattgatatcctgttttactccttcacatcctacttcctataggctgtggtaaaactttataagaaaacaaaaattctcaatttctaggagacctcttttaaagcactccagtggaggagcttctcttggaagctctatgatcagatcttgatcagtattaattcagttgaattaacagaatcaattccctctatgggaaagaaataatttcttccagatattagaactaatttttttttgctataatttgtttaaccttatattgctttaaaaatgtttatgttatggaaaatttaaaatgtatacaaacgacagaagagtcaaattcactcatatagactcatcacataatttcatcaattatccacacatgataatcttgtttcatgtatatcctctttattattttgaagtaagtgcattgtatcattttatttcacctatcatataacttttgaactgggaatagtttgtattctcagtttaccaatgtgataattgagatccagctgacttgctcaaggtcacaaaactcatttctggtatcctctgtggagatggggaataattaatccatatcctatttattactattattttttaaagaatagttgcattagttctcttgtatacctagagtagagcacaccgatattattatccttcattcatataaccaaactcatatatccctgtgcattctctcctgtttttttccatgccatgggaaaaagcacaacaaaataaaaaatgctaagtaagtgtatatttggctggttgaaagggaaggaaatacttgcttcaaacatagtctcactattttgagccatgcttaatataacagtacaataaacatacgattggtaactttcagttacgtgattaattactttcagttgccaattcatgttgttcttgtgcatgacaaagctcttttgggctgtacttaggtcaatctcctctttttttcattctgcattgatatggtagtaccatgtacttcactcaattaaaaatgtgcagtattaactctaatttgctgttttctcactgaagactgaggaggtctggcctttgctgtgttgggcttcagctttgccctttcagcttattgcttattttcttcttcagtgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagtaagtacaagagaaaccatcaaggatccccaaaatactgattagtagtctaaacttagacatttgccacatccctgggatgcttttctctttttttgtatcagagacaggcttaagatctagcagacagccatgaaacaagtggagctcacagaaccaaatctcacctcaagagaatacattccattgcaatgaacagcatccaaagcacacatttttccttctcagataggggtcctgtcctactaggtgtaatgtagggtagtttggagcatcgactattttatttcttaatttcaagacagtgactttgtttgaaaagtaaacacaaaacgggaaaaagatcataactcatctattgcaaaattatctacaagaggctaaagaccctctttctatcactacaattcatatctctcagagttagtaaattgggtgtgtttatttcatgactttttcttatgtttatacagacatttaaaacaaacacacacaaataaaatatttaaattaaataagcattaaatgccattttgtgtgtatgtatatatataaatatacctatagaaaagggacttgctatacatatttttaaattgctttttttcatgtaactatatacatggccactttcctacaccagtccatgtagctctattgcccgctatttaataactgcatatgtgtatgtcataatttattatatggctcccatattattttaatattttttatatttggaacaatgctgaaatgaatattttatacacacacatattcttatgtctacgttgttatttctttctttcttttttttttttttttgagatggagtcttactctattgcccaggctggagtgcagtggtgtgatctcggctcactgcaacctctgctgcccaggttctagcgattctgctgcctcagcctcccgagtagctgggttacaggtgcctgccaccacgcccagctaatttttgtatttttagtagagacggggtttcaccatcttggccagactggtcttgaactcctgatctcgtgatccacccacctcggcctcctaaagtgctgggattacaggcgtgagccaccgcaccaggctactacattgctatttctataggatagattcctaaaatgattgctggatcacaggatgctattatttgcagaatatacttcaaatatccaagaaagtctactaaaatatttaatatatacttggacacaaaataaatattgaaaaaaatcaatgttttcattttctattaataattgttagttgaatttgaaatgtaaaaataattcgattcacaagatctatatgaaaatttactgaaagatataaaataagacttgaatgaaagaaaagacatgcatgatcctggatgggcagacttactattacagtgcaatgcctcccaggattttaaattcaaaaatatgaaaaaaacattaattaaagaatctcatccagtaggatacacatctaacattgtaaatatttttgggaaaatgatgaatgatgtatacatttgactggatcaaagggaaaggaatacttgccgtattagatagtaaaaaatactacaaagttactatgagcacaatatggcaaactgtaggtactacaaattatatatcattaaaatagcaaagtataggtacatataagtagaacagattaagtcaggaggaaaagtctattcaatagtgatggaataattatctatttggaagaagacaaagttagggctctagctcacaccatattcataatacattccaaatggattttaaatatataactatagaaagcaaaattattaaatcattaaaagaaaacatgagataatatatttattacattgggatggggaaagccttcctaagcagtttcataaaactcaggaagtcataaaggaagaaaatgggcagatttaattaaatttttaaaagaaaaacttctacatactaaaagacatcatattgaataaagtatttgcaacatatttgatggttaaagagttaatgtttttaataaacaaagatcccctagagatcagtaaggaaaaaaacaacccaatagaaaataagcagttgggtaaggacaggcaattccaaaataatggccctaaacagcacttctatctcctgattatatgaaaggatattgaacattacaaatgattatagaactggaaattaaaattagatatacatcttttactgatcagattagcaaaaaatgaaaagatggatttaatttaatactattcatgacctgaggaaatagccatttatgtcagtgagagtgtaaagtgctatcactatttggatgtattttggcagtagctactaaaataataaaagccaggcgtggcagtgcatacctgcagtcccagctacttgggaagctaaggcaggaggatagcttgagtccagaaatttgaggccagcctagacaacacagtgaggcctgtctctaaaaaaaaaaaaatgaaaaagaaataataaagacaggcagtttaagagcacaaactatatatgctcttacatgagggaatttggggttatttaaaacttgcatacatactattatatatacagttaaattacatgcatataatagcattttatgtcattagcttgacacaagtttaaagtatttccttatttcttccaaacattttctggtttactctcttttaattcagtagtttctatcctagctcttaaccacaggatccctgtctttttatgtcacttcattatctaaatctaggatgagctccctaggtttctgaataaaccagattctttctgtttattctgtttaccacatcatctccttccgttcaaaattgtactcataaaagttaccagaactctggtggactggaatcccccaaacaactcctggcaattcttcttgctttcctctattcagcctttgagctcagtctctgagctttaaaaaattacagtgtattaactgcataagtaatattaatacacctttgttgtagaaaaatatagaaaataaaagacgaaaccaattacatacaagccatctaaggataagggcattaagtattttggcatataactttccatacttttttcctgtgcttatgtatgtgtaaccatgatttacaaaaataatattatacatgctctttcatcatctgctgtttttactcaaccatttgtttagaagatttttatgtttcagtaaatatacacccacataatcattgttagccactatttttgatcgacatgtttagtgtcctgtggtctcagagctgactgggaccttagagatgatattatttaacctgcttatctgataatattaggaaggaagccaagaggagcaaaatggctttagtgctacatagctagtggaagagccagtatcaagactcacaactcctaacacgtcatcctgctttctttccacagttccacagactcgtcctcttcccttccagccatgttctcccctatttctttttcttttgagacagagtcttgctctgtttcccaggctggagtgcagtggcagaatcttggctcactgcaacctccacctcccaggttcaagcggttctcatgcctcagcctcccaagtagctgggattacaggtgcgcacccacgctgggctaatttttgtatttttagtagaaactgggtttcaccatgttggccaggctggtctcaaattcctgacctcaggtgatccacccccttcagcctcccaaagtgctgggattacaggtgtgagccactgctcccaccttctcccctttttctgatactctctttgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgtgagccaattaaacctcttttctttataaattacccagtctcaggtatttctgtatcacaatgtgagatggactaatacactcatgtttcacaactcttatccacaggggatgtcagcttccacttgagctcacacgcttcatctcctctctcagggagttatttcttcagccttcacctatggcccaatttttcttttcttgtacattaacaattagcttctctacaacttaaaatttctttccttgagctcctgctgtcagataatactcccaaatccctactaactcagaagatgggctgggggaaagctctttcccatggacaaatatgatttagaagagaaggaaatgaatgaagaacaggtttccagatcccgcaggtgttgctgtgaggatgtcaggtgctggcgcaggtgttgctctgaggctgtcaggtgctggcataaacagctgcaattaggggtgctgttcattgagcgtgcctggccctcataactatgacttctatactcgtttctctcaggggactgtgaccctcctgggaatccagttcatggctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctcattctgattttgagagctgctttggccctctgctagctctcctcaatccctagaagacagactgatcctactaaagtatcctacttaccccaatgcaagtatctctttttcctctccgccaagacaagataaattatttaaaatgaatggatttggctgggcgtgatggctcacacctgtaatcccagcactttgggatgctaaggcaggcggtttgcttgaggccaggagatcaagaccagcctggccaacatggcaaaacccttgtctctactaaaaatacaaaaattagctgggcgtggtggcacactcctgtaatcccagctactcaggaggctgaggcatgagaatcgcttgaacccaggaggcggaggttgcagtgagcctagatggcaccactgcactttaacccaggtggaaaagtgatactctgttttaaaataaataaataaataaaatgtatgggttttttgtttttttgttgttgttatttttgagacagtgtctccctctgtcacccaggctggagtgcagtggtgtactcatagctcactgcaacctctgcctcctaggctcacgagatcctcccacctcagcctctctaatagctgggactacaggcatgggtcaccacgcttggctaattttttaaggttttgtagagacagggtctccctatgttgctcaggctggtcttgaactcctgagctcaagtgatcctcccaccttggtttcccaaagtcctggaaagtgctggaattacaaacatgaatcactgtgcctggcctaaaatgtatgtttttctaaaaaaaaaaaaaaaaaaaaaaatcagagaatataaatactaaaaaacaaacatagaagtgcagaaatataaagacttagtgtatagacccttaaagccccctaattaactcagagtcatgtggcctcactggcatttcgatctcgttatataccttcaatgcactttgcaggcaactctcatatttttctgatgaaaagcaattgctcctttttagccccttcgctaagatttatttgcaggtgtctctcattttctactcctttttagagcttagatgccagatgcctttttaggttattgaatgataaagtgcttctatcactctccccacccaaaacctgggtgtgtaaacacctgattcagaatttctcacttctctatgttttatgggttgactcatcacttgggtcctctcctacctccaggaaaatggttttactttgaactgctttgtaataccgagataacttaagcatgcattgaggctcaagggcagggaggtggattccatcacagcatgaaatactgaaatacaactacacaaaaccagtctccattacccaattcagaaagtggaaaagctaagccttgttctaatttctgttcaggtactacttagtgggcgtgcaggagcagcaatgcgttgatggggagtggagcagtgcacttccagtctgcaagttgatccaggaagctcccaaaccagagtgtgagaaggcacttgtaagtaggaggctcatatctgtcttgttcacagctggatctccagggcctggcatcactcctggcatatgctcagtatatatctgtttaatgtgggacattttgcttttgaatgggttggccttggcctggctgtagaagggactcataaactattaactcacatttttataaatggaagttggaagttcccattcactaccatcatcacaaatacctcatgagaccctgttggtagaagttgttgtctcatgtgccttatagagcagtggttcccaacctttttggcaccagggatgggtatcatggaagatgacttttccacggatgggggtggggagagtggggatggtttggggatgattcagatgcattacatttattgtgtactttatttctattattattacattgtaatatataataaaatgattatataactcaccataatgtagaatcagtgggagccctgagcttgttttcctgcaactagagggtcccatctagttaggagtgatgggaaactgacagattatcaggcattagattctcatctgggagtgttgggaaacagtgacagatcatcaggcattagattctcatctgggagtgatgagagacagtgacagatcatcacacattagaatctcatctgggaatgatgagagacagtgacagatcatcaggcattagaatctcatctgggagtgatgggagacagtgacagatcatcaggcattagattctcatctgggagtgatgggagacagtgacagatcatcaggcattagattctcatctgggagtgatgggagacagtgacagatcatcaggcattagattctcatctgggagtgatgggagacagtgacagatcatcaggcactagattctcatctgggagtgatgggagacagtgacaggttaccaggcattagactctcataaagaggggtcaacctagatccctcgcatgagcagttcacaataggtttcacgctcttatgagaatctaatgccacctctgacctgacaggaggtggagctcaggcagcaatgtgagcaaagcagagtggctataaatacagctgaagctttgcttgcctgcccgctgctcactttctgctgtgtggcccagttcctaatagtccgtggaccggtaccggtctgtggccctggggttggggatccctgttatagagcaaagcacataagcacaatgcgtgagaattggaaaagtctctaaaattcttctaggctccaaaactaaacaaacaacactgaacagatccattttcattgagattcttcttttagttcatatttattactgggataatattaataagtatatttaagccagaaaatataaatgatttgccatgttgaaaacccaaatctttacttaagctagcctggttctgagcccccattcagagagctaactgctgctcactggcttcagagtatatagctgggtctcagtccttatgttgtaacttgtgaaaaattttctttcttcagcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaattggtttcagatttacctcttattgggctgaaattgccaacagcagttgtataatgcaccatgtgtgtgtgtgtgtgtgtgtgtgtgtgtgtgtgtgtgtatgtgtgtgtgtgtgtgtgtgtgtgttgttctcagaatgtgaaaaggccaaatgtagtggttgtctaaggccagaattagcaacatattattggagaatagagggcttaattccagtctgtaaggagaatggaaaactctgatctcagccgagagagtaactcgtattttaacatgagaccatgaattatgaaaccaaaactaaccgcaacttatgaggcaaaaattaaccttccattttggaaaagatgcttagaatagttacatccttaaaaatgacccactgggacagaaggagagctaggacccaaattctcctcccagtcttgcccacatctggcttacggaaacaggtttccaaagctgcaggaaaattgcttactgcctcttgaatgaaacctggtcctgcatgataaattagagatggtgcaacacaagtgaatatatttcttctcttttttagaaacaaaaattttatattattttttacttacaattctccttttttagagggtagaagaaataagaatcctaaggctttcaatcaaaatgtcatactgagctggcatgacaagcttctcccacctctcgtcctgactgctacctgaaacacgtaggatatctagataaagtgcaaccaaaatatataagccagcttgaaataatggaaaatcgctaggtaaagttatgaaggggaataagagatggactcttgagtaccccagagtctactaataggcacaagacatgtacacacgtagcattattttagagtggttagaatgaactaaacattttcagacaacagtgggctatgagagctcagatgagaggaggttcacttctgtctgggaggaggaggcaggaatattgtcaaggaagaagtcacagttatttgggccttcaaaagtaagtgagaattagagacaaagattaaagagctcattccagttggaaagaatatttgagaaatggagtaagacaataataagatttaaaaccaatttttttttttgagatggagtttcgctcttgttgcccaggctagagtgcaatggcgtgatctcagctcaccacaacctctgcctcctgggttcaagcgattctcctgcctctgcctcctgagtagctgggattacaggcatgcgccaccatgcccggctaattttgtatttttagtagagacggggtttccctatgttggtcaggctgtctcgaactcctgacctcaggtgatctgcccgcctcggcctcccaaagtgctgggattacaagcatgagctaccacgcctggccaataataagatttttaaccaagtaaattcattcctaggattaatctaactggaggaaaatgatttgaaattgaagctacttcttatttgtacatattatctatctaggaggatcttatgagcatttgaaatgtctactcttaggaaaattttgaataaattatggtactttaaatgtaatgcagacctatatggtgataaatatgaggaagtagaaaatcttaaaaatacaatcttaagtaaaaatagaatatttaataacaagggcttatgattgcatttatgtaaaacctttattcttgtgggaaaggattagacaataataggcacagataaaaacatttgtcttagaatatgaaattataagtgtttattctcttaaaactttttaatgttgtaaaatgaatttctaataataattttagaaggcattgcacagaggcagaaaaaatgggatatgtttaggaacttgcacatagcctggactggcctagatgaagcatggaaattggtgagagagaaggtggctggaaagataagtcaaagccagtttatggaggcttttgaatgacgtgctagagaatatacacttgtttttggtaggca

SEQ ID NO: 14944 - DNA, 44393 bp, Human
  misc_feature (1)...(44393): n = A,T,C or G
atttgtatatgcataaaatatttctgaaaggaggtcaaaggaacccataagattgattatctcctagaaagacaactgtgtggttgtggccagaagttagagagagacttgttttttaatccatatacctcttttcacttcttgaattttgaatcatgttaatatctgtcaaaatatatgtttatatatatatattcaatggaatcattgttgaaatatatatatacacaaacaaatacacatataagtcatagaatttgttccacataactttcatttccttgaaatgctaccaagagttccaagaaaaaaggtttcaaggcccccacttagagaacgatactgaagttgatagatacttctttaactatgcttaacccacatgctctccaaacccattttcccatggaaccctcttgtcaagtaatatctgttttcatctctccagatactcctgcttatagaatacactttgggaaatgctattattaatatttaacacccaggcgaaagggttacactgtttcattaaatgaaagaatacatagagcctggcacatagagagcatttaacaaaggttagctattattgttattattatccacaaatggcattgattccattttgtttaaaaatggggggaggtgttatttatgagtatggagacaaaggaaggttttgttttcttcttttttcactcctctgtattttttcattttctaaaatgaacaaaattattttacgagaatcattgtgtaagcctacgtcatacatttttaaagtcttcctttctgtgcttcctctgtgccctgtgcccctctcatctactccctgcgtatatgcagcagctcagggtgaagttcaatgaggggacccctgttctagccaggccctcttgcctgcctttctccagagccagctctggcccattgtcagcactctgagttgctagggaaaggaccaatggccgagacagggccaatcagttcccagacaactccctggctccaacagaccctcccttctgctactggaaggcttttaaccatctcacagagagaaataagaccacaaaatcagacaccatcctgctaccagcctaacacgtggcaaatcttgatacctgagctttggtcccagctctgtggctgcctggctatgtggcttcaggcaagtttcttcacctctctgagtctcatctgcaccatcagtgtcagtatgacactgcctcacagaggtcagggaccaaacgagagcctgcatgaaggctttgtgtatcctgtaagggactatcccactggaaattgttatacacctcagcacgagcactggcttagcctcatcttcctgagaagagagtactttctctttcagggtgtgtgtgtgtgtgtgtgtgtgttgttttgttttgtattttggtggtggggagaggagcaaggaagtgaagcatgggagactggggcatgcggaaatagaatggcgtttaagaaaaatggggacagcctctcagcttggcatttgcagctttgcatccgtgattgggcctgagcccaccagtacagccccatggcttgttacccatgattttagatcctgagcactgatgtcaaggagatctgtgtttgaatcccagttccatcatctgcccttagggaagtgacttcaccattccgagcctctgtttccccatctgtaagtgggtttaaccattgctgtgagctcatggggttactgtgaaggtttcataagctaatgtaaagcttcataccattcaaggcatgaaggaaactctccataagttataactacattgatgtcatcacagactcattataaatgcttattgaattgaactaggaaatgacactaggaggggtggctctcaggatcacccttcccttccccagttccagcccaaagacagtggcccttactctccactactcatgcttggcactgcccctaccaccaccgtgctcacctacctgccttgtaacccacagccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcaggtaagcaatatccagcctgtcctccatccaagcagctgccctccctcctctcgagaaggagtggcctgaactgggcagaggccagggctgtgcccccagactcacccatggaaccagtcccagcccctctccatactccccttccttgccactcccagccttcttcctgcagctcggggaccctctggtcatggtggcccagggtcttgcagaccacagacaagaattaagcctttaacttctctggatagttgaaggcaatttgactgtcacagtcagcttgatcagtggaagaccctgctcatctctaaaacttcttgaaaaacctgctgtagcgtctgaaagccccaacatttggcaatctttggtgaaagaccctgactccagaatgcctctgggaggtcacacatgatgggctggtttctcagcttagcaagctgtcagttgtcagagagctaggtaagggaaaagggagcaacactttgattggtgttggagaactctgttcctcagacggtttccccctaaaagttgagaattgtctttaatcctgaatcagtgctccagggaagtgaatcagagaagttccctgagtctctaggctatgggagatggcctgtcttccatcttggctgggtcaggcagggggcttctggcaccagagaagccgctagtccaaggcagcccaccacctctctgctgcctctcaaggagaagcaagggggaaaacccctgcctgccagctaaacaggcattctacctgatgtctgctctgttggctccggggacctagtggccttccctctctgactgaggagctcccaaaccttttctaccctccctcccagagtagcttacaaccactcctttcctggctgtcattttcctcctcaccgccccaccacacacacaaaatgcaaattaggatggttttagagcacaccagcctgcccacaacaaaaagtggtagaaggccagggctgggcaggctgcttgggtttgccatgtggggctggatgtccatgccctgcctctggccctcagactctggaacctgtaaaagaggttaaaggagtcaggggactgggagttacttccagttctctgattctccttccaagaatggggagcagaagtaaaactgatcactcaagaaaatgatcctggcagaaaacagaatgtaattaaggaagagtttggcttagatcaaaggtttgtggctgaaagaatgccgcttcctaaggaacttgccatggccagtggcgagtggggggttctatatgtcccttgtctacagcattggcaagaagctctggctgcccacccagcccaccttccgagaccaccccaccccttctcactgccctaccaaggctgcttccaagctggagagaatgggcaggcttcttggagctggggcagttgggtcccgtctccctcctatcctttctttctagaagatggtttctcccctacttcactgcagtgacgaaagtcaggagagcccccctttccctcctcatggctcccaaacatgtctacaacctgcctatcatcatcccaccctacctggtgccacacactcatactcaccctccctcccgcacattcccccccaccacacacacacacccacagagccctggtaccaccaactcactcctttctctggtaacttcagctttctctccctaccaacaaacccacgcccgtgactttttttctcaaatgctgtccctccacgctgctgctcccctggccctccagcggttgccccatctcacttccgccctccaccaccatatgaagtcactgagggagctagcctcatgcccactgactgcgcactctcgtcctccactcactctttgacctgctggaatctgcccttcagttacatcccaacctctcgatggctgtggtcctggagaaaccgcagttatctttgcacttcctggctcaggcctccaggcctctcagcggcctcggcctgggaatacctgctccccgggccctgtggtgctcctcctagtcttgctgtgagtctggacactgtctcttagttgccatcaatgctggaactttcctgagctttgggcctcactattttctttcctccctttccgcctgtgggtgatttcaccttctcctgttgctttaagaatctgagaccccaagtctccatatccagacacaatggcttttttacctgagctccagacccatgctgccagagagacactagataccacacctgagatgcctcacagacatttctgattctgaaggcccaatctggcctctcccctgcctgctgtagtcctttctctccctcatgtgttcccctctcaactgtggctcaaccagactctctgctgctcaacccctgaccctttgtcgtctgcccagggggtcgtgcctctttccctcctcctgcacatttcttatctggcctccctgcctcgagccttcctcctctgtcccactcttggccactccccaccttttctggaccacaggcccctctgagaattcatttctgaatctaaaatatctgtattgagtatcaactatgtgccaggcactctgctagaggctcaagatatgtcagtgaacaaaacaaaacttaccttcatgagtctctagtctagcttctactatagaatctggtagacaccttgtccttttcttcaggaaaaaaaaatgtggcttatgtacccagtttgtttgtaattctagaggtccacagagtcactgacccccatgagtgtctgacgggaaatgatctttctaacaggaacatgtattcaatcatccattcaagacagagcttgagagcctactgcatgccaggtacagccttggggctcttccgactcctcttcctggcctacaagtcactgccatgcagtttcctcacactgccacactctcggccgctggtctttcctttcatggctctggacttgggcccaggctgttccctatgctggcagccctcctcccctcacttgtccctggcaaggctctccaaggcccagcttaactgtcttctctctgggacaccttcctaagccctctaggcagctctcattgtctcctcccatggtgccttagacatggcttcattgctttgtagagggatctgtctctccttccagcatgagagagcctcaaagcctggatccctgtacccagatacccccttctccgctatagaacctgacagagagctctacactgagggctgaactgacgagaatcttgcaggactagccctcctctcctgggtgtagagtcccactgagactgggcatgagaccttttggatggttctagccttctgaaccagttactgtcctggttaagcctcagtttcatctaaagaatccagaaacagggactggtcttctcctcctgggtattatggacccctaagagtctaaagtgtgccccctgctccctacctttcagggccctgccccatttgctgcatctggaaacttccctgttctccctgttctgcccctgggctctcagcagtgagttgtcagtggtggaggagtgggccatcatagagaacttctgactccctgcgaccaaggcgccctcggagtgacttagagagaacggccacctgcacacctacccatcctacactacacatctcacctagtagaggggccaggggcagtggcaggagtctgctttctggcaaaatgttctctgtcttgtctgcccacacaacagctggctcccctacctcctagcactctccctgcccgggccgcactctgtctgggcatctctgttgacctgtagagacccctcctcagagggtgctgtctgtctttgtgcccactgcactgaaacatctcacccaagccttcctgtgccaggagcaaactgcccccccaaatcctgggcacggggccttccctgcagaatcgcatgttcccttgtttatgaggggcaggctggaacaggccccttgagcaggcagggggcggggggcgggggtaggcgctgaggaaaatgtggaggacacagctgcccagatcctgtccctgccagcagagaaccagctggggaggtaggggggaggggggagggcgtggtcaccatctcagggcaaacttgggtcagcatgtgatgggacaccaggagcagagcacagcacgcggcctgccagggagacaggagagtcctggatcctcaggcttccacctggagctgggagtgaggagggagaaggtggtgactccagttcctgcaggggctgagaaaccctcagagccctgccccttagccaggacccagagccccgtgtgcatctctggggccggcttctatgaaatcatcagacagctgctaacctaggacatctgcagcaagcctcagggtcattatctctgtcccctgcctctttcttgttcctcagaaggaaggggcactcctagagacctgtgcctgccttctccaggtctcacatgcctgcatgtggggaatccttccttaacattctgccacgtcctgctacatatgatgctgtataagggaagcgcctctgaattccaggggggtgacaaggagaatctggctctgagtcccctgtgcatcaacacccccacccccggaccctcaggcgatcccccttccctgctaatctggtgtgtgcacagggaagtgagagaagccataccctgggcaagctggagtttgtggcatctaatttggctggagcagggaaagagatgctgtcttagtcagaggggcctccagggctctctttaatgaagggaacaaattataattgacagaagagggttgtgggccggcaccaggccaaggagacagagaccagcttgagccaggaagaatatggtatagttaagcagctgtcaccacagcatcagcaaggacattaccatagcaatagggtctatagacaagaccatcttgtagcacccttgttgggaggaccttggggtaaggatgccaggatgcctgggaagaggctccccatcagaggtggagacagcccaggtagggattgtgggccagtttgcgtctccttgaccctggcccagcctatctgcttgcctctcctcagcctccttaccccatcagctccatagctcagttttacatcccctaggctcagggcaatgatggctctactgccctccctcgtattcccccatctctccagcccactacacataggctggaaatctggctttttaattcagcactaaaaagaggaggtgatcataccatgtgcagaaattaccgtgttacttcttgcttcctcctgggggccagcctgggatcccaggctttatccagagctcatgctggcccttggaggcagaggaaggggtgagggctgtgaacaggcccttgcagagcctaagcaccctggggtaggtgcagggaaactctgagaaggaaggagaggtttggctggggcttcagaaagaagagggggaccaaggccaggtgccctacacagttctcagcatgcagggactaggtgcaaagcttcagggctagccccagcttttctcagagatagcccacgtcctcatgaactgcagctcctggcatacctctgcctttgccttgccgagtgcccttgggcaagtcaggaagtccctctaggactcagttttcccttctgtaagcagagaacacccagtttggccctgaggatcaagtccaggatctttttgttccccaaggtgtacaagctcctggcacacaggaagtgctcagtaaacatttgttgaatgaatgaatgaaacaaaaaccccttggagaagccacagagtgccccttagtggcagcgctgattttgagaacaagggagagccccaggtttggactaggagtctgggcaccatcaccatgggaatccgtcaggacagctgccctcccgggtatctgggaacaggtcttgcatacccagaatgacaggttgccacttcccaggagaggcagaggcagctgggaatgagggaggtggccatgtgacttcctacagggcctggctttactcccccagaagaatgttacaatggtccagccctagaagagcggatgtgagggatcatagatttaggacatgtgagcagccactagtcctgccctgtgttgtcctaagggcccaaggctccctgcagctgcagggactccgtgccccacctggactccagaaattgctggggggagggaatctccttcccatctaagctgcagggccactgtggctctgtggagagaggcaaccgctgggtgactgctggggagccacagccggccctggctcacgcctctcccccttttatcccctccctaaccagaaagaactcacgactacagttcaacaaggtgaaggtggaggacgctggggagtatgtctgcgaggccgagaacatcctggggaaggacaccgtccggggccggctttacgtcaacagcggtaggtgggcccagacagagggaagggtcctagaggggtttggcagggcgggccagtggccccccagcccttggggcctgcatgtgatccatctcgcactcaactcccctccctcctgctgctgccatatcaagccctagatctcagccgattcagagaaatgcagtcgaagcataaatgtttagctttgttatctgggcctggaagagccgccagctctcattttaaataccctgaaaactaaatattttgaaatcaagaggtgggggtggggaaaggatatttttagaaggcaattataggaggctgggctgccaggagtggggctgcagggagaggcaggcctggggcatgtacaagctgactgcctattgcctgttgctttgctgggcacctgagcacaggcagccatctccactgggccatgggtgggcagcttggatgcctggggcccctggtggcagcctctgttcagggagggcaaactcctccccgacaggccatcctcactccttgaagtcttgcaaggtcaggacctcacggcacctcttaccttctcgtctctacagtggcagacccagcctcagggtagaggctgccttcctgctgcactgccctctcaggccctggttctttcccttgactgggagattgcctctccgccaaaactacctgtcctcaggcagtgccctctccactctagcttgagtaccttaaatcccacagatcactctcctccccccaacacacacagactgagtgtgcatgtggctacctatttattggggttcacttccagtcctgctcatcacagaatataatcctgtatctgtcattacctgcctctatttccaccagacagcctcccaatatgccctaaacctagcatggtctaaaagactacttggaacactctctgccctatgaccctcagacaaaaacctagttcagaccctgtcttcctgtcctggtgagggacaccccgtcctcccagccccttgtgctccttggtctcccttgccactgtgtctaataagtctgagtctccatgtccttgccagtcttctttctggatctttctcacacctgcctcttctgctctaactatacctcaagggtaaccctggcttgggtttcatccctagtcacctgaaccagagcagcagcctcctaaggtgcttttatcctgtcatgttccccaccccatagaactacagaacagggactttgttctcaacaccctggcctaaatgatctttccagcctaacttccatcagtcccttgtccattccattcttactcttgctcctgtgccatcctgactcataggatgggtcaagacagtttctctcactatgtgttggcctcattctttcctactgtaaaatgggcctctcccatgttcggagagtggggtgggaagaggaggccatggcttcatctcttcctccttgaccatcccaacccactgcagcgtctctcccagctagggctccactcctgggccactccttggccaaccatgctctgatggcatctcttgaattctagcctttgattagccttcaactctcatgctattgctgaactttctctgtgggcgtggccatcccagtgaatctgtgagcctcaggagaggggagaacagggaggatgctttctcctggaagttacaatcatagccagtatttattgagccaagctccacattatcccatgaacccatactcaaagccaggatatattttataaacaataagaagctcagggagattaaatatttcacctgaagtcaaacacctagttaatgatagagctgtacgatgtaaaagtagttggcaaacacttagtctttgagctctgtggggctatgtctagtctgtctaccaccctagcctcagggtctagcacagcacctggctcacagtgggtgcctggtaaatattatataagagaacttataacctgctccaaggtctttactgcctcctctatggcccagcctgggcatgacagcagggagggtgtctgagctcctacttctctcatcctatcccaagtttgggaaggtgggctgtgtctggggtctagcacctgccacctctgctgtagtggtcagacattctcagatccactttggatttggggccttcctattttattagtcaagactttcttgactagaattaacttaagcctatcttaagggatttatttattggcttataaaactggtaagttcagaggtggaactggccccaggcatgacagaatctaagaactcagaggaagagtccaagaactcataggatggctcaagacagtttctctcactatgtgttggcctcattctttcctactgtaaaatgggcctctctcatgtttggggagtggggtgggaagaggaggccatggtctcagacaggtccagatctaccccatcccagcccaccacccggagaaaagagatggctttgtctctgtgtccataagtacagtcacaaggatggattctgaatgaccctgccaggtcatgtgacccacttgaccagtcactgtgcttggagggtggggccatctttgcctggcctgtctgtgtgtgcacaggggctactgagaggcagggcactgtgagtgaaggcctggtcagaactccatggaaaagcacttccccgaaggggtgctgttagcagagaaagtgggagcggctgctgtgcagaaaaccacaggagtgccctctctcttgcacagggcttggggcctgtggccagaggtggtgagacccctcagataagctgcagtcccctcccacacacggattactgtcagccctccgtaggccatgctgtgatcagtttaggaaccagaccgtggcacctttgggcagggcactgagggcatatctggaatcccagcttcctgcagccttcttgcctcttgaccctccagggcagcggcagggcagagcaggggaaagagtttggagatttggtctcgtccaagctttacatcatgcaaccctgagtaagtcacttcaccccaccagtctttggttttcccgttgtggggctgaactagatgatctttaagcccccttccctctaaaattcggggattctgagtttgatgctgaggctgacatcctgtgcacctaaccagtacgcacacacacaaacacataccacaccacttctgctaccatgtgcagtccatggcaggcaagagcctacccttgaacaggtgaacagggccactgctggggaccaggaggcccctgctggggatgttttcccaggcagagatgcccaggctccttgtttatccacagaacccatgagacctgcagcaaccacaccctgtggtctgccccctctgactcatcccaaggtgggttggtttggcccgcccaggccgaagggaaaccagggctacagggatagggcagctagaagagggtacagggaggtcattggggagcagcaggctgctcgggtggcatcactttggctcttgagtggctactgctctgttcaggtggagcccagggctccttccacaaattagagtaggccttccttatagtcagagctctgccagctcacaagaggctcctgccttcctgaactggcgggcaggaggagtcggcaggaagtttgcggtgctaacacaatagcttggtccaacccacttctgagttagagaaacagatgtctcatcccaggtgaaagggagtttgggaatgtcctgaggtggctgtaccagcccctgatgtcaggctttgccccagaggacaggcaggtttgacctggggtgtcataggaccatggaagccctggagaggcctctgggccagtctcttacctggagtcttgcaaaagctggctgtttaaacacacacacacacacacacacacacacacacacacacagatgcacattcatgtcagtcacgcattcagaagcgcttattcaacaagatcttgctctgagctctgggaagtcgcagtcttggcccccaagaaagtccctcaaatggcaggaaactaaaacccgaactctaaaaggtctgccttttctaacaaactgagaggaaggtaggcaatttatcaaagggaaaggggcctcgatggataaaggagcactcgacctgagtcttgaaggacaagcagaagttttctccatgagcaaaggtgaaaagcagctgcacttgtgggcagtcggggacgcagctccacagcagcggctcccaccccgccactgtcactcttcaggggccctgataaactcacaccaagacactaacggttcatcaaaacttcctgggcttactcctcccgggtgcttttttaaattaatttttgagatataatttatataccataaaattcacccttttaaagtatacaattcagtggtttttagtatattcacaaggttatataactatcaccactaattttaggacatttttgtcaccccaaaaagaaaccccatgccctttagcagccactcccatttctccccctctccagccccggcaaccactaattctggacatttcatacaaatagaatcatacaatatgtggccttttgtgactgtcttcttatacttaacataatgttttcaaggttcatccgtgttgtagcatggatcagtactccattcctttttatggctaaatactatttcactgtatagacataccacattttatttatccactcataagtttggattcttgggtcatttggattcttgggtcatttggattgtttccacattttggctgttattaataatgctgctgtggacatctgggcacaagtttttgtgtgagcataggttttcaatctcttggggatacacctaggagtggaatttctggagcacatcatgaccatatttaatttttaaaggaactcccagactgctttccaaagcagctacactattttacattcccaccagcaatgcatacggcttccaatttctccacatcctcaccaccacatgttattatccttctttttgattctggccatcctagtgaaagtggtatctcagagtgtgtgcgtatgtgtatgttttatagagatggggtcttgctacattgcccaggctggtcttgaactcctggtctcaagtgatcttcctgccttggtctcccaaaagtgctaggattacgggggtgagccagccattggcttggtctcattgtggctttgattttcattcccctaatgacctttttggaatgtttgcatttaaaggagacagtcctttaatctaccaaaaagatgatattatcagccaaggataccagactagtccctgggatggtagcacagggcacttttttcccccaaagaataagatatttattttctcattcattcattcagtaaatatttgttaagcacctgttatgtgccaggcaccatgctggacattggggttcagggtaaacatgtcagacatggctcctgccctaatggagcttacattctagtgaagaaactaagcattaaacagcaaacagttggctgggcacggtggcacaagcctgtaatcctagcattttgtgaggctgaggcaggcagatcatgaggtcaggagatcgagaccatcctggccaacatggtgaaaccccatctctactaaaaaatacaaaaattagctgggcatggtggcacatgcctgtaatcccagctacttgggaggctgaggcaggagaattgcttgaacccgggaggcagaggttgcagtgagctgagatcttaccattgcactccagcctgggcaacagagcaagactctgtcttggggaaaaaagaaagcaaacagttgcacacttagtcatgtaattatgctagaatagctataagtagaagtatatgaagctaagcgagggaataagggaggagcctgaccagcttaagaagtcaggtgaggcctccctgagacacttgttgtattttgaacatcctgggcaggagactacttggcttattaaaggagcagaactatgaccagcatagtctgaaatatactgaaggagaaagatgggagatgaagtgggagaggtggtgaagcccagataagacctgggaagaagttgggggctttattctgagtgcaaatggaagccactggagagctttggtaatagaaaagattgatacaatttacatattttaaagaccactgtggctgctgcaaagtaaaggagatgaaggcaagagtgaaggcagaaagaccagagaggaagctattgtggccatcaaagaaagagacaatggtggcctggactaggggaggaggtagcaagacatggatggagtctcttgaggaagtggaaatggcaacccttggtgacagatggctataggggaataaaggaggatgaaatcaaagatgccctctaggactttggtttgtgccatttggtcacggagataggaaagactggggaagaaggtgggtagggcagatggtgcagagcacagttttggacttgttgagtttggggtgctgtgagccatcctcgtggaggtgtaaagggagagtccacgtcaccttcacttctccaaacacgggcaaccatagtgagagatatggatacgctgacaggggtgtatagacacgttgcctcaggagcccacgcgtgctagaacagtgtaactgcgctacagcgtgagcgcagctcttccgtgtggaaatctccctggagtatggctttgccactggcagagttgggctgcagtatcttgggaaggccctgccattacagaggagtggcctttctgagatggaaacacccgtggtcactctttccccacaccctctgtgactggctccccaaatgtcttccctttttaccttcccggggtcccagcctcgtccccatgacaacatgatactggcagcgcaggctcaatgcattcggctggggaggccccatctttcctcaggagttgtccttagcctcccaaagcctcgatgagcacagacatatatgtgagaagcccaagtgtgcaactgtggccccggccaacccagcatcctccctgctgtccactgctcactcgactggggtgaaacaatgggcacagcagtgggcagtctgtgccacccgcaactgcagaggacaccaggctgggcctggcagatccaggctgagatttctctggcttagccaacacccacaggagggcccaggcctgcagtcctcactgcgcttgcattcgtctgcttttgtcaagcctgggtgctgatggggaggatgtacagccaggggctaggagccctgaggctctgttgcaacacacactgcactctggccagacacttcgctgccttctctctctccactctcctgtgtgatgtaaatgaagggcaggacaacctcgagggttctcccagcaaggggattttacaagtggcaggcgtggtacctcagctgcttctcttctctgtccctttcttagttccctgggtctcactgacccagaagtggggcaaagatcagcaggaggtctctagttccagccagcacgtgggttccagctgggtctggggttgagccgaggagggagacctcagcaggggtggggctccgggatgccagctcagcagcaggcatgatgtggaggggatggtgaagccggccctgcccgctggattttatcagcatgctcctcagacatatacagaagcagagctgtgtatacactcccagccccctgtgctccatccgtctccccacatgtctaaacactgagggtgccgactgcctgccctcctcctcctcctctcacttccacccctattactgaggggagtggagagacccagtacccctgaggagacagggccagctggggtagcttgggccacctcattcaggaggccactgctgggctgggtgggaacgagaggccctcagaggccctgggagctgaggggagcaggacctgcttctggctgtccagtccggattggatggggcattatctaaaactgatgtttggggcgagaatgttcacttgaagctagctttctggatgccattccctgatgaggagcagagcttcagtgatgttcatttctcaaatgagtccagtcaatcggacgtgcagtctgtgctagaagccttaaggcccagccttgctctcccccagttttgcaccccagctgcccccttccctttccctggccctgtctcctccccaacaacttgaaacccgtgatttatggctggggctgtccgagacctggaggctccctctaggggcaacagctgataaggtcagggaggagggggctgtctggggtggggagatatggagaagaccccagatgcttatggagatggggcatagtagcctttgaagcattcctggagctagcccagaccttggagaatgggggaagagagcagaagctagggttcctcctacccccaacatctctccagatcttagaaaatgaccgtgtcctaaaggtgccatcccctgaaggcccagctcccttccagccactccctggtccaccatgagagcccaagccatgcaggcgggtgtaggtgtctctttcctgcaccgcctcctgcgtttgttccccacatgagacatcagcatttcaaccacttgcaggggagcccccggaaagccaggcagggaaggggagaggtgggcccttattcagcagaggaagcagttcctgctgtcttctcaccctgctccccccacaaaagaatgaaaatcttcctggcctttggaagtttgcctagagcttgggtgcaaggttgcactgggtaaacgggcagagctcatggtggcctctcctttgccttatttgtgactagaagggaccaccagacctcccctccccagtcattcctgcagcctctggtcatcttccagttttgacgtggggcatgaaggagatgattcctggggcctagggatagtctcagtgcgtcactggcacatgtctctcataccctcagtgagcaccaccctgtcatcctggtcggggcacgcccggaagtgcaacgagacagccaagtcctattgcgtcaatggaggcgtctgctactacatcgagggcatcaaccagctctcctgcaagtaagtgaccagtaggggtgggcatgggagcaagaacagggtaggagatgctgggtcagaagtggagggctctaggaaaagagggttccaagccactgacaagaggtccccaaggggtgtagacaggaagctttgccctacttcctagccctttcctggaatataaggagatataagctctaaggggcacaggggcttgtgcagtccccatttcccaggcccctacccaccccatctcctgatgtctaccctttcaccaacaccctttagggagatggggatgctagtctatgccctaggcactgggcactgggtttctctttctctctctctctgcctccctcagtctctctttccccccctcttttcctccccatctctcagcaactctccaaactttgttcttaatgaacatttcccaggctgcatcttccccaatagcgaggagcctggcagggccaggcagagcacaggttccagagccctttgctcctgtagtcttgaggggagaagaggggtctgcccagaacccagtactgacctcaggatctggctgcccttctgccctacaggaccccattgtacaaagatgccatccctgggtgctgcctgtgtcccttcagcccctagcccccactccatgggatgaggggataccagcaaggacactactctaggtatggcccaatgggggaggtcagggtggaggagaggctcaggctggggcctctcagcctccccaggggccagagcctgctcaccagccaggcagggtggccccagcaggaactccaaggagctcagaaccacccactccccatagcaaacaaggcaggtgggagagaggctgtcagggagggctcgttcaggcccagccagatcttctgggcagctgggcctacagtgccccctggacagattctctggtgagtgtgtgaggaggggaggggagcttggtgagggcagcataggctccagacagatctaggagaggagtgggaggggggcctagttaataacttcagtgtttcaaagcagcccaagcctagagccctggcaagttgctaaagctgccccattcccatggcatctgggcaaaggccaccaaaacattgatggggattcagagagagatgtttgaccttcccccaggcaaggtcagactcaacacttctcagctcccctgcctctgatctcccgctctagatccacagcccccttcctgggcacacccttgcccgggaatgtgagcctggtctgagaaggccaggacttttcaagacccctccacctaacaacatggtaacgaggggctcttgccccggctggcctcctcagctggcttcctccctggccccaccctgcccctgctgccacctccttctccccctccctgaaccttagaggagagtcccagtagcaacaacaggccctctagggaagttctcaacccaaactcagcccctcatccttccccgcctcctgcctctaggaggctgccatgttagtatgacagaccctagggaacattctagctgtgaaacttgctcagagttctttggaacagatctactagaaattcatcagggtcctggaatacctcacagggatgacccagccctgcatccccatttccttgtctcctgcaccctcctcctccctgtgacatacacactaggtaggtctctcctcttccctagccccttggaccccagactttgaagggatccagcactgtcactgaagtcagccctcgtccgggcagggaaggttctggcccctcaggacaggtgccagggctgaggagggccatgggggccagggctccagtgctagagttcggtgtgggcaagggagtggtgagatatgtgggctccaggagggccctgccagcaaggttgcacccctaggacctctgagtcctgcccagctaaatctgagaggagcagaggcaggagcctgagccattgtgaagatggtgccctgttccctttcccaccagggcacctgggctgcactgcttagaacttggtacccagagccaccacttccccatctcagcctcccctggttccagccaaggttcctggaaccaacttccccaacaccctttgtcagccctcgggggagagggcagccctggtggagatgcggtcagaacaccaggtcctcagagctgtgctggagaagggcaggggggtggggggcagggcagagcccagaggccattctgcgggtggacgagctgggagggaaggtgggcaggcctcttggggttcctgatgacacctgaatggaataaaaaggaaagaacttaggaaacggaactcacgtcttaccatttgtgctgtttgtttactttttattttgatttttttgcatttccgcttagcttggataatgaaactacactggtcagtttcattccagtttctataaaaatcagttttccttcctggttttcttacacttgttgttgtgtattggttcagagccctgcagggagtgttggaaagcaggcacactccgtccctcctgtttttctggaattcagtgccaaaagaaacagtgtcactgatactgaattttgttttaaaaaaagacaacgtagggggatttgaaaatgggagtccaaatcaaggtgactgtcccctgtctgggccagacaggggcctctgcactccctcttgctgctttctcctcttctctccgtgtgtttgtagagcacggttggtgcgtgactcttggggactggttcaggggatgatgacagaacaagactctttccagccctgtgcacataccagtggcatgcctccccttcccatcagctcatccccctcatccctctgcccctaccccacccatgtccaggtgattccccatcccacctccatctgcctgctcatcctcgccacatcttcacccctctcatgaactcagaggcccttcactccctccagtgcccggggcacaccgccatccttcatccaccccctcccccgggtgagggcagcacacatggcattatccccaggctaccaaaaggagaaactgaggcccgggaggtggggtgggaaaaggggaaggcagaggtcctgacctctctgtcaccccagatgcagcccgtgggctctcctctctgcccctctctcaccctgctcttctccagccctggggacagaccttccccagagtcataactgatgacctggtgggaaaggctgggaaggctgttacccgctgctccttctaatctgtcctctgtgccccctgaaaatcagagggtcaatcccagtttcagtggaaaccaccaaccaccacccagcccccaatgctgagttcagactcccaacctggttgataggctaatgtaccccatactctcttaccctggtattaggtgcaggttagagaggctataggcccagctcacccccaaagccttctctagggaagccccagtctcctgaatgtgactcatcctcagcaaacaggactaaggagagacataggagtgtccaggaggtccctgaaggagctagcaccccaaagaacagcagtagctgtcagccttccaccacccccactgtgcccctccccagtgccttttgttttgttcagccagcggggagcacattttctcaaggaaggaaggttaggaccataatgttgtgcaactcagcggccatgaaagatgtaagtctgtagtcaggatagtccaggctgggtgtgagataagggccacagggatgtatggagttatcattgttatcattgttctccaagggtcttgggacagcagccctgcttgtcagcaatggaaataaatttccccttgcccctcctgcccctgtactcccccattttctctctctctctgtcacacacacacacacacacacacacacacacacactcatacacacacacacacacacacacacacacacacacaggtttcccttcctccaagagctgggctgatctcagacattggacacagacacatctgtctctttcttgttcctttgtggaatccaagagtcatttggcaacttcctgggtcttcatcctccactcccaaaggcacttatgtttgaaaatcacttctccctctctagtccccatcacaagtggacatcagtttccaagagctaaggaagaagagcttgagctggttgggaagccttagccactacctccatttacctgagctgggatgaatagggacgagggccagggatcagagaaggatgtgttgacaagggggctgatggcagtctcctcctccaaaccaccctgttcagtaagacgaccatgtaccctcttcccacccatgccacttccctgatacacttcccagccctccaccaccccccaattagccaggcatacccacacacacactcctaccactacaggacaaacctcctgcctcccctgggggagatgccatcaaggcccagagaaactctagccctctgctcaactaccactcccattccccactcctccagatttgaggtcacagggtgttcatgagtatctgtcacaaccaatggctgccacttactgtaagcctaagtggcttcctgacagttgctatatactgcaatgctaagaaatagagtacacttgcctcttgaggaagtttacattgattaattttgaacagtagcctattattgagggggacactggtgatgaacttagctaatttcctaaggaagaagatgcagaggcaatatagacccatctctgagtagggagatgtggggaaggggtctagccctccctgtaagcttctccttaggtatccagccttgccggggttcagaagagagtacagggctgggcatgtcctccagaaatttgcaagacttctgcaagaaatctgagattcgcttgaggagagggctggcagccagagagcagaagaacgtgtaccctgtgggtagagacaaggtcagggagattgagtggggggtgctttagagctgtaagcaaggcaagatcagagaatgagatccagggcaggtccaggcagtgatggagaaacaggtcatggggaaatggaagagtttcgcaggctggctgccactaggaccttgatgtggaccaggcttccagggtcccccagcgagcctgctccaatcccttttgtggtccttgctacctgaggccagattccctgcacctggtatcaggaaggcccactttgggatgctgataattccagctcctctccaacttcccatttccctactaagcttttcccatgtacatcacactggggcagcctattccaaaccatgttctaccacaagggttcctcaaaaaacaacatccatggtgaagtaaatttgaaacacaaataaatttgagaacttacatggaaagttcagctatttcctcctatgaaactttcatagtctttcataggtgaaggtacactgcaactctacaaggcaccctgagaatgtatttcctacattgatttggccacagaaccctctttgaaagaacagataaaacatctcttaggtcacttttgtcaaagacatacacagtctgggaacagcattcccgagttatctgagtttcctgggggctgtttcttggatgagaaaacctgcccagggcccaggagagaatccttcagtcggtcctgggaggagtagctcccaagaacttggtattccttaaggctcccagatccctgccagctgactgactgcctggcaccaagaggccacagtgcttgcttcatggggcaccaggcaggtaagaaggaaagtctcaatgaccagtaggacaatttcccatcttccctcaccccacttacctaaatcatcctccccctgacccaccccaccttccccaccacccatggagccacatctatgagacagatttttaaggagatttcagagccctccacccagccctgactccagtcccttcagctacaagtatgaccccaagtgcctgacttggtttttctcattcatcactgtgcactttgatttctaaccttagcctcgcggatgatgccagtttgttctgtgatttttccccttttccttctccagatgtccaaatggattcttcggacagagatgtttggagaaactgcctttgcgattgtacatgccagatcctaagcaaagtatgtttgaagatacaaacacaagtccctgctccttagaaagcttctgggtgcagtccccccaatgtagggcatagggccaggggtgttggttgttttgatctttggctgttttgttttgtttctcttttcttttttgtattttggtttgttagttctttttgttttgttttgttttgctttgttttcatttttggcctaatccttgggtttaaagttcagggctgcaggtaaggggcagagtggcaaggccaatacaaatggtaacggtggcaaggaacccagctggcattggcaggagcccgtgccggggtgttgcaatgcctgtgtcttgctatcctggctctctctttctggttttctttcttttggtaggtgtcctgtgggatacaccggggacaggtgtcagcagttcgcaatggtcaacttctccagtatgtctctttcttctatttcttctcttccctggtgactgacagtctccccctggggagggatggggccttgcttagcaagactagggggagatgtagagggtgtcctgcgctccttagaggagacggaaacacccccggcacccccacctccacatgtgggctgtacctcctgggcacagtaatgccaagttctctctgcagcagccagggccacacccaggcctcctcccaacttctggggtcgggcagcctggccagaatgggaggaagcatttgcagagccctcccctgctccgaaggctgcctgagggtaccaaagggtctggcagtgagtgtgtgtgtgtgtgtgtgtgtgccgacgtgtttgagagagaaaaaaagttctcagaaagcccattttccagtctggccagagtttgtttgttttgagggtttggaaatggggtagagggaaggaaggggaattaagggagagcaggacccagggcaatgatttccatgaataccagagatatttatgtggctacaggatggtgggagagggggcgggggttggtgctggagatgctaaaaagttgaggaaatgaggaattgaggggtaactggtgactctctcagcacctctgtggtctgaatcctcccatctaggattttattcccttcctttcttcaacttatgaggttggagctttcccttttgcacagtttgcaaaaaaaaaaaaaaaagaagaagaagaaggagaagaaagaaagaaaagtgagccccgaggcccaaggacccagccataattatggagtgcttttatttggggcctgagagcagttccttccagcaccaccaggtggaggtggagcagaacaaaaagcctctggccggccattgattctgcttgaggaccaggggtccgctggcttgcaaggcctgtccccagttacccatcccatcctgcagagcaggctaggcccctgcgtgccccccgacctcctcttctccagggaggacagctgggccccatgaggagtgtggaaccaagtgtccacatggcactggatactgggaggtagaactctgggaggtgctaaaggtgggatccaggggaccatgtaggtagccttggagaaaaggggtttggggatttaggtctcagggtggagaaatgatccttcccagtactcctcagaccacagcacaaaagtccagcaagttactccccaccccaaccccacaggggcatagagacccctgggggatgggagctgcttggcccagatggtcaactatcttaatagagtgtgggaggccaaggaggaagggcagagcctgtgggcaggacatgtggcccaacagaattctctagaacgcaggctctgcaatcatttcagagtcatatccagccctgagtgcaggactgtagagcaggagggacctcaagagaaggcagagcctaggcagagctgggggccaggggcaagagacagtggggcaatattcctctcggcagagagcctcccgggcttgtgagactgtcctggatggcgagtcccagcctgtcctgaatcagagcagcagagcctccggaaccgggccgctatccaaggcctctctgccagctgggctgcttcagctttcagcctagatctgctaggaaggtcagcagggccccgggagcccagaaaagagcctgcaaaggcagtccaggcccttctgcctagtgtcttcagtagcttgactgttaccttttcgtaaaggatttatgctcttcaagcactttcccagagagcacttcatgtactgctctagcagataattactgaaaaggtagtgtaaagtgctggcttaagtgttcaggcttcggattcaaagagacctcagtaaaaatgccagctgctgagcttactagctctggggcctctttaacttctcaatttgttttctcatctgtaaaatggggatgatgacatttatgcctgtggggttactgtgaggatgaaatgaagtgctgcataagaagggcttagcagagagcctgccattgtgattggagcacaatttagtacctctcccagctacaactggtatgcgggggcagggcagcatcagccccctagaggctgactcccagcacatcctgagcaaagtgtccaacctgcccagatagcatctagaccaggttatcttttgcagagatcaaagaaagagcctgtgactgcaatagcacattgaagcttttctttcttccacaaacagcccctccattccccacgggtcaaagcttgtccatctttatgtccccatgtaaaagagcacacatacttgtacacacaagcacaaacgcatgagcatgggctcatacatgcacaaacacacaatcatgttcttacatacctgcacacatgagcaaacccatgagcatgtgctcacacctgcacacacaagtgcaaacacaggagctcatgctcacatctgtacacatcactgcctccttgtccaggcagcctatgactgtatggcatgggacatgtccaggatgaagaatttgcatattgtctggtaagcacagccctgttgggagtccagcatcaggttgccatggttactggtcaacatgcaaatttctggttaataggaccttccggtgactcagtggtgccactccaccctggctgagtggcagccaatgaacataatgagtgggaaggtcttgtctttgctggggcggacacagccataggcccctcatgttccaacccatgcttcccagtgagaaagctgcctacccagtgactggccaggccctcagtgaccccaccaatcatgccagccaccactctaaacagtactggcctttgactcaaagaggaggccagttaggagccctagaagctgcagctgctactattcggttcccagaggagtgatgcagaagaaaacgcttaaagggctttgggagccctgctcacttctccagctggtcattgtcctcaggaatacccagccaggcctgcccagaaactcagtgggcaggaaagccatggcttagcaccaagggaccaaagggtctggcctccagtctcccttctgcctcctaatttgctgtgtgaccttgggaaagtgtcctagcatcactgggccccagctgcctcatctaatacaaccacctcgtcggaaagtggggcccagaccagctctatgaacccaatcctctttgcgtcccaggtgttgtggtcaagctgggctgttctctcagggcagcatggctggatagccaaacaatgtgagctctccagctgcctgaagggtccctgggccacagcattaactactcagtgagaggtgcgccagggttctttgagaattgtcaagtttgtactgtctactcagcacgcctgaccagccctgggacaccctggagaggagtggacaaactgtacttacggcaactttttcctgcctccaagcagtcagagtgggaatgcaaagaaaccaaaacgtcaaggtcactccccaacctgggatttaatagcagtacaagaatggcttgtgtctggaaaagctgggagtaatgaatgcttcattggtgtggtctctgcatggaactggggggttgaagccccaggatcttcctcaagcctctttagtcagagccatcacagtccctggctcggagccatgctgctctcccgcccttttccaaatgcagaaccttctggaatccctatcaggaagtagatgagaggtccagggatggataatgcgcaggacttcctgcggattgccacgtgctcgccttcctccaaggcagatgagaatatcagacacagtgtcacaccttccctggatctagtggtgctgactatacacctggggaagccagagagtgagccaatccaggctaggaggagcggggccctgcacgcatgctgagctcatgccgtccaggcttgttcacatcttcctgtagctgtgtgcaagcactttggacagacaaggaaacagggattatggcttacccacatccacatagtgaattagggatgaaacggagactctaggcttgtagaccgatgctggctgctacattagaatggtaggtgagctttttaaaaacactgttgagatttctgggctcccacctcagagccagatttcctcagtctggacaattcagaagctcagccaggtttgcaaacctcctaggatcctatgccccaggctgatccccacgtaacagagaagagcctgagacttaactagattggaatcactcagggtggcacagcagcaggtcagtgcagaactgactcttgagtcagggtccttttatctaacccttcaatgatgtgggggtctccgtcacagggtcctgaaatcacacattcaaaacaggatcccacttccaagactgtaatttgtccaccagttgaggagctcagacattctacaagtgaacccacttgtctcttcctgtgagttgcagtttgctcttctgggtagtgaaatcaggctcaggcaccatggcccagccctgtaggcttctagggtgttgcggtgtcaagtagagaagtgacctgctatctggagcctcatcctcttcctcttcccactccctcccacagactctgaggctccccacccgggctcccagtacgtggacaggccagctaggcctgtggggcacagcagggacatggggccagtctggggacctcatgcctgcactctgaacaaaaaaaaaaaaattgggcccccaatgagggagctgggcaagctgtctgcaggaaggcttgagagttgagagtgctgaaggcctggcactgatgctgggaggagcaggggggctcctgagacccccacccccacttacctttcctcccagggacatttgccaactgactcttgcgcctctgcctcgccaccaggtactaaccccacagctcatctctaaagagcctgccctgcctgctgtttctaacatctctctctaccctccttggggctcttggggactgggtgtcagggaaggagctcaggaggctgggaggggacactactaacctgctttcacctcgcaggatggctgcccggtgtctgaggagtcctgaccaacgtttctgtctctctctctccccctgtccccacccacctgtctctctccctccacccctccctttgtgaccctcgctcttctgcactgccagagcaccttggatttgaattaaagggtatgaaacctctgtgtgtcactcagcaccatctgcgtggcccctctccacagcctccgatgccatgtgtgctgaatgtttggtttcctttccaaaaaatggaaaagggatgattccaaaaatctctcctggccccatcgagatgtcctatcataaactacgttgatttagcaggagacgaaagaagctcatgaacagaagggcactcaggggttcggaccgttgccctcagtgtaccgtagcatccctcacataggggagatttattgctaggagagctcagaggggagggccccctcctgagctgagtgcagacccgcaggctggctggacaagagataggccccatgtgtgaacatggccccttgaagggctggtgtccaggaaccacagaagcctggtttggagagttgtgcagagaggcatccctttccatttgactttagtcttctttccattccccatttccatgttcattgcttttcatcctgcaccaggccagcagctgataactctctatttatctctgtccctgccctgtgtctgtctgcctggctttgccatctgcttgaggctgtcactccctccatgatctgaccccacattggcaagaccagccagggtctgggtggggctggcctctagtacctgccccttgtctcccagctcagaatcttacatatgtcctcctgccacctgctactaccaccctctggcccccggaagactccttgggctagaagggactttatggggttagtgtttctggctctctggctttgcaccgggaggctcctccatagctcaagtgtccaggcatatgacatgaggagagaggcaggggctcagagggtgggggctccagtggggtgggatctcagacatggtgcagagcctacagttacagaaaggctgctctcgtggctgatttggggaggcctcctagccccaccacctatcctctatcagctgttctcagtagaagatagattgcaaagtttgtgtgtaagagtgcatctgtctatagctactggctgtgatggggttgtgggagaggcattgagtccgtgtggggtctgtgatggtggcagggtgcacaggcgtgaatctgcaggtacgtgtgtgttgttgagagtatacaccttgtgaggtctgtcagggcaagatgtcagcaggtggaggggctgtgaatgcctttgtgttaaggtttgagcactgtgcaggtggaactgtgagggcgtggagatgagtgtgagtgtgcagatatgtcaatgtctataaggctggtctgtatattcactcactcaccaatgcaacaaacatctatggaacagaatttaccagacacacagtccctgccctcctgggctcacattcacaggtgacaacaagcaaacaggaaagacatcaggtggtgttcagtgctgcacagaaaataaaatgaggtaatgggatagtgcctggctggagtggggtgctagtgtagcgaagtggtcagggaagatttatctgaggaggtgacatctgttttaagacctgatgaaaagtggccaaccctgcaaacaaccaggggggagtcctgcagagggcggcacagcaggtatagagatcatgtggttggagtgggcttgccttattcagtggatggagagacttccagcatctctgaagcacagtgaacgcagggagaggaccacagatgagatccaaaaggaaggctgggaccaagcagccgggggcctcagaggccatggtaaggctttgggttgcatttgagtcacagtgtgaagccattttgagtttctaaacaggggagtaaaatgatctgctttatggttgtaaataaatgtagctttggatggacaacagcctgggctgggggcagggtggggaggagtggaagcagaaagacccgtcagaaggtgaccatctccagatgagaggtgacaccatcctggactaagttggaagcaatggaaatggtaaggctagatcagacccaggatctacttgggaagcagagctgcgaggacttgcggctggatccggcattagggtaggtgggaagaaagggagtaatcaagaatgagcccaaggtatggggcctgagcaacaggaaaagtggtgctgcatccatgagctgggaagagtcgagtaggagtttgaaaagagggtaaggaagcagggattctctttggtcgtggcccttggatgcatgagtctggtgcccaacacagcccaagtaggatgcaactgattaaatgcctgcagagaaaaggacatgaatagcaagcagaaagggatcacagatgactgcaataggaaaaatgctcaacctcactcatgagtaaaatggaaataaaaacgacactgagacaagcacagttcaccccctggactggtaaactcaacaagtctgataacaccatggagtgaggggaaccagtcctctcatccatgtctgatgggacagaggctgccaataggtgcagactcgatggagggccatctggcacgatcatacttcagggagcagtcagggcaggacataaaaatttgagagtctgcaaatagacggtatacaaagtctgagtctgagttaaatcactaagggagagagggcaggtgcaggaaagaaagaaacctgagcccaggcccgtctatcttcccagtcggtagaaaagaagaaagcatggctaagacagagacaggtcagccaatgaagtaggacagagagaagaaccattccaaagcccagggggagtgggccccagaaggaggagagcagctgggaaggaagcaagtgacctcaggacttggcggcctggaggttgttggtgcctgtaaccagggtagtctcagaggagtgatggagacacatgcctggctgaactggatgaggcatgtgaagggggcgtgagagctggagccagggctgtgggcacagagccaagagatggggacctagggtggaggtctggttgtttacaactccatccaactgtgtgtcagtgggcatgggcgtgtgtgtgcacctgttgctggagtgtgtggttaactctgtgtgtgtgcatatgttgtgtgtgcaggtgtgtgtgcgtgaatgaaggggtctgcctgtgaatcagataggcatagttagaaatctctgtgtgtctggagggtttgtagccctgggtgtttcctggtgtgtacacctttgccacaggatatgctgcaagcccaagaggttagggacatttcccagggctctgccaaggcattgaggtccagcctccactttaccctgagctgggaggaggggccagccagcaggtgtggtgggcacgggtggggtctccgggctgtagccttgactacagctagcgctgtcaccttttactttttcttcctcctggctttctctgttttagaaggatgggggttgccccagcagcagcagcagagggtaaagaggacagtcggcctttgggagggctttgaggcccagcctagctcagctcctcagcaacggtgggggctgttccttgcacaccagcactttcctagatgccaggggtccatggtgccactggcgggcttctcacaagcagagatagcaggcctggagggggccagggccactccctgaccaggctgcaggggtaaacaaaggcattcccatgatcactgccaggaagaacaactcctcttggcccaccaaggttctttgcagctaccaggccactgtggagcagggcagggtcaccggccagactgagctgtcctcccctgctctacagcctcgggagctttgcctccactccatcccttcccattcccctgcattttccactcatgtgctctgggcaggcatggggcttggggaggggaactcaggaggagttgtgtgtgaccagatccatgggtgggtgggagctgcagggaagtggaaggcaaaacagagcatgtaggagggaaggaactggctggagaaaagggatggaaaggagctgggcaggacctgagctggggagagcctatggctttgggggcaaaggggtctctgcaccactatccctatggggtttgcctcctgccccacccctcacatctaccctacctctgcagaagccgaggagctgtaccagaagagggtcctgaccatcacgggcatctgcgtggctctgctggtcgtgggcatcgtctgtgtggtggcctactgcaagaccaagtgagtgtcagtcactcaagctggggacaggccaagccaagggatgggcctccaagaatgtgtgtgaagaagactttcctcccccaccccactggagccctctataccctcctaggccccaactacccctcgggggcctctgtagctgggtgggtgtcgagccaaagatctggaccaagaagtagaggcagagggtcagggagacaggccccagggcactgacgaagaatggttgtgagcacaggctttggaagaagacgaatctgggttcaaatccagctctgctatttcccatgtaaccttgagcaaattgatggttcctcatgggaatgatcctggtatgtacctcaaaggacactgtgaggacctgagcagtagcgtgcagctgaccccacaggctcctggagcaggtgccccgtcaagtgggcaggtactaggtagtgttggggaggaacacagagaggacagcttcattcccaaagaaagacagatgcctcaaagcactgcctgaccccgccttgggagcaattgagacaaaaggacagagaaggcagggctggtccccctctggacagagaagaggtaggggcagaaccttggggcaaggagaataagtgaacagagagggagccgggcagtctaagctaaaagacagcacagatgagggtcaactgtactcccggagcatgggcagcccagactagctggagcaaagggccagggacaggaaaaaagcgggcatgagtctaaaagaatagctgggacccagatggtaccataggccttggatgccgagctagcaagtttgggtttatccagtgaaggctatagatgtgcctttgttggataaacccaggcatcgcatagctcggcatccaagggcccatatgaccttctgagtgtgctgaacagatgacgggtgtgtacacgactgtactttatctggcaaagcgaaggtctggcactggacagagcagcaatctagaggaatgagccctggtctgaactacttcacgccccatctgtgcnnnnnnnnnnnnnnnnnnnngcctcttttgtgtgtctttttgttttttctgttcctttcttttttgttctttgttttctcttgtgtttgctttgttggtttcgctggttctttttttgttcgttctttgtttcttcttcttattgtgtttgtgtttcttgttgctgctcttgtgtgttgttcttcttcttatttctcttgttcttggcttctttctgtcttctttctgtcctttctcgtttctttttgttttctgctgttctcctctttttttctcttttgtgtcctttttattttctctgttttcttttttccttgtgtcttcgtgtttatctcctttttttgtctatctttttttcctctttctccttcttcccattcttccttatctctccatccaaggccctatgaccttctgatgtgctgaaagatgacgggtttgtaacaactgttcttatctggaaagcaagggtctggactggacagagccaccattctggggactgagcccctggtctggactcatgctgccccatctgtggcatctgaagtcctgctggccttgtcttgaatgaatccaggaccagaaagtctggaggagagtcaggagggagttggggcccagtgagcccagaggagactgggcccaagagggaaaactaagtccaagaattggagaaaaagcaagccgcctgtcctgcccccactgcatttactcatttcttcaacaaacattcagtgcctgctggacaccaggtcctgcctcaggcatacggccggtgctctgaacaagtggtccagtgtcacgggacaccttttagagtcacctaaccttggctgaggagcaggaagggtttccctgaggaagcagcatttaggccagggcctgagaggtgaacaagagttagcaggtgaagaggagagaaagtattccaggtgaatggcctggcatgcgcaaaggccgggaggccagagagggctgggcatagtgggggatcagaaacaagctcaccatggaggcagctagctggggtgctgggtgggcagagagagacagggctgggagagaaacaggacactaaggcccaataaaggggttttattttcatttttgcgggtacttagtaggtgtatatatttatggggtacatgagatattttgatacagacatgcaatgcataataatcatatcatgtattctattcatccccccaggcatttatcctttgtgaccttgagcaaactgatgggtcctcgtggacctttgtgttacaagcaatccagttatactcttttaaatgtataattaaattattattgactatagtcaccccatatgctattgaatactaggtctttttccttctaactagtttttgtacccatgaaccatccccacctccctcccaaccccccacttcctttcccagcctctggtaaccatccttctactctctatctccgtgagttcacaatgaagggtcttaaacaggggagggacatgattagatttaatatcaaataaatcgagcatttaatatgtgccaatctgaagtagtcccacaggccctgactccctagccacagcacctgttttattttcttcatggaactttattgaaagtatctagttcattgctttgtttatgtgtttaccatctgcttcctctactggcctgcaggcttcaggagggtggattccctatctacctatctattgtctctgctccaaaacagtgtctggcacatagtgataactcaatacataccaaattaatgaatgagggagagagagagggagtcagcactgtgcttgaatgtttcatatacttttaatcctcaatagtctttggaatggataaatgatcaccctgtcttatagatgaggaaagtgaaacgtgaagagcttaagtaacttgcccggggttgcatagctagaaagcagtgaagttctactctctgggcagagccagagctcactgccacgacgctcaggtcctattggattcaggtggtagtgatgctgtagggcagcttgagtacagggacgagcagtagccatggccaccctgggcaggaggaaaagctgtttccctagagagatagctagggaagttcatcgttggcgagtggggggaatgccagcctcaccttcccttcccttgtgcagaaaacagcggaagcagatgcacaaccacctccggcagaacatgtgcccggcccatcagaaccggagcttggccaatgggcccagccacccccggctggacccagaggagatccagatggcagatgtgagtggctttcctggggcccccttctgagccctcagtggacagccagccttctcatgccccctgcaaggatgggccagggcagcagccagcctatcccatggccagccttgcctgctaggcactgcctcaccaggatggctggccttggtttgctcacttccatgaggaaggggtgggggttgatttgctggagccatcgctgccccaacatcaagtcactctcacacagtgggtctccccaaccaggagctcagtcagtgctcatcacttccctgtccccaacaagaaagagttcatttgggccccagtcactaactctcgcccaactctgtctgttccagtatatttccaagaacgtgccagccacagaccatgtcatcaggagagaaactgagaccaccttctctgggagccactcctgttctccttctcaccactgctccacagccacacccacctccagccacaggtaggcaccaccaaggcccatggaaacttgtagactcacatacttcatctggcgcaaagtgcccacttactccgacatccagagctattcaataccctcccctgagcttgccacaggaatcacagcacaccttagcctcctctccagaactgcagaggccagtccacacagcacaaaggctcagacaactcaaaaataacatggctggctcccttcttccctcgggagcaccaggaaatagtcagggccctcacatactggcccctggggctgggcttctgagataggtagctaaggaccacggtggtggaaaggtcccagacagggggtctaaggtaaggctggggggaggctggttgcaggaaggaaagaaatgggtctctgcacattacagctcacccatctatgggaccccagccctccttcttccaatattggggttgggcatttgcaacaatacacatcaccccagagtggagaagggcattgagctaagggagctcgaggtggaagaagagccagggaggtccatgggaccacacctgctgggccgccctgccccttcctgacccctcgtctcaccccatctggccttcccagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtcagttcctaccccctgacctattccccgcttagccagagggctggcaccactggcccaaggctgacccttagggcccctcagaaacactccaaagagcctcatctccatttttcatatgggaaaacaaggtcctagaaaaggtgaaatggcctgctcagagccatcggcatgttaatgacagactgggactagagttgggccagtggaccctggtggacagtgaccatctaatttaattgtcctcccaggacacttttcacactagaaaaaggacattattaatagttacactggaacatcaagaacaaacaggcagccgggcgcggtggctcacacctgtaatcccagcacttgggaggccaaggcggatggatcacctgaggtcaggagtttgagactagtctggccaacatggtgaaacccccatctttactaaaaatacaaaaattagccaggcatggtggcacatgcctgtaatcacagctacttgggaggctgaggcaagagcatcccttcacctgggaggcggaggttgcagtgagctgagatggcgccactgcactccaacctcagcaacagagcaagactccctttacaaaaagaaaaaaaaaaaaagaacaaacaggggctgttctggacaaaccaggatacatgctagaagttccatgtcccagcaggaacagaaggagacacgaagaaggagtaaactgcagagtgggaggggaggttgcctttgaggacactgaccagcacaagatggacgtgagccaagaatgatggcaggccttggcagtagcagcaacaagaccccagggttcaaggccttgttggcttcctaagcagtggatgtagtaagaaccaggaaacgccctttcttccctgactccaagccagaagtcaagggccagcacccctgccaccttgctcagccctgagtggccctcagcaagtggggtctgtaggaggtgagcagggaaagatgagtggtactaaaaactccacaccagggagcagggagaggagcagatattcccttgctctcaactcagcctactccatgccaggccctgtgctgggcaggcctggctgggaatccagaagtggcctgccaggttcctgctcctgaggagctcctagccacagaaacaaaccaaggaagcttacagcagcctatggaaggtgctaaacatgacaccacaccagggcagagagacccagtctgactgtaggctctgggaagtagccagattttctaagcccagctccaccacctgtgtgatttggggcagactgatcacctctgtaccttgttccctcagctgtagaacagggagaacaaaagctactatgcatggttcaagtgaaggccacctgagatcatgtgcacagagctctttgtctcatccctggcatggagctgatgctcactaggtgtagctatttatgaatcgtaaccacagcaatgagactccttaatgggtggtaggaaggggagaggcaggagagcaggaagaaaagcattctaggcacggggaacaacttgagctgttccaacagaggcacttaagaacagggctgatgagtgaggtgcctggaacagagtgggctgtagggagcagaggagctgggcctgaacaggcaagctgaggccagacagactgaccctgggtgggtaaacaggaagaccggcttcagcagagctgtgactttacaagattgctctgggaactgcatagagtgaaggaggagagaccctggggtggacccagatgaccacatgtgaacagtcgggcccaggatggggtggagagtgtgcttccggagaagggaatgggtaggacttggtggttaatcagatgtgccggtgggaaagggaagagggaggagtcaggcgattcagaaaaaatgataatggggactccaggctggttccagagagcagtgagatgcccagctgtgcagtttggaagggaagcgtggaggtgggtggcccctgtcctgaggtgacaacggtggggcagaagactgatgggcttacaagggggatgtggagcacaaaaggggacaggtacccgggatccagcctgggagatattagcaaggccagacttctgaaggagctggtggtgtggggatgggtctgtagccacaagcagagacacctcatgggatcttggtactcccctgaagcaggttttgacttcactgtaaggaggaatatttccctcactgaagccatcagggcatgggaggaattgtccctgtggggcagtgaggccaggtcacaggggtatctgaatggagactaatggcttctggaattgggcagtatgagtcctggttcctgactagcctcaagtcacatcccagctctgccacttcttggctgtgtaaatcctgaataagtcacttaaacgttctgagtgttactttcctgcgtgtagaattaaacgttctgagtgttactttcctgcgtgtagaatgggactggcggaagggtcttacagagctgcggtattaaaccagatggaacatgtaccccagcgtgagcctgaccccctgacggtgagcattcccacagcaagtgaccattcatgaaagcttaccagggtcaggcacagggctaacacatcccactgatacaatctggaatcatcccaacagagctatggaatcaacaccatggttatgcccgcgtaacagataaggaaaccgaggctcggagaggtttaggaaattgcataaggccactgagggttgctgccgtcattcttgcaggcggggtctcgggcaaggttaaggcaagtctgggtccgcccctcccaccctaccccacccccaaccccccctcccccgcgccggaccgggctggccctggcccatgcctctgcctctccccgcaagtacgtgttggacctgaccacagcccgcgcgcctctcgcccgtggacttccactactcgctggccacgcaggtgccaaactttgagatcacgtaccccaactcggcgcacaccgtgtctatttctccggcggcacccatcagttaccgactggccgaacatctatccgttctagtacaccctgcaccccccggtcctggaccctgtcccgggcccgggcccgggcccggcgcagacatgcagcgcagctatgacagctactattaccccgcgccggggcccggaccgcggcgcgggacctgcgcgctcggcggcagcctggacagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggaaaaaaaaaagaaacaacaaaaaaaaaagagagatgggccaattttttgactctttaatagaaacctattttgtggtgccttttgctgtatgctcatctggggctccgggggacaggtctgggttgtggggtgctgagagtgacagctgggcagagaagaggtgcgggttctgttgggggcgagggtggggggcggtggggggttggccctaaggaagaactgaggacggaagtagctttgctcccaggcaagagctgaagttcccggcccctgggaggagagggccaggaccctaggcttggagctggagctggggtaacttccagggggagataaagacacagctacccgaatggggaagccctggctactcacagctgttaaaggagggggggcagagaaacgtttccccaagagcctgagcccagggaggtggcagctctgccaggggcccaatgttggcggctcctgtcccccacagcctccaggacgcccctccgtcctctgcagcaccttcgtttacaggtcgtcttttctattttacacctgcatgtcctttgcatttcagattctttagattggatgcatggtcacgctgggaccgagaagagccactcgacagtgtattccccttttagcaataaagtaacaccatttccttctcacaggctgcctcctagcccccaacccacctatgacatccactcgtctccagtcctgccctcccacccccaaaaactgggtccactgctaatttgtcaaaaaggtaattgtttaaaaaaaaaaaaaatcccaaacagaaacagatgggaatcctgtcctgaaatgtctgaacacctgactgttgacacttgaacatttttatattataaataaaatcagaaataactcctgtttgactgtgtgtgcctagcctcagatgaggagggaactcagagcacgaagtcccatggtggatgtggatgatgctggcctggaggttggagggggccagggcagtccctggaaggaagtgaccctgtctccggtctctccggccccagctcacaggacagactccagccctcctcccgcttccaagaatatttacaaggtgtccccactggctgctggggaacctggccaagggactgacacaaattgctctgcttcaaactcagcgttggaactctggcccagttcctgccctggatctatgggccggactgaggcaacagttgccggcctaggtgggtgaggagggatgggttgtggggttggtaatagcacagccaaggcaggatgacccttggaccctgaggcacgtcacaggcaaagtctgaacatgcaaagtggcataacagtggtaccctcagctgccaggaccacagctgctgcagttcataagcccacagggtgttgctctttccccaactttataccccctcagagccaggacctgtctaaacccgcagacctgagagagagtacatgatttcagtatggagaaggcagatggaggcccaggttcaaaagcctttcccctcatcaactaatttagtaaaccagtgcccagcacccggaactattcggttccagccagacacacggacgtcttccacccaaacagctgaggtggttggcatgcacactcggctacacgtgtgtgtgtgtgtgtgtgtgtgtgtgtgaatcccactaggatgtgtgtagtcagagacctataggtgggagggacagagaggctgcgggttgagagggctttggcatcaacagggcgtaagttcaaattccagctctgtgccgcctagctgtgtgacgtctctaggccacagtttccttgctgggaaatgggtgatgtaaatacctattccaaaaggttgctgtggagattataaagtacccagtgctgatgctggcacgtgatagatgcctattacatggctgatttgatggtggtgatgacaatatcctgtgccttgcatccttgtatcacacagccagagtgacaaaaactagat

SEQ ID NO: 14945 - DNA, 44393 bp, Human; identical to SEQ ID NO: 14944
  misc_feature (1)...(44393): n = A,T,C or G

SEQ ID NO: 14946 - DNA, 44393 bp, Human; identical to SEQ ID NO: 14944
  misc_feature (1)...(44393): n = A,T,C or G

SEQ ID NO: 14947 - DNA, 15718 bp, Human
  misc_feature (1)...(15718): n = A,T,C or G
gtttgatttgggggactaaatgtgcttggcattgaccacaaagccgccatttctgtactatgtacagttcaggaataggtaggtgatttcgaagatagccgctagttctaaggatggcaaactactgtatttaaatccttctattctaaatctcgtttttcacatcagtctagttcggagaattttataagaacagtgtatttgaaagtgaaacttgtaagagtcattttcttaatccttttttgttttagcattcaactatggtagtaaataggtgaaaagtttgttcaatatttaaccgaaatatttgaaaacttttgatacatggatcttggtgctttgtggacattgcttttaagcctcaaataattaagattgttctgatcttttaaattttatggtacttgaaggtggaggagagtttacacattcatttgtggaatatatatttcctctcagtatttagatcttaaggtttttttgtggtgtgtaacaagtattctgctgtttaaaaacgtttgtttaatgcctactacgaaacgttttgaagtctcatcagttttgtcaataatggaccaattcttgaactcctaatttcttgagttttacattatttttacatcatatcaatcataggtgactcatcttttggagttctaatctgttgtaacagacgttatatttaaataagacaattgcattaaaatagaatttgctgccattattgttatggacatttttaagctgttataaaatagccaggaattaatgactttttttccgccctgccaagctagtttgtctaaatataatgtaaagaaattagctactcattttctggtccacgaaagttcctaaaatgggaagaagtggagatctgaccttgttagttctaaatacactaaactgggagtgccatggatggctttcaggatgtcctgaatcctctataattgtatacaaaatcgtgagtttttaaaaactgggttagagctattggttcctcagagtctcaggcatcttagacccccaaaaaggttaaggactactgacttaaccaattaggtttgagtggcattggctttgaagaaaagcagaggaaagatatattttataattctgggcaacaaaaaagtggatgtgtgccagcatcttagagtagaatcctcttaaaaggatagcactgcatatgaactagtaggttttaaccagtgcatatttaggcgaagtagctcatttttctgttagaattcttttttatttgggaatgggcaagcttttacagcttttaccttgccaatgaatacctggaatttaaaaaatcttgttaggcatattgcccataaagttttttttcctagatcatatattcagtaaatatgtttgtagctgtaatttcaatcccccaattcattgagggttgaaacaatttgaatggtttgagtgtagaagctaagttatttctgtagaggctaagggcatttataccaagatatgttagacttgtggttcctgctaaccattgctgtagacaataggaattactgtatatccacattttaatttttaacatcattctgtctttgtttgtttgtttttgagatggagtctcattctcttgcccaggctagagtgtggtggcgcatctcggcttactgcaaactccgtctcctgggttcaagcagttctcctgcctcagcttcccaagtagctgggattacaggtgcccgcctccatgcctggctgatttttgtatttttagtagagacggggttttgccatgttggccaggctggtctggaactcctgacctcaagtgattcgcccacctcggcctcccaaagtgctgggattacaggtgtgagccaccacgctcggcccattctgtctttatagcattatttttataaagttaagataatgtgaagtgagcttttactgagttattcagaagaccctacttgggaagaaaagaaaatcacattcacttgaacttaatcctacttgcttaaaaagttttgacatcaagatactgaactgtatcacgttttaggaccataaaatcctaatagtggatgcgtttaaataataggttagcatactttataaatgttagtagaataggaaagtcttcctggtgtataaactaaacactagaaaagttgaatggaccataataatttatgtaattatcaaatagctaagtaatttcagcttttgttacttgcttttactatctcagttttttgtaattaaagtctctaaagtattcattaaaatatttgtaataacatggttgaagtaaaataacttgtaggaagtttttgataataccaaaacttgataggcagcttcaattttttttctttattttcagtaatctatgccagcaattatgacaatgttagcagaccatgcagctcgtcagctgcttgatttcagccaaaaactggatatcaacttattagataatgtggtgaattgcttataccatggagaaggagcccaggtaaagtagccaaccaaaactttataacattatgacagtgtaacagagttgttgggtttagaataaaattttaaattatcacctttaaaaaagatattccatagtttgcattaatttggaattctgtattaaccataatgaaaattggtttggagaaagaaattgcatgtttgacatggttagagtgggttgttttggaatattatacttgttttgtccttaagagccaaatgttattaaatactttgtaggtattaaaggttctctgtacttttatatatacttaatatgtttggcactaatacgattcttctacttttaaaacatttacagaagtacttcacagatatgtttgtttaaataaaaacaggaataccaagtatttttatgttagttgaattttgtgcacttttcaaagtggtactgttaatgtagggaattatcttaaacataaaccaaattttgatcagtttaagatttttggtttttttgaacccaactaaaaggtgaaacagaaatgtgtgtacaattttaaattgtatatgtcacaagaaaaaaaacttgattttttacctgtggggccaaacttttttttgagacagtctcgctctgtggtccaggcaggagtgcagtggcgctatctcagctcactgcaacccctgcctcctgggttcaagcgattgtcttgcctcagcctccctggtagctgggattacaggcacacgccaccatgcctggctaatttttgtatttttagtagagatggggtttcaccgtgttggccaggctggtcttggaactcctgacctcaggtgatccacctgactcggcctcccaaagtgctgggattacaggcatgagccaccgcgtgctggcccaaacatgtttttgaatgagtaaaaagttttgcagttgggtcagaaatcttttttttttttcagatggagtcttgctctgtcaccaggcctgagtgcagtggcacagtctcggctcactgcaactnnnnnnnnnnnnnnnnnnnnnnnnnnnnggagttcgagaccagcctggtcaacatggcgaaaccctgtccttactaaaacaaatacaaaaattagccaggcatggtggtgtgcatctgtaatcccagctacttgggagactgacacatgagaatcacttgagcccaggaggcagagggtgcagtgagccaagactgcgccactgcactccagcctgggtgacagagagggactctgtctcacaaaaaaaaaagaaaaaaagcctgaggcaagaggatcactggagcccaggagttccaggctgcagtgaaccatgattgcaccactgtactccagcctgagcaacagagtgaaaccctacatctttaaaaaacaaagaaaaagccaggcgcggtggttcgcacctgtaatcccagcactttgagaggccgaggcaggcggatgacgaggtcaggagatcgagaccatcctggctaacacggtgaaaccccgtctctactaaaaacacaaaaaattagccaggcgtggtggcgggcgcctgtagtcccagctactcgggaggctgaggcaggagaatggcgtgaacccgggagcggacttgcagtgagccgaggttgcgccactgcactccagcctgggcaacggcatgagacttcgtctcaaaaataaaaataaataaataaaataaaataaaaaaacctaaacctgagtgccattacactttctgaaaatatataaggtggatacagtactatcttttatagtagtccaaaaagcatcatgtataaatgtttccattcccttatgaaatgcaacagtactgcttttactatagtagaaacttgaaaaaggtccatggaaacgctaaaagtagaaaaaattactcttgcagtgattctgtaagcttgttagcccaggtttatacttttagggcgttttgatcagtatattatctcctaaagcattcttgaaaaaattaaccatccgtatttattatccctgtcatttagttgttactcatgctatacattcaacatgaagctttaagcttcatttcttctagcatggatgcatagaaagcagctgcttttggaggaagctatgaaagtaaggttgggttcaactctgaatgtaatattggaagcacaggtctgtagccattgggaaaaagggcatttaattttttccgcatagattcagctactaatactgtttaatcttcacactaaactagttcactacatctaaaggtatgataaataaaccaacatagagcagtgttcttcatggcttgtaacagaattagtggcaatttttgtaattgagaatatattacagcaatactgcttttaataatgtttcatagtattaagaaatttaatggtttgttttaaaattgacttgttaataaaaagtagattaagaaaagtgtttctaaatttttttgtttgtaaggacaataggttaactttcccaaagtaaaaggattttgtctgcagtagttaatagatcatgtgacaaaatcagttgcgtagaaataactagcaaacttattttgtattataaatgaagaaacaagatttagagcttaaagctggttaaggagtccttttggtctctaaaagtcctatgtcgttagttcagtctacttttcgtttaccacctccttgggggtcttatttcaaaggaaaaggagtagtagtagcagcgagctgctatagtggaaaacatgatttttagtgttagacgtcttaatttgattcttggaagctctctctagtcattgcttaagtcccatgtacaaatatgacctgtcctacaagagattggagggttagttatgaggtttaaaagcacctattacagtgcttgataggtagaaggcactcagcttaaagggtacatttagcagtataatgaaaatgatttagcatatgtgatactcattgcttaaaattaaaaaaattttttttttgctactcataaaatatgcactaatgacaagaaaaatttattatgctaattaagcttttaaagtcaactgggaaaaaaagctgtaggtaggtttttttttttttaaaggaatgtgtaacttgggggaggggaagaaattatttacaagggtgacttttaatctgtagacagaacttctgcatacatggttagtatagtaggatatttagcagtgtaacattaggactaccctctaccctctgttatcagcatttttctatttttagccaagtagacagctagaaaaaagatgcgggaagagttggatgttttctccaatattgtgttctgttaaagatcttgaactctattgcttagcaactaaaatgctttcaccattcagttagtagtacaagggagatgctaggttttctctctttagtttgcttttgtgtcttttttttttaaacccctgctggggttttaagtttataaagaacattatgtaagaatggtgggattagaataaatcagaatgcaaatactagaagtagcatcagagagtaaaattacaactaacaggaaagaatattatttatgtagcgattgatgtgagtggtgatagtgtgggaagtatttgattctgtgtagaatgcttatcacttcaaagcatctgacaaaatggtaacttgaccaagtaacttttactgtgtgaggatctttgatacaacttttcctctagttagataaggttatctagctagatattctcagggagaagaccaaaacactgctaaaatgtgctttggccctagataagccacatcattattctttcggccttctgtcatttctcatatgacacattatgcccatcagtcctttaatgaaatcaaatagaaatgtgtatgattgtattttaaagtatacacattaactcttgtaaccacagactcacaatggaagcaggcgtctgatcttttcaggcaaccacagtggttctggtgggtttctgggtagagaacaaccatataagttattgagtgtgtagcagtgtgttttcctgattgatgtatgggatagtcatgaatgtggtattgtatttcctacctgaggaaaaggtcatgattaaaataaagcatcaaagccaggataagcatataatttctttctttttttttttttttgtaatgagacagagtctcactctgtagcccaggctggagtgcagtggtgtgatctcaaatcactgcaacctccgccttccgggtcctggttcaagcaattctcctgcctcagcctcctgagtaactgggattacaagtacgccccaccatgcccagctaatttttgaatttttagtagagacggggtttcaccatgttggccaggctggtcttgaacttctgacctcgtgatccacccaccttggccacccaaagtgttgggattacaggcgtgagccacggtgcccacccgagcatacgattgttttaaaaaagactagaataaaagccaagctaaagattataaggtatctttgtcagaaatggttgtgagagtgcttcctaccctgtttttgatgctttattgtttataaccatagaattaaacccatgataaagtaaagtataagagaaagataactgacagattttaaagtcatcaaacttttttcttgctctgtcacacaggctggagcacaatggcttgatcacagctcactgcagccttgacttcccaggctcaatcttcccacctcagcctcctgagtagctgggaccataagtgcgtgtcccaccacacctggctcattattaatttttctttgttgcccaggctggtcttgaactcctgggattacagacatgagccaccacacctggtccaaactttttgcttacaacttttaatagaaataggtaaaagaaataggaaggatctaattgagttataaaacaacctttaaagatacaaaagtgaaaaagattaagccattgctttttgtcaatagaattaaaagctgttggtaaaaatattaatgtatgaaaaacttattgaaatgaaaaaactatatatatatatatatatatatatatatatatatatatatatatataaataaaatgtcgacatggctggatcttaaaaactgtcaaatgaaaaaaactaattgcaggaaagattttttttttttttttgagagggagtctcacgcagtcaacccaggttggagtgcactggggcaatcttcctgattcttggggaatcttggctcactgcaacctccgctcctggattcaagcgattctcctgcctcagcctcccgagtagctgggactataggcgcacgccaccattcccggctagtttttgtatttttagtagagatggggtttcgccatattggtcaggatggtcttgaactcctgaccttgtgatctgctcacctcggcctcccatagtgccaggattacaggcgtaagccaccgtgcccagcctaaaagatttttaagtatactattaacataaaatttggtagccgtacaaccctattcatgaaatttacacacatgccgtgaaaatgtggacaggaaaagacacactaagttcatgatgaaagccattactttttaaagaaggaacaaaggtgtaatcccagcactttggggaggctgaggcaggcgggtcacgaggtcaggagttcaagaccagcctggccaatacagtgaaaccctgtctctactgaaaatacaaaaattagccaggcgtggtggcaggtgcctgtagtcccagctacttgggaggctgaggcaggagaattgcttgaacccgggaggtgaaggttgcagtgagtcgagatcctgccattgcactccagcctgggtgacagagcaagactccaactttaaaaaaaaaaaagagagaaaaaaggaataaaggaaggaaatggcactagggaaaggcacaaagatgacttccataaactttagttattttatgctaaaagaaaatctgatacaagcacaagatgatgactacgtagattagtatttctgggttgcatgttaaaaatatgaaaataaaaacggaaatagtttccaaaacaaagattttatatatgaaattagtgaaatttcagaatggagaaaggatggttacaataaatgttaggagccctctttaaagagctcaaatggtatgtaagtatttgggatttgtggtttaattagacctagttttcagcagtctttccatgaaatgtatttttgtatttagagagatcttggtaactcttgtaaagcagagtgtcctgctacattacataacttacctaagtaggtgtgcttttttttgtttttctagagacagggtctctgctctttcacccaggctgaagtgtagtggcaccatcatagctcggtgcaaccttgatttccagggctcaagtgatcctcccatctcggtctcctgagtagttaggactataggtgcaagccaccatgtgcagctttcttttttttttttttttggagagtcatggcctcgttacattgcctgtcacctagactggccagctggtcttgaacccctggcctcaagtggtcctcctgcctcagtctcccaaagtattgggattacaggcatgaaacactgctactggcctagataagaatttttatattgtttttggttgatttaagtgctgagaacttatttgcttcagaatagatctttggttgaaatgcagttcagttttgagactaaaaaataaaccagatttactcccaaaaatgttactgtttcaaataagtaaaatatttgcacctttaaagattaggagttggctgggcatggtggctcactcctataatctcagcactttgggaggccaaggcaggcagatcacctgaggtcaggagttcaagaccagcctggccaacatggtgaaaccccatctctactaaaaatacaaaaattagctggctgtggtggcacctgcctataatcccagctactcaggaggctgaggcgggagaatcgcttgaacccaggaggcagaggttgcagggtgctgagatcgcaccactgcagtccagcctgggtgatagagccaagactctgtctcaaaaaaaaaaaaaaaaaattgggagtcatatttatataattttatttctatttctgtaaggtctaatttttgagtatttctgaacatcaataatagaatctctgtccaattagaatttgtgccttgctcagtagttttcattttaatgaatgattcaaaagaatacattagcttaagttttgttttttttaataatattttagcaaagaatggctcaagaagtactgacacatttaaaggagcatcctgatgcttggacaagagtcgacacaattttggaattttctcagaatatgaatacgaaagtaagcaagtggtggttttaaaatctgttatttcttttcttccagtcataaactttgaggaaggtatctcatttttagtattagcatttgttatctcaaattattttatattgttaatttgtttcaaaatttagtcttaagcatataattaattcttgcaaatagtcctaagaattatgaatgaagttttgtaatgggactagtatgcaaggtggcttttttggttgtctgattttgtttttttctttttagtatatgtatacaggtctaagtagcataaattctgaatgttattcagagattaaacataacattaaggaattattttgggcaagtaatcaatataatacaggccaggcacctctgacaccaagttgtgtggacagcttaaaaccctactccatggcattgggcttctaatgggacagcactcagtttttatttacaatggaaaatgttataattctggtccttttttaagtttgaacagaagggttgatcaaaatgtgttttgtctgttttaggcttgatgattcacgcttctctttaaactgccttaaagtaataaatactatggcattctgtttaatacacgaaaggtttccacttgatatacattgtgttaaaacagaagatagccatattcacatctgtttctgaaaccagactttgttaattaacagttttaaaatattaattagttttgacatcttgtaaattttaggtcaaaaatacagtccagaacttcctcaaagtgctaaccttaagtaacataacagtgtttgcctgtttgcttgcctggtaaattttgctttttatactgacagacattactaatgtttaagttgatttatcaacagtatttttaaaaactcaaatttgtcttgtgaaaaatgagatgattagaggaacagaaagaaagcaacaggtaaagaattcttcaatttacataaattacaaatgatttggtgctaaatttatgcactatgacatttggcttttatgcaatcatttttttttctttaaagatgttaacactacctgatattaatcataatgttccattatgttgattgcttgtaataggaagaaaaggggtgtcttcctgtgcaactgacacagctaggctttgacggcaggcctccacaaggtctacccttttgattccctttaactgaattctgttcatcaattgtttttgtttcatgggcggtgggaggggaaaggggaattcaatgcataaaataagtatttctaagggctcagtagaaatttctaccatagggatcatttcatgcatttattttttcatttagtctttgctgttatctgtccctcatcttcataactcagcagtggatttctcaagtttggagatgtaaggcaaaagtataattctttagaatgtttggattgtagtgatttatcattggctttcagatttgactgtcacttcagatttttgagcaaaaatactaaaaaaaaaaagaaaaaaaattctttgaagagacaggacctctgttgcccaggctggagtgcagtggtgtgattatagctcactgtaacctcaaactcctgggcttaagtgacatttctgcctcaactttctgagtagctagggctacaggtgcgtgtcaccatgcctcgctaacttaccaatttttttatagaagtggggtctccctgtgttgctcaggctgatcttgaactcctggccctcccgccttggcctccccaaaatgttgggattacaggcgagggccactttgcctggccccaaataacattttttcaaaggaatgtaaattttttttgttttagtttcataggcaaagtctttatgtctgggagagattggattttaggatattatagtaacagatgtattcctttgacctaacctgggcaaagcttttattgggctccctgcttcaacccccttggcagaaagatgaaatatgaattgtatcttcatcaagcttatgctacctttatacagttgtagaaaatacaggttagtaaatagtaattttaggtaacagtatcaaataggaagaagtaaataaaaaagaaaggacagtgtctttccattaaaaatgtaaaaaagtttggttaaataagatgaagttatctttaagatttttatttgtaactatatttatggtgggttttgtttcttagtgttttaaaggctttttaattgatttttggcaagaggatacattgtaagcagtgcattgctttgacttactgagtcttgacaatctgattttgtgcctataaaattaaagaaaatgcttagggtagtatgtttttaaaagctaattaagaacttcaggcatttggacaactctcttttttttacatatttctcagacctagacataataaatagatatgtttttaaaagtgaacaggttagaaagcatcactatttactgctgattatgaaacattttaatagcatcaaatttgtaattttagaattttgctttggccttgtttttattttgaaagtttttaaggaatgttctgcaaatgtagtactttagttgaaatggcaaaattttcttgaagagtgtgaaatgttaaaatgaaagaaaacagcaaaaacattcactgtttgagcacaatgtagtttgggacagtctatattgtgctttggataaaatgagcattcacatgatccctttggttgaaatactaatgctcctattttattgtgtaatgactaaccattttaaagatgaactcttattctcagccaaaacttgcaatctgaggttatatgtctatatatgaatgagcttacctttcagatattatagctgattcttccctaattctctcagttgaaatgtaccacaacggttttgtcccttttcttcctcctgcctatccacactaattggtcatagtaattcaggtagtaactcctggggctttataaattattataaatattgttgactatttagagtgagtaatcagcaggagggacaaaatggcttgaaagtggtatctctgttttttaattttttatacttttagttataactttcagtatttaggaagaaatacctgaaaggtagatacagattgcaacatgcgtttgtgattattttgactgtgcacaaaagtttatctttaaattagtagaaatagcaactataagggtggggttaaaatataaaataaacccatgggttgtcttgctgctccttaagtaacacaccagtgatgcttgtaaacactttctatagaaagtatctgtgacaatactttaatatttggccaaaagcttataactcctagaggatggtaggaagcttgatagcatccaagctgctaaattcttaggagcctgttcgtgttaaagtacgtgagcctatgagcagtcatttatgctgtgaattcatatctggctgctacttttccttcgacagataagcctatttggctgctaaagggctttttatttggttcttcctcctggtgtgagcatgtataaacagcaggacgttatatagagtagcaaacaataaaatgaggaaaatgcatgaaaactcagtatatgggtgaatagatacttgtttaatatgtgtaattaaacttggtagcataatgtttttgaaactttagatgtaaatgtgtgaatgtctgtccatttgtgaatcctgagagttgccagtcctataagcaatatattcacatgcttctattctccaattttcagtactatggactacaaattttggaaaatgtgataaaaacaaggtggaagattcttccaaggaaccagtgcgaaggtaggaaaataaagaattataaattcagagttttgtttttcctggcatttttattgtagttgactgtttgagggggcatgtaatgaatctttagtatattttgctctaatggagcttattgcttttatcatgaagcaaacaggtctgtttgtattggtgggtacaggaaggccacttacaggttatcttttgggagaaagaggagactggactgttgaaaactctgacaataaatattctagttaaaaatatgggctatggcacagtggcccacgcctgtaatcctaacacttcaggaggccgaggcaagtagatcgcttgagtctgggagttctataccagcctaggcagtatagcaagacctcatctggacaaaaatttaaaaaattagctgggtatggtggttcatgtctgtggtcccagctatgtgggagcattgcttgagctcaaaaggtcgagactgcagtgagccatgatcctgccactgcacttcagcctgggtgacaagagtgagaccccatctccaaaaaaacatatatataaataaaatatgggccgggcacagtggctcaagcctgtaatcccaggacttcgtgaggctgaagtgggagggtcatttaaggccagaagtttgagaccatcctgggtaacatagcgagaccctgtgtttacaaaaaatttaaaaattagccaggtattttggtgcaggtggcggcggggacaggggtatcagtggggtgaggtaggaggatcccttgagccaagaggttgagactgcagtgagccatcattgtgccactgtactctagcctgggcaacgagcgaaactccgtctcaaaaaacaagaacaacaacaacaaaaaaaaccatatgtaaggttaactcgggaatggaaaagccaagtactaaagatcacaaagctgttttgccttttgtggttctgggaatgccttggaagaggttggcttctgaaatgaagaaagatcagaaaatgaaggtgtagtgatacctgttaatgagtaatttaacttttctgtctgtgctaccttgaggaatgtagtcatattttgagaaacctgaggcaacattagtttcttgggattctttgatttagctaatttcagttatgatacactgcctttttacctactatatttcatttatctctgaaaaatagaaatttttttcttgactttattatggggcacatgatacttctagtagtattttcatttaaaatatgtctaatttctttgattatttgtcttttaagtattgtccttcacctgcattctcttatcatcattatggtagaatagtgacatggatttacttagctaatctgacttaaaccttgacaaagtttgagcacatttagagttgaatgtgatgagattttaatgccagtgtctttttttaagaatattaagtatattcagtggcaatatctttaatacatcataaatcatagattaagagtgatagtgcaggagcaaataatgtgccctaaaagaggttctcatttctttaaatgttttattatggtttgaaactattttagatcacgttctgtgatggactgagaaattaataagcacaatttgactatgtggtccaagtaggtccttcatactttattcttcagggatctttagtgtagtcattccttgtttctttactactattgttttactcatgtgttatgagccccagatttaattttggccatggtctgccgtaccaagaaaaggtgatttacttctgtcccattttactgttgtataattttaaatcctccttttgttcttaaatctgcatctctgttttttatcacatttgatggttctggaagatgttttccaggttgaaaatagatatgattatactagtttatcaacactgtagttacatttgttacagacaaaattaatttaaaaaatttttgtttctttctttcttctttgttgagacagattctcactctgttcctcaggctggagtgcattggcacc

SEQ ID NO: 14948 - DNA, 41863 bp, Human
tttaccttacagattatgagcaacctgaggacaagatctgtgccttggcttcctcagtttctagctcagtttcttgcacattctaaatgtctgatgaaccaatggatatatatatatatatatatatatatatatatatacatatatatttttcgagatggagtctctgtctgttgcccaggctggagtgcagtggcacgatctcagctcactgcaacctctgcctcctgggttcaagcgattctcccatctcagcctcccgagtagctgggattacaggagcatgccgccacatccggctaattggctaatttttgtatttttagtagagacagggttttaccatgttcttcaggctggtctcaaactcctgacatcaagtgatccgcctgcctcgacttcccaaaatgctgggattataggtgtgagtcgccatgcctagcctcaccaaaggcatcttataattgatcaagaacttcatttgttcagtgaggcacagattctttccattctatagatgagaaaattgaggccccaggagagaaaatgaagtactaaaagtaacataggaagtcagggcaagaggcaaaatgtgcaggttatatctaggttattaattcaacgttacaagaatcatagcattgcccttttaagccagtcccctgccactgcctcccatatctgaaagagaaacactacctctctgggatgttctgcacatcattacatccctgtaacacactgcctgacacacactggccctgacatctgaggggtgaacacaaaatggctacttggcttaaggaattccgaccagatgggttatttctcatggtagttgtcggtaattaaactcatgcgaaatccaatgaactccatcctcttgccacctcctctcagccaatcagggtcatgatgtagggtgaaatctatcatcgttgcctctgtggcctgaaacaagaggaaacctaatctagcccttctcttgtagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggaggtatggcttgctaggaggccttttgctgttgggattcagagtcagcttgctgggggaggctgggtgtcactgcgctatcacatggggcagcaacctggttgctataaccctgactctgcctcatcaaccactttcttcactctcactgctgtactgcactgatgtgctgtcagagaaatccacatttcctttttaaaaaatgtaattaagctgagcatggtggctctcacctgtaatcccagcactttgagaggttgaggcagatgaatcacttgagcccaggaactcaagaccagcctggccaacagggcaatatcctatttctacaaaaagttaaaaaaagattagccaggcatggtagcgcatacctgtggtcctagttactcaggagactgaagcaagaggatcacttgagcccaagaggtcaaagctgcagtgagccatgattgtgccattgcaatccatcctgggtgacagagcaagaccccgtctcaaaaaaataaaaaataaaaaataattaacaaactttactttttagagtagttttaggttcttagcaaaattgagcaaaaagtacagcgttcctagatatcccctatccccacataggcaaaaacacattctctttttgtgaagttattacacataagaatggtactttctgtatgttagtgctttaagtacagtgtggtcacatccattcctttatcttagccttataagaactccgcaaggtgggcagcacacagcttatcaaacccattttatagctgagaaaacagaggcctagagactcttgctatgagttttagagtcaagattaaacttaggtgttctgtctctgattcctcctttctttctttttcagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttggtgtgtaatgttctttacttgtttctactctaatacagactgcgtctcagagatgtggccagattaaggcaaaacttgcaactccatgagggcacagcctgggcatgggtttgtgcactgttgtgttccttcctgcctagcacagggatgcagcagccctcaacatttaatgaatgaatgaatgaatgagtgcatgagcagatgagtgcctgagagtggtacataacgactgcactgtgtggcctggggacagctattgcttgcagaaacacctcattcttggggtcagatgttggcttgacagctctagaaactccatttttcacagtgctcagggatgacttgctactggagacagagtcaaccagccatagcccctactctgagaggaagctttatctggaagaccagtagacaattatcagtttctcagagcctccctcctgtggggtcagctcacttaaaagaccctattaagttgggtgcagtggcttacacctataatctcagcactttgggaggccaaggtggtcagatcgcttgagcccaggagtttgagaccagcctgggcaacacagcgagaccctgtctctaccaaaaaaaaccccacaaaaattagtcaggcatggtggcgtgtgcctgtagtcccagctactcgggaggctgaggtgggaggatcacctgagcccatggaggtcaaaggctgcagtgagccgtgattgccacaccatgcttcagcctggctgacagagtgagaccagaaaaaaagaaaaaataaagacaggctaatgtttttagagggcatttcttaagctgggaagataccacaacaaatttgatcatttcattccaataactgttaaattcagaagagaaaacatcccgtttaaataaattgcctcatggtttgcttgactcagtccacagtttcagccaaagaatgggtatgtgcaacctatcggggcacagcctcggtgaaccagttacaagttaacaaattttgctctgggtcaagaaatcaggagcaagtaactgggtccagttccccctcctctggcacatggggacacaggcccagagagagaaggaacttgcctcaagttacacagtaaatgagaggaagaactaggactatgtccaaggcctccttactcccagtcagtaatagtaacaatgaaactatcaacaacaacattaatttatgttagtgcttactatgcgccaagcactgtgctaagtgctttatatggattatttaattttacatatgttacttgagaatgacttttcacaattaaattttaattcaccagttaagtatgtttattatcctcaacttacagatgaggaaactgaagctcagaagcattaataacacggctagtaagtggtagagcttgaatttgaatgcaggtctctatggctctaaagcccaggaccttgtgcatcaatggatgttaaatggaatcctctttgagctggtggttctgttgcaaggactttggaggaaggagataaatgggaatggaaacgcggaggcatgttgtaacctattttttttcccctgccattttgggtcctggcagaaaaccagagaggtgtatgggaaggagccatgggagtgtgaggaagaggagctggctgagatcctggtgagctgaaccggggcagcacgagccccgatgtataacaagtgcaaagtgctcctgagcatgcaggggtttctccttgcaaagcatgttccccatcactctgttctgatccttccagcagacccaggatggggacagggctggacaggaggtgggcacccagaaacacttcatgtttcctaatcacctgactctattccttatacagcaagcggagctgccagatgcagataaatacgaaattaataaatttcacttcagtgacttacccctaacagaactggagctggtaaaatgtggaatacagatgtattatgagctcaaagtggtggataaatttcacattccacaagaggtgaggtcaaaacaaatatatatgatttccctttttaattttctttcttgcttgctttaaaaaaaagactcaatctgtaaactaccttaaaaagagtttactctcagtatttaggatttaaagaattagtcatgttgcacagatgagtcatttataagaaaagagacacgctgttcctctgtgtcctgtgaagtgtgatgttttgggtgcgttggtttcttgcagtgggttctgaggtactaagccctgaaggctgggaatagatatgctgcaaaaaatgggtcctatagttaaatgagggcagaaaatgtgggctaaacccatttaaacagggctcattccctgcaggattccttactaaggtttgctgtgagtctagggtcatgggggacggcagagaaggtatgtgtgggaggcagtgggatatgatatgcagaattgcctgaacttgtttgattttgattaaagcagtggttctcaaagtgttaccccagaccacatccacaccacctaagaacttatcagaaattcacattcttctttttctctctctctctctcctctttctctctctctctcacacacacagacacacacacacacacactcccagctctgataaatcagaaactgttttaacaagtcctccaagtgagtctcatgcacacgcaagtttgagaaccactggataaaagagtccttttgtttttgttttttttttccctgtagagcccttgttagcttctccaaggatagttgctctccagggcacagttcgggaattactgatgaagctcagtcagaggaatgatgcatgctcacctcgtttcctaacaacaacaacaacatcttcttagtatttagcatttagtatttgcaaagcactttcgcagcatgattgcatctagtacaagctctcacctcctggtccaatgatggggttagagtacctcaaacctcaaaagagagggccatgggccatgccttcttcatatttttgttattccaaccctcatgagaccatttcaggtgtgtcctgcctcactgatgtgcatgtgttcacaggccctggtgcggttcatgtactccctgagtaagggctaccgcaagatcacctaccacaactggcggcacggcttcaacgtggggcagaccatgttctccctgctggtggtatggcggggccggtggggctggtagggtgggcttgcatcacactagacaatctcatgcagactctacatggtagcaacagcgttgttcttctttctttatttattgtcttttaagagttatgtgaaagcagtacgggcttagtgtaaaaggattccaagaatagagatgcatataaaataaaaagtgaaagaaagctgcaagctacccccaacctcagtcaggttatttgggggtaaccatgtcacaagtataaaagtagttcaacagggccgcctgtaatcccaacactttgggatgccgaggcgggtggatcacgaggtcaggagttcaagaccagcctggccaagatggtgaaaccccatctctactaaaaatacaaaaattagctgggcgtggtggcgggcacctgtaatcccagctacttgggaggctgaggcagagaattccttgaacccgggaggcagaggttgcagtgagccaagatcgcgccactgcactccagcctggtgacagagtgagactctgtctcaaaaaaaaaaaaaaaaaaaaattcaacagttcaattggtcatggttatagtctttgcttgggggcataatgacaattaggaacatatttcatttttaaatggcctgttataaagaggtatccatttctgtagttagcctggcaatgcaagtcatagtaatgtggaaatccacttaaaataaataaataaagattagaaaaccttgaaatagaaaagtttgccattcaccattcgagatgcctccaaaccacctgttagctgctcccataaacacatcatgtgttcttttccccagagaaattttctgaaatttccttaaattgtggcagtgtctagagaaacagcagtatcagccacctttaaattaagcttcctgtagtactaaaatcagagaaaagataagtgcaacattcagttttgttcagcctcatacacaagccccaacaaggacaaaaaggaggtctaaagctgcatcatgttccattaggtgtttccatgaatcttctcatccactttttagagagttgcttctacctgtctgaacactgggaggcctgattgactataaaatccaagatttccctctaatgtataatcagctttaaattccctataactggtacccctctaccagcaagagtgagcccccaggagccccattggaaactttcctcagtagacactaacttatattcatctattttgaggtcattagtaattctggttattgattgctttggcctctgattgtgggagttattatgggaactttcaggggcaagctatctgggagcatgagtgagcctggccaaataacaagttctgaaccatcagggagacagaacagagtaagcaaacccaatataagcccttgggactggaaaagaggccagctagtgatgcatgaacagagttcagttaagtctgtccactcataagtctgcatagctcctgaacagggtccagtgagacacttacttttttgtagtcccttcatagcatactgtaaggttgcataaccatatttagtggaaagaaaccttactggatttaatccagtgacatcctacaagcaattactcatacccacataggtagtctccaggtcttgactatacaatacctgaaagcaggatataccttttgtaggcatcacttagatgggttttctatatttggcagtgattaggttattaattagaaaggtcagagtacggtttccttcatgatggcagagaagtcttgatctatgatccctgtctagaatgccatctgtttctgtggaaaaccttccctggttagctttacccgaaggagtccaacaggtgtatacttccaggaatctggagggaccttttgaattgagagatgtagatccaagactcaaggccctaaagttttgcggtagagaagaacttggtatggtcgcgtccaatggagttcaagagcagtcttcctttggtgtaatttccaaaagacctaatctttgggttctagatcatgaaagatctggttgtcatcaactggtgggtcacaaagggcttctttaacctgatgaaaatatgctttggcataatgcactaaagttctgcactactgagtcacgtcagagtttataaaagtggaagataaatgaggttctcttaccaggggcatacaccttcctgtaactatttcgtatggggccaatctgtttttcagcaggagtggatctgattgccatcaattgagaatacctttgaccaaggcaatccaattgattcagttagctttgcctaatgcaattgtgtttaaaatatctttgtaaatggttttacgatgtgtctagtgaaatgagtatctctttatctctatctataaattttatacaggctgggtgcagtggctcacacctgtaatctcaacactttgggaggcttaggtaggtggaatgtttgagcccaggagttcgaggtcagcctgtgaaactccatcactacaaaaagtacaaaaattagccaggtatggtggcgcacgcctgtggtcccagctactcagggagtaaggcaggaggatcctttgaacacaggaggctgaggctgcagtgagctgtgatggcacaactgcactacagcctgggtgacagagtgaatcattgtctcaaaaaaaaaaaaaaaaggaaagaaaagaaaagaaaatgtcatacaatttctgaaacacatattaataacatatccatagactataactcaaacaaagcttagcattattatttgacagtgcttccagaaaagtctctggagattttctcaagaattcctcacaagggaaaaacatttttttaagttttttttttgatttgagctcctactctgttgcccagtccggaaagcagtgatgtgatcatagctgaatgcagcctcaaactcctgggttcaagtgatcctcccatctcagcctcccaagtagctaaaactacagacaagtaccaccatgcctggctgatttatttattttgttttttagagagatggggggtctcactatgttgccatggtcttgaactcctggcctcaagtgatcctcctgctgcagtctcccaagttgctggaattataggcacaagctattaaactcagtgaaaaaatattttctaatagctttttaagtagtgttatagcatcagccttcctgtatgggaacggttctataaaaccagaaaagaagcactaaaggagcagttaagtgaaatccatttgtaagtgttcagatgatccagtgggtgctggaaatgtgttgcctgagatttttattgtcttgctagaattatgagtttgacaaaccaaactttttttttccttttttttttgagatagggtcttgctctgttgcctaggctaaagtgcagtaatgtcattatggctcactgtagccttgacctctcaggctcaagcaatcttcccatctcagcctcccaagtagctgggtcaacagacactcactgccatgctgggctaatttttaaattgttttgaaaagacagggtctcactatgttgcccaggctggtcttgaactcttgggctcaagtgatcctcctgccttggcctcctaaagatctgggattttaggtgtgagttaccacgcctggccccaaacatttcttgaaaccatttcagcaattctacttatttatttattttgaaatggaatctcgctctgtcgcccaggctggagtacagcgatgtgatctcggctcactgcaacctccatctcccaggttcaagtgattcttctgcctcagcctccccagtagctgggattacaggcacgcgtcaccacccctggctaatttttgtattttttgtagagacggggtttcatcatgttggccaggctggtctcgaactcctgacctcaggtgatctgcccacctcggcctcccaaagggctgggattacaggcaccagcctccgcacccagcccattttagcaattttagagcagtcaccttgtcactattttgtcatcatttctgtcattttatctcttccatgatgagtcatggagtgcagtaatctaataatggaagctttaaggactcaagaaggatgaggaggccatcgggactccttatgagtccacacttaacattggatttacatccttttaaataccaatttcatttctccaattcaggtgcatagcactgtttattaaataggttatcataggtaacttgacttggatcaatgtttggagttcattaaaattgtatatctcaccaatttcagtactggctgacttagcataaaaatctgccaaatcatttgttttaattttcaattattttttattctgcttaatactgagttagcagttttatgaaccagtttcttcactggaattctggaaattcttccccagtccaatggtatgatcttatgaagaagaaacactttaggcttagagttgctcaggaaagtagcagagtgaaaaaccacctgtggatgacaagactttacatggtcatggttaaagatctcatgagagttcattacaataatgacacaattgacaaggaaatttggttatttccgttgcaaacattttaagacaataactaaaattgtgactgatagtgttataccaggaatactagatttctatgaattttatacagtttctgaaacacatattaataacacatctttagaatacaacttgaagatttagcattaattgtatttgacaatgcttcccatataatttaatatataaaataagcctaattagtttaatgtctctctttttacaagaagagatatctttttgagatgttctaagggttcatctgaaaaattccaaagttaatttgcagtcaagaaaaatacttaatttagaatatgattttggggccagacgcagtggctcatgcctgtaatctcagcactttgggagactgaggtaggtggatcatttgaggtcaggagttcaagactagcctgcccaacatggtgaaaccccatctctaccaaaaatattttaaaaattagcctagtgtggtggtgtgtctgtaatcccggctactcaggagggtgaggcaggagaatcacttgaatctgggaggcagaggttgcagtgagttgagatcgtgccactgcactccagcctggacaacaaagcaagactctgtctcaaaaaaaaaaaaaaaatgaatatgactttgggaagtttctaaatgcttgaattttttttttttttttgagacagagtcttgttctgtcacccaggctggagtgcagtggcatgatctcagctcactgcaacctctgcttcctgggttcaagcgattctcctgtctcagcctccccagtaactgggattacaggtgcgtgccaccgggccaagctaactttttgtacttttagtagagacgatatttcaccatgttgccgaggctgatctcgaactcctgacctcaagttatccgcttgcctcagcctcccagagtgctgggattacaggcatgagccactgcatccagcccaaaataagataatttagcctagtgtggtggcatgcgccagtagtcccagctactcaggaggctgagatgggaggattgcttgagcccaggaggtccaaaccgcagtgagttttgattgcaccagtgcactctagcctgggtgacagagcgagactctgtctcaaaacaaaaataaaataagataaataataaataaataaataaaaatacagaaagttaaatacttatagaaagaccttagctcttttaataaagaaaacagttttcttaagtgatcaaaaacctaataaaggcaacctggagtacaggaaattaatttggtaaagcacagaatctttgtttcctaggtcaattacctaaaagataaatttcctgttaacagcagaccaatactcaaagaaaatttgttgttttaaaagagaggtccaagttctagttttgcatcagtgtacttttgacatcaatgttcaagatagcattaatttcaaaattttagaaaaacttcaaacaattttcttctgatctttttttttttttttttgagacagagtctcactctgtcgcccaggctggagtgcagtggcacatctcagctcattgcaagctctgcctcccgggttcacgccattctcctgcctcagcctcccgagtagctgggactacaggcgcccgccaccatgcctggctaattttttgtatttttagtagagacggggtttcactgtgttagccaggatggtctcgatctcctgacctcgtgatccgcccgcctcggcctcccaaagtgctgggattacaggcgtgagccaccgcacccagccattttcttccaatcttagccagcttcatcacacatacaattactttcacaagatttatcttccacaagccttctacaactttcttatccattcaactttttcctatactttttcctcttctcattttggagtaaccagttatcctacattaggacaaaagtttctcttttcacccttaacaaaataaaacatcctcatatcttatagctttttcttaccaaaagcagtttttgccctcttgtataattgcttatagaattgtttcccttattattttattaataatatattaattattagttattaatatattataaataacatattaattatgtgttaagaattctaaataaagaaatatatattaatatatgttaatatatccttatattaattagaattcttaacccttagtgaccttaatttccagtgaacactaggaagcaagcaaaaattgtgaactgtctgtcacaccagcaatctgtagatcaatcgtctgtgaataataatttctagaagcatgtagttccccatagtacaatctgtcactgtggcacagaaaatttttagtaacagtcccaaatatttttagtctcttggtaataagaaattgtagaggaggcaacatttaatctctatcctcttagatctttttttacttttgagatatgatcttgctctgtcacacaggctggagtgcagtgctgagaacacacggctcactgcagccttgacctcctgggctcaagcgatcctcccacctcaccctcccacatgttaggttttgaagggaaggcgagggttaaagaaagacacacacacacacacacacagaaagagggcggctcaagagcaaatgcaggctttacgcccagcataaaatctacagaagtaggaaccagcctaatgccagagcccaccgctgcttacaggctggtggtacttataggtatgggcgggaggggtctgggcagtatggcttgttgcctggcaggctattgataagatgttctcatgatgaggcggttttgcttttgtctcggtgggatgccattgtggtgtttcttggacttttgcccagcaagatatgataggaatgtttctttagttgggcctttgtctgccttgtggtcaggtggttaggaaggctgtttctcccgacccaaacccccatgaaatgtttcactttgaccaaggtctgcaaaataatggggagcttacaaaatggtgcagttgggactaacaccaggtagccgagaccacaggtatgtgccaccatgtccacataaatttttagttttgtagagacagggtctggctgtgttgcctaagctgatcttgaattcttaggctcaagtggtcctcctaccttggcctcccaaagtgctgccatgtgtgacctgccatgcctggccctgtcttattttttgtttctttcatcttgactattctatgcacctcatatacagtgaggtgaaatcatacagtattcgtcctttcgtgtctggcatatttcacttaacataacatttttgaggcttatccatgatacaattttgtggctgcatagtgttctattgttggacttggaagtcttttcaatctttcactattacaaacagtgccacaatatccttggatggacttatctttgtgtatttgtgttcgtatttttcactgagagggttcggagacttttatgttttatttcaagttatttccccatccagatcatgatgcaaatccctgcccttcctcaacatcatcccttcccccttggctgaaatggtcaggccagagtaggtgctagggcccggaagcaggaattctgaccaggctaccttaaagggtgacaggaacaccacttagagtgattgctttcataaagtcagcatcagctctccagagcactttcccacatttggtttcaacacccagcatcaacaaggagttaagtgtctggcaaaatcccagggaaggattcctccaggctgtgcttaaaccagtagaccacgtttggaagatttgctttaccagcctggccatgttcagaaactctccaaatcctaaaacctgacttctacaagtttctcaaaattcatctgatccaatatgctcgaccctcattatggagattgggctaccgaggttcagagggagatgagaccagctaaggtcaactcagaaatagggtgaccagttgttcccatttacctgggactttccccattctagcactgaaagtcccatatccaaaaaacccctcagccctgggcagtcctctggtcagcctctggagccaggatacagccaagatcagacccatgagttttttagttctgggccctcctccttacacccgccttttcagccctgcttccagcccctacacaaaaggaatgatttgcactctgattgcccttccagacgggaaagctgaagcgctacttcacggacctagaggccttggccatggtcactgctgctttctgccatgacattgaccacagaggcaccaataacctctaccagatgaagtgagtcagcctccctccccacacccaaccctccggattcattatccagctctgtgtggctcccaggcagactcactggccaacagggaagtcttgtggtccacagcttcccaccgccttctgcccttgggatccgggtctcctcctgtagcaggcagaataatgaccaccacaaagatgtccagatctcaaatccctgagctggggaatatgttgccttacatacaaaagggactgtgcagatgtgattaagtcgaggatcttgagatacagggattattcattcgagtgggccccatgtagtcccaatggtccttataagagggaagcaagaggtcagagaggaaagaagatgctaccctgctggctttgaagatggaggcatggcctacaagcaaggaatgcaggtggcctctagaagctcaaaagagcaaggaaacggattctcctctggagcttccagaaggaaagcagccctaaggacccatttcagactccatacagagctgtaaaataataaattttattgctttaagccattaagtttgtggcagtttgttatagcagccatagaaaatgaatgcattaaactcctgtacttgtctccttccttgtcctacctgctgcactaatttgagccaagatgttaataaccagtaatggttcattcactcatctcgtatttacagtgcttctaatatagtgtggtaggctctatgccaggcaaaaaaggtgctctgatgagcaaaacagctcctgtccttacagagcttatatttcagacagcccataaagcatagtccttgaaccatgatctcattggatcctcacaaccacccagtgggctgggcagagcaggggctaatgttatccctacttacagatgagaaaactgagtctccgctcagggccgatggcctgtaagtcattaacaagctctgaattcatgctgctgagtcttctcaatactttcatgctgctctggggctagagattgggtttacattttacattttgagaatctaaatacttagcacagtgtgtggcacatagcaagtgctcaacaaataattattgaatgcagaaatgaataaatacacggcttgcggaaattcagttgtttccttcaagacttggatgtgaagaatcagggctagatgatcttgaagcatggcccagtgctaatgtccctaaaatcccttatggcattgtgtgtgtttgtggctttctctggggaaggggtccatgctatttagtagattctctaatgagttcacgacccaaaagtaactcggaatcacttgtggagaaggctgaagactgagtcaggagacttgatgtttagtcctaattttctattgtccactccatattgattctctctctttctcattcagatcccagaacccactggccaagctccatgggtcctctatcttggaaagacaccacttggagtttggcaaaacactgctcagagacgaggtaggatgagggccaagggtctacaggccgcggggcctggatcagaggctctatttcacaaggagcctgagtgtgcccagggagcattcttcccattggcctgggctgcctctgccatcatctggggtggccattggtaggtgggtgactttactgccagcatcaattctctcccatctcgcttctctttttttctttagagcctgaatatctttcaaaacctcaatcgtcgacagcatgagcatgccatccacatgatggacattgcaatcattgccacagacctcgccctgtatttcaagttggtatatcttctcattctaatagtaaaagcaacaatgattatatgtatgcatatatatatatacacacatatatatacatatatacacatatatatacacacatatatacatatatacacatatatacacacatatatatacatatatacacatatatacatatatacacatatatacatatatacacatatatacacatatatacatatatatacacatatatatacacatatatctacacatatatatgtgtgtgtgtatatatatatatatattttttttttttcttttttgagacaggatctcactctgttgcccaggctagagtgcggtggcaccatcacagctcactgcttcctgggctcaagggatcctcccacctcagcctcctgagtggctgggactacaggaacaccaccactcctggataattttttaatttgctgtaaagatgggttctcactatgttacccaggctgatctaaaactcctggtctcaagccatccttctgcctcagcctcccaaagtattgggattacaggcatgagccactgcacccagcaacaatataataacaataataataacaaacatcatagttccaattaatttagcatatactatgtgtcaggcacaacacgtgtgttatggacacattgattcttgctacaagcctgtgagttagatatcattacccccgctgtacagatgggaacactgagattcaggacaagagatttgctaagagtagataacaaatcagtggcagagacttaggttaaacctaggtcttcactcctgggccttggctctttcaaccttgttttgtgaattttgttgatttaataaggctccatctgaatcagccaatgttagcagctcaggtgttgccttattctaagacttgctccctttactagactgatatgttttgtaggaagaggacgatgttccaaaagatcgtggatcagtctaagacatatgagagtgaacaggagtggacacagtacatgatgctggagcagacacggaaggaaatcgttatgtgagttgggatggggttaaaacctgatcctcttaggcttaggatcatgaggcgagatgcactgacagctcttgctgccctcaacaagccttgggactatttcattttggaggccttcaacatatgaaaaaaatgaagttatgccaaattccaattgcacaagccacatgtttaatctttattttagcactaaaaatgcaagacagtgtattattgttttatttatctgaataaaaaaatatgttatttgaagtagttcaatcataatatctaagatttgggtggtaaactgatataacttttaagtttttgatacaacggaaagcactatagcaattaaggggtttttgttttgttttgttttttgttttgagacagagtctcgctctgtcgcccaggctggagtgtagtggtgcgatctcggcttactgcaacttccgcctcccaggttcaagcaattctcctgcctcagcctgcctagtagctgggattacagtcacccaccaccacgcccagctaatttttgtatttttagtcgagaccgggttttgccatgttgcctaggctggttttaaactcctgacctcaagtgatacacccacctctgtctctcaaagtgctgggattataggcgtgagccatcatgcccggcccgaattaaagtttgagtgatagttaatgtgttattcaaaacatataggcttaatttttaacgtattcctttacataggacaatatcccacaatatagctgtgctagtcacaaattggttatggttggtatgaaatttacagtgcatggtctggcatggttggtaatgggactcaaatttaagttgtctggtgaatgtcttttttcagttttctcagtgtgcttccatgattcacctcaattgacaatggggtgagaagtgtaaatttgaggccttttatgaatatgtggcccaagccaaatggtcccctggctcctctgtgatgggtcctgggcattgaaggcaatggtcaggaaaagttgcaggggagacaaggctgactagttgcctaggaagcattgggttatttgtttatccccagatgcttctgtggaaatgaggcttgattaagtcacaagcattgcaaatgtctgcaacagagaagaggagaccactgggacaggctccggaaacggggggggcagcagcaagttgccactccttcagccctgcagttgtccaaccaggcctcccacaaaggtcccctgattctgggagcagtgcaatctgctttcactgaacaagggggcatgctcagcccacagttactcatagactggccaggagctgcccccctggacattttatttatttatttatttatttatttatttatttatttatttttgagacagggtcttgctctattgcccaggctggagtgcagtggcgatcagggctcactgcagcctcaaccttccaggctcaagcaatcccctcacctcagcctccttagtagttgggactacaggcacacgcactatacctggctaatttttgtaattttggtagaaacaggttttgccatgttgcctaggctggttttgaactcctgagcttaagccatccaccctccttggcctcccaaagtgttgagattacaagtgtgagccaccacgtccagccacatttatttatttataatttcaacttttattatacattaaagaatgcatgggcaggtttgttacatgggtatattgtgtgacactgaggtttggggtacaaacgatcctcacgcaggtagtgagcatagcactcagtatgtggttttctggcccacactctcctccgtctccccttgtgtagtccccagtatctattgttgccatctttgtgtccatgtatatgtaatgtttatctcacacctgtaagtgagaatatgcagtatttggttttccattcttgtgttaatttgcttaagataatggcctccaacaccatccctgttgctgcaaaggctatgattttgttcttttttatggctgtgtagtattccatggcacgtatggaacacattttctttatctaatccaccgttgatgagcacctaggttgattccatgttttgctattgtgaatagtgctgtgatgaacatgttagggcatgtgtctttttggtagaactctttgttttcttttggatacacacccagtaatgagatgttgggtcgaatggtaattctacttgaagttctttgaggaaactccaaactgctttccacagtggctgaactagtttacattctcaccagcagtgcataaggattcctttttctccacagccttaccagcatctgttatgttttgatttttcttttcttttcttttttctgagacggtgtctcactctgtcacccaggctggagtacagcagcacgatctcggctcactgcaacctgcacctcctgggttcaagcaattctcgtgcctcagcctccacagtagctgggactacaggcacccgccaccattcccagctaaatttttttgtattttttggtagagacggggtttcaccatgttggctagattggtctcaaactcctgacctcaagtgatctgcctgtctcagccttccaaagtacccagccttcttttgactttttaataattgccattgtgactggtgccagacagtatctcattttggttatttatttattgacttttgcttgtgcttttctttttttgagatggagtctcgctctgttgcccaggatggaatgcaatctcggctcactgcaacttccacttcccgagttcaagggcttctcctgcctcagcctcctgagtagctgggattacaggcatgcgacaccatgcccggctaattttttttgtatttttagtagagacggggtttcatcatgttggtcaggctggtctcgaactcctgacctcgtgatccgcccacctcggcctcctaaaagtgctgggattacaggtgtgagccaccacccccagctgacttctgttttttcctaatgtttttctttttttgacttccatagctggacatttcaaaatggctcagcagaaggactaaatcattgaaaggaacaccctgctattggatagggggacttgatttagaaagttgtctattctccctaattttaatttattcatttaagggtgattccaaaacaaatcaagcaaccaaccaacaaacaaacaaaaaaaccctgctttattctgggggaattaggaagctgattgaaaaattcttatgagaaatgagtatgcaagaataaccagaaaaagaaaaaagataaaaaagaatagccagaaaattctgacatggaagagtaataatggtgaccagcagaactaaaggcagttctgtcctaggcaggagaagtcgttcagatcaatgggatgaacttaaggactatgtctgtgttcaaagtgggttttatactagtggagaaaggtgtaagttcatcagtggttttgggacaatgggatggccatgaagttagatctctatctcattccttataccaaaataaactccagatgtaataaaaatttttaaataaccagggaaagaaaagagagcacgaaaaaagcatggaagaattaaggaaatgtggcacatatacaccatggaatactatgcagccataaaaaatgttgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaaggtgcacatgtaccctaaaacttaaagtataataacaataataaaaaaaaaacctaaaaaaaaaaaatttcagagcgagcttttcaaaatgtgacatgaggctgggcacagtggctcatgcctgtaatcccaacactttgggaggctgaggcaggcggatcacctgaggtctgaagttggagaccagtctggccaacatggtgaaacgccatctctactaaaaatacaaaaattatctaggcgaggtagcaggcgcctgtaatcccagctacttgggaagctgaagcaggagagtggcttgaatgtgggaggtggaggttgctgtgagccgagactgcaccactgcactccagcctgggtgacagagcaagactccatctcaagatagatagataaataaataaataaataaaacaaaataaaataaacataaataaaatatgacatgaaaatcgtaagtcataaaattagatggagaaatctgactatgaaaaattaaggatttctgtacaacacacaaaaacacatagtctaaataggaaagtaagtgataagctggaggtaaatatttgcaccacttctaagagaaaaagagctaatttcctcagtgaataaagtgttaatatgattccaggaaaagactaatccaatagaaaatgggcaaaaggcacaaaccgacagttcccagaaaagttacagtgggatataaacctatgaaaagacggtgattataaaactacaatgaggtataattgttaactcctattgtcaaagatgaaaacatttgcttacatactgtgtcgggcagagtgagggaaagggccacctcgttccccatgcgggagtgtaaacaggctcagtctttgcagagggcgatttggcaacacctatcaaagctgtaagtgctcatgccctttgactcagcaatcccacttccaggatttcccctccagatattctcccacatgtgcaccaagtgtatgtacagaattgtttgttgcagcattgtctgtaacacaaacaggattgaaaacaatcgaaatacctagcaatggggaaccaggttaaataaacgataacactttcatacaatggaatatcttacagatttgcaaagaaatgacatcaaatgaaaggaattatgtttaattttaaaagaaaaaaaaaagccaggagcaggatctcaatcattgtcaaagtcaaggtgaccttacgtaggcatcttcagctgacggcacacatacccctctgggaactcatgtccttccaagatgtatatcagcatagatagccttaagggaatcagcattttcttttgtaatattaatcttcctgagaaagaagcagcccagtaggcacagcattctctcattcttccccaccttacaaaataaaggcaaactccattctttcttgaatcttcccacattgcattgtcgtagagacaaaaacctctgggcagccaaacggagggactatttgaaatacagtcatccctgggtatactcaggggatcggctccaggaccccctagtataccaaaattggtacaaactcaagtcctgcagtagccctgaaaaccccttggatgtgaagagtcggcccctccccacatgggttttgcatcctgcaatccatgttcagttgaaaaaaattcatgtgtaaatggacctgcatagttcaaacctgtgttgtttgagagtccaccatactggtggtgtcacagcctcttataattaaggcattataaatctaaggaaggggctgggcccggtggccatgcctgtaatcccagccctttgggaggccaaggcaggtggatcacttgaggtcaggagttcgagaccagtctggccgacatggggagtctccatctctactaaaaatacaaaaattagccaggcattgtggtgcgtgcctgtaatcccagctactcgggaggctgaggcaggagaattgcttgaacctgggaggcagaggttgcagtgagctaagattgcaccgctgcactccaacctgggtgacagagtgagactctttttaaattttttgtagagacaaataaaggtcttactatgttgcccaggctgatcttaaactcctgggttcaagccattcttacacctcggcctcccaaagtgctgggattacaggcatgaaccactggacccagactatttggacccagactatttgttcaagagtttttacaactttaattgccaggcactccccctgaaccccacccccattcccagccagtgggtggggttttataggggggcagcaggtgaaagatttttcatttaaatatcttacttctttcagaaaatgtatcactgtccagggaccatgacactagggcaaaggcacatcagtaatacgtactgaagatggtagcaactgatttaatccacttcactgtcttctttctatcatctgtctttacaattttttttctttcttttttatttggtcaatagtctctcaacagaatcatattatctatctatctatctatcatctatctatctatgtatctatctatctatctatcatctctcatcatctatcatcatctgtctgtctagtctacctacataccctccatgtacctttacctttcttagaattaaaaataaaagataagttggatgtattgtaacatgcttatttaaatttaaaaataggaactgggcatggtggggaggctgagacgggcagattgcctgagctcagaggttcaagaccagcctggggaacatggtgaaaccccatctctattaaaatacaaaaaacaattagcagggcatggtggcttgcacctgtaatcccagctactgtggaggctgaggcacaagaaccgcttgaaccggggaggcggagtttgcagtgagccggtatggaaccaccacactccagccgggccacagagtaagactctgtcctggaaaatttaaattatccaggtacggtggtgcacgctacttgggaggccgaagtgggaggattacttgagcccaggagtttcaggctacagctagctatgatcatgccactgcactgccctccagcctgggcaacagagagactctggttaaaaaaaaaaaaaaaaaaaaaagaggaaaaatgggcaaaaaataggtgctgaatccgactccagtctagtaacaagaaatattcattcataaaccaatactttttaaaaaatccaccctatattgttaatagatgaattcaaaaaagggtgctttgagtgtttaataattatttgtaaaaataggtagtatattttgttatttaattgtgtaataataacttaatccaaaagaaaatttttcaacacttagaggcttatggtcaaagaaaaaattttaattacataatttcaataaatggatataattgattgcaagtaattatgaaaatcgatcaatgaaagactttcaagcatatatgtagtgtacacacacacatatatatacagaaacacatatgcacatacatgtacacgtatatacacacaatattaggataaaattctgtggggaagtcaagtggaaatagaggtttacagagacaaggaaagatgtaaaactctagactcttaaagaaaagcttgctcatgtgcttttattgtgggtaaagaatgatgtaacaaatttattttaaaaagtcagtatggccaggcacagtggccacatgtgtaatcctagcactttgcaaagctgaggcgagaggatggcttgagctcaggggtttgaggccagcctgggcaacatagcgagaccttgtctctataaaaaataaaaatttccctgggtgtggtggcacgcacctgtggtcccaactactcaggaggctgaggtggagggactgcttgagcccgagaggttgaggctgcagcgagccctgacggtgccactacactccagcctgggtgacagagcgaggctcctccgactcaaaaaaaaaaaaaaaaatagtcagtatgtataatgtgctataaattagatcctttgaaaatattaaacttgtaatagtttaagatgtcaacttaaaaatgtgcaagaaggtagcacttttcaaaattctttaggtagggatttaacgaaaaatattgggagacctgtaatgcagcgtttctcagtctcagccctgttgacatttggggctggcaaccctgctgtggagctgttctgcgccttgagggatgcacaggattagacaccaggagcacccccacccctccccagctgtgacaatcaaaaatgtctccagacattgccaaatatcccctggggcaaaaattggcccagctgtttgctataaagccatctcggggcccattgcttaggtgtataattggaacttcttcacacctgggtagcatgtagctgttacacacttggggctttggtatcagacagcctgggttcaagtctcagctctttcatttattggtggtgtgacctcaagcaggtgacttactccctcacctcagtttcctcatctgctcagtgaggatcatggtggtgcctactttgtggaccatcatgggggctgagctggagtatgtggaatgcagtgcagcaggtagtggtgttcggtgcttcctgtggtataagaagacatatatgtttggtcttcgttcctggttcctgacagagatcctaaaacccttggaatttcctgagtgataggagcatcttttgttctgatgggatgactcttggcaggaccctagacagcttcaggctaggggctggtcaccagaaagaccaagccttcatttgaagcttggaactttcagccccatccccagcctccggggagggaagaggctggagattgagttaattgccagtggataatgatttaatcaatcatgcttctgtgattaaaaacaaaaaaagctccatacaaacctctaaacagcagggtttagagagcttctggtttggtgaatacttcgaggtggtggcacgcattccccctcccataactttgtctatgcatcacattcatttggctgtttctgagctgtaacctttataataaactagaaaatgtaagtaaagtgtttccctgagatttgtgagctcatctagcaaattactgaacccgaacgcagggacacatttcaactttgttgccaagtcagacagaagggtaggtaacttggggaccccatacatgtggctggcctctgaagtgaggcagtcttgtgggactgaaccctttaacctgtagaatgtgatgctaactataggaatttagtatcagagttgaaatgaattgtaagacacccagttggtgtcaggattgcttgttgtgaggaaaaacccaacactcccttcctgtgttttgattatcttggagtgcttatgtccacgggcttcctgtggtgggaggtccacaccaattgactttgacttttttcttcttctttttttttttttttagagacagggtcttgctctgttgctcagactgaagtgtggtggcatgatcatagctcactgtagcctcaacctcccaggctcaagtgatcctcctgcctcagcctcctaagtagctaggactacttcagtaattttaatctagggtcaagatattatagaaactctagagtgagggtgtgacttcctattcttcatcaaactcttgacatttccccttaattccagattttgcttctgacagtctgaccaaaccatgagttggaaaggctcacagatcctctagcactgcagtgtttgtgtatggctcatgagctaaggatggctattacatttctaaatggttgggggaaaaagtcaacagaataatatttcatggccaggcgtggtggctcacacctgtaatctcagcactttgggaggccaaggcgggcggatcacttgaggccaggagtttgagaccaacctggtcaacgtgatgaaaccctgtctctattgaaaatacaaaaattagctgggcgtggtgacgcacacctgtaatctcagctactcaggaggctgaggcaggagaatcgtttgaactccagaggtagaggaggtagtgagcctaaatcatgccactgcactccagcctgggaaacagagtgagactcggtctcaaaaaaaaaaaaaaaaagagtatctcatgacaaatgaaaatcataagaaattcaaacttcagtctccataaataaagctgtattcttttacagagggccacattctgactttcatgggtcctaggcacttttgtctttgtgcctccttcctccataaaagtaaataagtaaatacaaattatattttatgattgtgttggtatgaagacaaatataatccagactgaattcattcttacatattcattcctgttatgtccttttttcctgctcatcttgaaagaaattgaaatattttcatgggccctggagaatatcgtgggccctcggtgctctgttgaatggacgagctggccctgcttatccatgctgtgcttatctacggctgctctcacatcgcagtggcagagctcagtctttgcagtagggactatgtaggctgtaaaacgtcaaacatttactgtctggctctttacagaaagagtttgccaattcctggtctagtgttttacaagtgaggaaagtgaggcccagagagacaatgtgacttagctggcatcacgcaggcatttgtggagcatcaaggacttggactcagccacaccagcccttgcctgcacacccactgctttcttaggctcctccaaggccttccccggcagggtctcctgctgtaccctccagacacatgtaattccagggagggtctgagtaagtgtcctgaaagggctggctaagaggaaggctggaatgcttttcctgaaagttggccaggagtcaggaagaagtgccactgaaactcacagccaaggagccaaatgtttcaggaagaaacatttgccttggggatggtccaggcggataagagctcagcttgcttttgagagctctacacacgagggtgacccagaacgtgagtgagatgaatgcaggtgctgataatgaagatgaggacactgggtgcatttacaaaagcatcttatgtgatcatcacagtaagtcttaaaaaggatatattacattgacccataggaaactgctgaattttaactgatttggactaacaaaatcagaatttcataggatccaacctaacatgaatatctcattttacaaacgaacagactgggactcaaagacatgaagtcgcttgccctggacacagcaagtggggaggagatggaaggtctaattcagctctgtctgattccaaagccctgcatggaattttgcactgttgtcctattgaactccatcccctcctcttgacagttcgtctactgagagcataaggttcacatttctgagcatacaatatttttgtggcatactcttgcttctttctgcattataaccatgttgtcctttactctgttccatcctgacacctctctcttcctcactttgcaagtctaatctgtccccaaatgctgctgagttgacttcctaagtgccatatctgtctggacatttctctttattgccagctccatctcttgtccagatcctgcagtggcttcctaactgggttccctgtgtacgctcctgtcccttccacactgaagccacagtgatttctgtgaaatacaaatgtggccacgtcacccttctgttctaactcccatggcttttcctgttgctcgtagcatgaaaaccatcccctcgcagcggcgcctgggctctgcatgggccgcccctgctcctctgtggagcttctcttaccaggtctcccacctgctccctgagctcccccaacctttaagctctttgtgccgggcttccttctaccaggccctgcacactagatgatccttctgcctggaatgtgtttctcccactcccttctttagcaagtaaatggttacacatcctacagttatcagctccagaggcactctctcagggaagccctccctgacctcccagacctcagtcagtttctctttctcatgtcttctccaagaatggaagtcctttccttcagagcagttgtttgtttacatgttaacctgcatgtgtgggataaatgtgcaattccccagcacatctgcaagatctctgagagcatggaccatgtgagcccagcctcttcctagccagcagagaccactttccctgtgtgttcttctatggtgatgaagcccatgaccccacgatgggggctgcaaccttacgacctcatctaaacctcagcaccccacaaagaccctgtcttctaatagcatcatattaaaggttagggcttccacatataagactgggaagagacaaacattctgtccattacagagggctcctatgtacccctcaaggcctttgctccattgtcacctcttagatggcacctggactgagctagtcaccttcacttttgggttctttttttcttttcttttcttttctcttctcttctcttcctttctttcttctttctttctctttcttttcctttctttctttttctttctttctctttctttctctttctctttctttcttcttcttttttcaccttggacctttttctgccattctacttagcatattgtgatgacagtttttttttttttttttttttgccctgtgttccttgagtgactatgacctccctgcaggcccctctggatcccctgtgcccagcacagcacttgggaccccagtgcatataagggggaggtgctggagtgaatgtgaagcctcatctttagggcacaagtctcgaattggcttttctggcaccttggtgtccctccttcatcccatgcacacagcaaatctctgtctataaaattcttaggtgtgtttctgcaaccactgggaatgttttccacatgatccctccagctaaagaaagtaagcatccagtgccctcctgaagccaccagggagccagtgactcttatatgcatagctgagcatttatttgctcaacctatctgacagtaagtaaacatgtccacagcacttattaaagcacagggcatgtattctgaggttattataaagcataaaggtgtttctaagaaatgtatgcacttctgaaagcttacttaaagagctatttgaatttctgagggtttacataatttaaaatatgcagtggcatgatcatagctcactgtggcctcaaactcctgggttcaagcgatcccctcacctcagcctcccaaaatgctgggactacgggcacatgccaccacgcctggctaatctgtgtatttttcatagggacagggtctcactattttgcgcaggttaatcttgaactcctggcctcaagtgatcctccttcctcagcctcccaaagtgccaagattacaggtgtgagccactgtgccaggcccataattaaagattttatttaaacttgttaatattccatgagtaactcttacagcctcacagactggcttatagaaaatatgccccacacagctgattaattgtaaaattatccaagcagcaagttaggttcagagccccagccttctctcactcctccctctccccagttcctgcccattggtctcaccccgccgcagccagccgttgctgcagaccagctctcctgccctcctgctgaattactgcagcaccccatccccctccatcctgctcttttcttccttctccatcctactagtcctgccagctgccttcctgcagcacagctctgaagaggtcacaattgggcctttaaccttcaaccgttccccactgcttgctagatacagtctgcactccctggcatggaatttagggcccatgccacatggccctggattaccaggattacctgctctaaaatgttttctcaaatccaccccccttgctccctcctcttgctccagttctttgtccgtgtcccctccctttctattttctgttgtacccacctatgtaataatacctgccttgcctttctatgagtgggacactcccttaagagtttacctttgaactctttctacctactttctttacctgcacccttccactcctttttttttttttttttttgatatggagtctcgatctgtcgcccaggctagagtgcagtggtgtgatctcagctccctgcaacctccgcctcccgagttcaagcgattctcctgcctcagcctcccgcgtagctgggatcacaggtgcatgccatcatgcccagctaatttttgtatttttagtagagacagggtttcaccaagttggccaggctggtcttgaactccagactgcaagtgatccgcccacctcagcctcccaaagggctgggattactggcgtgagccacggcacctggccctttccaagccttaatgcaaggcctctttgctacagctgttcacagttctctttacaccatatgttttcttttttcttttttttaccttttaaattttttgggtgagagtttctgccaggtgaggaaatggcctagaagagaaagaaatctattagtattaaacaaaactcctaaatcagaaaagctaactgactgatagaaaaatggagtatattgcctccaatggagcaaaaagtgattcttgaggtaggagagcaaatcttagctattacaatggcctgtggttctccaaacagatggacagcatatctgtggtattaaaagctcatcgtggggcaattactgaaaaagtatctaaaaaggctcgttggcagttggggcagggaacaatgatgagaaaaaaagttgagaaacacttctctacagtagaaaagagcaaagggactctgaagatgtgatgagatttaaatgaaattgatgtttgtacagtccctggaacagtgcttgatacagaagaaaacccagtacatgttccttatgcatataccatgttcagacactatacttagatttctccaaccacaatctcatttaatcttatacctgttttgtgagtaaggtacgattatcattacagacagggaaatggaggctcagagaggttggtgtagttgcccagtgtccaacctctgatcactgacagaggcaggatctaaccctgtttgatttcaaagcccaacccctggatgcaatgggggtgagccctttcctcacaatgagacaaagtcacctactagtgggggtggagaaaggtgagagagatggaattaaccagtacatgaagtcttaaatggccctggactgatagagggtgtcctgtgtgcccagggccatgatgatgaccgcctgtgatctctcagccatcaccaaaccctgggaggtgcagagccaggtatgaactcctgctgacccaagaggaggggcatcccagtactgggggcatcaggtcatgaggcttggactctctcagcccagctccagaaccagctcacctgtgtcccatcctcctctaccaagacatgggaatcattttacgtctctccagtgatgacagcaaaagtgagggtggcagggcagggatgggtttatcctttttgttgatttggaattgcaagtggggtgggagcaggggtaggggattgggctggggctctgactctgcgtgtgtgagggtctgtctgttgcaggtagctctgctggtggctgctgaattctgggaacaaggtgacctggagcgcacggtgctgcaacagaatcccattgtgagtagacaggggatgtcagcctgatgttaggtgtgtgtgctccatcctgacctagatatgacctcgccatgatggagagatgtgtgactttaccataaagatgaccttttcctaatgcagtggttctaaaaatgtggtctccaggccactgtcaacctcattacttgagaacatgttaggtatgtatattcacaagcctcaccctaggtctacccaaccagaagctctgggggtgggcccctgcaatgaatgctctaactagtaagccctcctaaattttgggaaatgtgtccttagctcactcaaccctagaggttggcaagtggactccaacacttagattgccctttcaatttcaaaggtctagaagtccatccacctcccctgaccctaatctaacagcacagagtgagcaagttgtgcacctgtcaacattgaaagttaacttggctgagacagtcagccagcttcccatggagatgcgcagttggggagatcggaagagcagcccgaagtttccctgaagtccctgaaggcaaagctgggaagtaaagcagggtttggaaaggatgggtaaaagagagagacattgtggggacaaaccgttgacacctggataggctaaacctgtgagagtgtgctaaggatgcagaggtcaccacggcaggcttaggcaggagccgagagagagtagaaggctgggaggagcaggtcctgtcatgaagaaacacgtgaagggccccatgggctttgtcgttctcactctctctttgtaatattttcaaatatattgagaatagtcagtgaactctagtgcccatcagctacagccaacaattagcagcagtctgccattcttgttttatcaattccttccagtgcatttttttgcttttggttgcagtattttaaagtaaatctcagccactataatctcttccataaatactttagtacgtatctctatgagacaagagcttcatatggacaaaatcataaacacaaccataataccattaacacactcacaaaagtcatatacttcagtatcatctaatccccaatttctgttcatttttcttgattaagaaagagaattcagttgatttgttcaaatcaggatctaatcaaggagcatactgcctctggttttaatgtctcttaagtctcttttaatctgtagcaggccctgccatccctcccaccctctggcctttttctggtatgccatttatttgctgaagacagtgtgtctttttttttgtgcagtttcccacattctggatttggttggttacaccctcatggtgttctttaacatgtttctctattctcctatttcctgcaaaatgctcatcaggtctggaaacatgatgagtttacagtttgattttagtaagaatgcttcatagatagggtaggtttctcttactgtccagtgcaattaactctttctcccccatgacagcccatgatggacagaaacaaagcagatgaactccctaagcttcaagtcggcttcattgactttgtttgcaccttcgtctacaaggtaggcccttggcttcctcagccgcaacaagatgtctttgataaacctgggatttccagacaacagcaggaataataaaccctagcaggtgaccagtgggtgatactttacaaagcgcttctcatctctaatggcattcgattctcaggacagctctatgggtctcatgtgattgcagctccaggctccagcgtacggtacatcctagttgcttaatacataattgtggggcaaatgactaagcatggattcacagaggaaggggaaacatagtagacatatgtccttctaagttccctagctggtggaaacatcataggccaaaagtaattgtgaaaagataatctggactttctctttgagctcttattcaaagttggtctccctcttgagaaacccattgctcccaactttctgttaatctgtgccaccatccacctctgacttttaatttttattttggccatgttacacatgagaagacaaaagtcagagatgcaaagtgacagggccagtgtcactggacttagccataaggcaggatttagcccagttctctttatgctgtgtgagctgcagccctttgctaggaagaagtgcaaattttctagaaggcaacaagagcatctgagatacaactcagactaactggggtgctctgacccacgggacacagtggctgatgcttgccactatcatcagtaatatttcttttttttcattgaggacatgagttttttgctggttttttttttttctttgagacaggtctcattctgtcacccaggctggagtacagaggcaccatcatagcttacagcagccttgacctcccaggcccaaatgatcctcccacctcagccttctgagtagctgggaccacaggtgcacaccaccacatccagctaaattttttttttttttttttttgagacagaatctcactctgtcacccaggttggagtgcagtggtgcgatctcagctcactgcaacctctacctcccaggttcaagaaattctcctgcctcagtctcccaagcagctgggacttcaggcatgtgccaccacaccgggctaatttttgtatttttagtagagacggggttttgccttgttggccaggatggtctcaaactcctggcctcaaacgatccacccgcctcggcctcccaaagtgctgggattacaggcgtgagccatggtgcccagctgagggaatgagttttaatcatcaggaatattattaaataagggagactgggctaagtgctttatatatgttatcaaaaccacactgtggggtaggtattattactgtcctgatttaatggctgaaggtaagctctggtagtgacccgcccaagatcgcagtttgtggcagagcctggaccggaacccaggcatctctgaacacagtcggctctggcacttcacagcgggccgtggatttgctgttcttatattgggcaaatccactccatcaatctgcatctcaatttccttacctaaagatgtagaagtgatgaatcttattttcctacctcacaggaatttgaggaccagaggagataaattgctcataaagtataatgtgctatgctcaaagagctgtaagagcctttaagaatcatcttctaggtggctcatgcctgtaatcccagcactttgggaggccaaggcaggtggatcatttgaggtcaggagttcgagaccagcctgaccaaaatggtgaaaccccatctctactaaatccaaaaaaacaaattagctgggttggtggtgcatgcctgtaatcccagctacttgggaggctgaggcaggagaatcacttgaacctgggaggcggaggttgcagtgagccgagattgcaccactgcactctagcctggtcaacagagcaaaactcagtttcaaaaaaaaaaaaatcatcttctcaacatcccgatttcactcagaaaatatttactgagtatccttgtgtcccagaccttgtgctaggccagggccaccccagggaatgaggctgccaatgtccctgccctctccaggttctcagcctctcggggagacaagcaaagggagtcatgacaaggaagcaagatgtggtaagagagggctttgggagcttccaatgggggactccactagggggccagaagaggcttcttggaggaagtgacatataagtggaggcctcaaggaagaaaacgggaggttagagtgttccagcaaagtgaacagcttgggttgagcatggtggctcatgcctgtaatcccagcactttgagaagccaaggcagaagaatcacttgaggccaggagcttgagaccagcctaggcaacatagggagaccctgtatctacaaaaataaaaaaaattacctgggtgtggtggcatgagcctgtagttccagctacttgggaggctgaggtgggaggatgggttgagcccaggagtttgaggctgcagtgagctatgtttgtgccactgcactccagcctggatgacagtgaggccctgtcttggaaagaaaaaaaaaagaaaagagcagcttgtgtgaggctcacagaatggaggacacactccaggaactaagagatttggattgcttggagaatgcaagatggtcaagggcaggaggacactgggtcatggagtttgaaagccatagtaaggggttttcacttcatgctgaaggacaggggcgccacaggaggcttctaagcaggtgaggcatgggctggtgtagaccggaggccctgcagtatcagcacggtggcgggaggcctgctactccgaagcagctcattccagtgttggacgtttccagctgtgccacccgcttgagcccagaccctgtggcctggcccttgcaccagaggcacatactctctcttctaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcaggtttgtggaagggggaagcagggactcccaccaccccactccctgagcactcagtgtctgcgtcctgcctcagagactcttacacggagtctcattcaggcctcctgatggccaatactgtccccattctgtgtgtgagagcaccaaggctggaagagaccaagtcacacagtaagagacagagcccggttcccaagattgaggctgaggaacgatccaggcctcccagcaagtgccccggcaaccaacatagcacagactctgattttagggctgtggacatatgtccctaccctgggacaaaggagaagatctataattattggttggaaggaattttatttttatttatttattttttgagccggagtctcactctgtctcccaggctggagagcagtggcacgatctccactcactgcaacctctacctcccaggttcaagcaattcttccgcctcagcttcctgagtagctgggattacaggcacccagtgccatgcctggctaatttttgtattttagtagagatggcgtttcaccatgttggccaggctggtctcgaactcctgacctcaggtgatccacccgcctcggcctctcaaagtgttgggattacaggcataagccaccgcgtccggacttggaaggaatttgaggccctatttccagccttctgtctgatgtttgaatcctatctataccatcatgagcttatgcttgtataccaccagtgacagaggtctcactatcttatatgacatcctcattcagtaccactattagaaaggtcttcctagaactcaaattgttccttgttgaagcttccacttagtggtcatggttctgccttcagaatcaaatgggatttgtttgttctaactctttactactgacagcactgcccctcccccaagtcatttcttttactgattgtgtgatctgtttcctcacaggacatggcatcttgtccctccctcaccctgactgccctcctttgcacacccatccctcttcacccatggctcttacacatggaaaatgtcagggcctcagctctgctctgggcagcgtgggttgattctaaatgggcagctgcaaatgtaggggccacttagagttttgtagtttatgctttgcacaactccggggagtgtcctgtacatcacagatgtgtatagctattttgattttccagaaaaatggcagtgaggtatcctgggaaataagtgcatttttctaatttgtacaaattgtcttttgggcaagtagtaaatcagtgcaaatttgtggccttcagataaaaaaatacagatttggcttacatttttttctccttcttttttttcttatagctagagaatcagtaccaacatttttttaaatgtgaatttttgggccacattttaaaattggaatatttaagatttaaaaaatccagatttacagcctctttttctttcttttttggagatagagtcttgctttgttgcccaggctggagcgcagtggcacgatcatagctcactgcagcctcaaattcccggcctcaagcgatcctcccacctcagcttccctagcagctgggacttcaggtgtatgcaaccatgcctggccaatttttgtatttttttgtagaaaccaggtcttgctatgttgcccaggttggcctccaactcttgggctcaagtgattttcctgcctcagcctcctgaagtgttgggattacaggcgtgagccctgtgcctggcccagcttttctttctaaaagagtaaaaaggtaagatctggccacaccagtctatcatttttgcatgacaacaattggctgaagccgagtggcaactgccccctttagatgagacagaggctgtctctagtttgtcatgttcacagctcccctggtctcccagacgttggtgccgagtactggttctcacttatcatcatcctcgtgctgctatttttcttagagaaatgttctgtttccgtgattctcctcacacctggtttgccttctgcatgtgttgttatctgttggccactgaaagcctttgagtttgcaactcttggtccaaattaggtcaaaggggaagcccactgcagcctcttgtcacctggtgtgttctttttcctgtttcattgcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagatcccaatatcaagattttgctacatgcatttcgtctgtcctttttacattttcttttcaattttttttcttacctgaagtgtttaaaggcaaatcctggccaggcgtggtggctcacacctgtaatcccagcacttcaggaggctgaggtgggcagactgcatgagcccaggagtctgagaccaacctgggcaaaatggcaaaaccctgtctctacaaaaaatacaaaaattagcactcacctgtagtctcagctacctgggaggcagaggtgagaggatctcttgaacccaggaggcggaagttgcagtgagctgagatcatgctactgcactccagcttgggcgaccgagcgagactctgactcaaacaaaagcaaaagaaaaggcaaatcccaaacatatcatttcacacctctactatctcatctttaaagaaataagtatgttttctaacataaccacatcactggcccatgcaaccaatgcctgcctaatacccagctgtgatctatgctttgatgggctgcacagaccccaagcttcagcaaaggacttgggaccccaccagctttgagtgctgttgacagacccttagtatcaaccccatcaggtgttactgcagccttccccagggtggcctacacccaatgactgatccatgccaggtggagaggcctggccatcttggctgagcatgggataactgtgcagggctgttccagctccacgactcctcgtggggtccactaaggctgtcgctgggctcacatcccaactcgacttctccctctgcccactcctatttccttcccttccccaagcatcggtccccagggcactgcttaataagcatcctgcagactaagtccattttagagtctgctttctgggacacccaacttgtgatgccagcccttaatcaaccttccttcattctcatgaacgttttcaatggttggcttgcctgaatctgatccaaacaaattcacatattgaatttagttgtttctttttgttggtttttagaaaaaagaagatgtactttttattcttggatttttcattgatttcacagagtataaattaagtcagattattctcaattccagaacttctgtttcttaaattagcaggcattctgttggtttaaaaagatagatgttggccgggcgcggtggctcacgcctgtaattccagcactttgggaggccaaggtgggtggatcacctgaggtcaggagttcaagaccagcctggccaacatggtgaaaccccatctctactaaaaatacaaaaattagctgggtgtggtggtgtgcacctgtaatcccagctactcaggaggctgaggcaggagaatcgcttgaacctgggaggcgaaggttgcagtgagctgagatcatgccactgcactccagcctgggcaacaagagcaagactccgtctcaaaaaaaaaaaaaaaaaaaaaaaaaaagatgtggcagatagaatttctctctttctctatctttcatgacgaggtctcactctgtcgcccaggctggagtgcagtggtatgaccatagctcactggagccccagctgcccgggctcaagcaatcctccatctcagcttaccaagcagcggtgaccaca

SEQ ID NO: 14949 - DNA, 14330 bp, Human
atggaaccagttttggacccaaagaaggaaaggctctaactattcaataatagaatggtttactttttggaaatagtgggtgcctttttcctggaagtagaggttttcaggaatgttagagaatttctccatgggctgggaagttggcatagataaaataaaatagccattttcattctaagggctttctttttcctttgtggattcttttttgttgttgttttcacgtaagtatttcagttttctcatttttctacagtgaacatagaattcttaagcatttcttttttcttttttcagaagcaaacaatgcatattgcctactctttcctctacccccaattgtgtgtgtgtttttttttgttttttttttttttttgagagagtctcactctgtcgcccaggctggagtgcagtggcatgaattccactcattggagcctccacctcccgggttcaagcaattctcctgcctcagcctcccaagtagctggaattacaggcgtgagccaccatgcccagctaatttttgcatttttagtagagatggggttttgccaagttggccaggctggtcttgaactccggacctcaggtgatccgcctgccttggcctcccacagtgctgggattataggcgtcagccactgtgcccatccccaattgtcttgaaagacctttcttttcagcaaggaatactttttccatcccttattcctgtcattagtgccatttcaccaagtctgagggatacccatgggatcatatttacctctttttgttaaaataagcaattttattcatcattgatacgctgtgcattttatagtttttcttacctacttcgtttggagaactgttttattgtttttttttgtttgtttttgtttcttttgagatggaatctcactctgtcgcccaggctgggggtacagtggcaccatcttggctcactgcaacctccgcctcccaggttcaagcaattcttctacctcagccccccgagtagctgggattacaggctcgcaccaccatgtccagctaattattgtatttttagcagggattgggtatcaccatgttggccaggctggtctccaaactcctgacctcaagtcattcgcccacctcagcctcccaaagtgttgggattacagatgggagccacatgcccagccctctttactctttaaactaatatgtaatcagcctggagcacatcattataataatatatgctaaataaaagcattctttggtgtaatagtttaagtgtctggtagattattgtaattttttttttttttgaggcagactctcactctgtcgcccaggctggagtgcagtggcgcgacctcgactcactgcaacctccgcctccggaattcaagcgatcctcctgcctcagcctcccaagtagctgggattacaggcgcctgccaccatgcccagctaatttttgtatttttagtagagacagggtttcaccatattggccagcctggtctcaaactcctgaccttgtgatccgctggtctcggcctcccaaaatgctgggattacaggtgtgagccaccatgactggcccgattattataacttttacctgagattgaaaaagttttaggaatttctttttgtggccgggcatggtggcacatgcctgtaatcccagcactttgggaagaggagatgagtggatctcttgaagccagagagatcaagaccagcctggccgaacatggtgaaaccccgtgtctactgaaaatacaaaaattagctgggtgtggtggctcacacttctggtctcagctacttgggaggctggggcacaagactctcttaagccagggaagcagaggttgcagtgagccatgatggcgccactgtactccagcctgggtgacaaagcaagatcttgtctcaaaaaaaaaaaaaaaaaaaaaattatttttgtgaagtcattcacattaccaatgtttaatagagttctggtttttttacagaaaaattttgaaagacttatcttctgaagatacacggggcagaaaaggagacggagaaaattctggagtttctgctgctgtcacttctatgtctgttccaactcccatctatcagactagcagcggacagtacagtatgtataggaatcagtttccacattataaacacacaaaacctgacttttctgtagaaagaaatggtgttaggaaaactgtaatactttgatagtgatgattattaaaggatgttttcagccaggaataatgcgaagtactgtttcagcattatttactccttataacaactttgtgacataggcaattatcaatgtatgagggaactgagacctacaacattagatactgttttgttttgttttgttttgttttgttttgagacagagtctcgctcttgttgcccaggccggagtgcagtggcacaatcttggctcactgcaacctctgccttcccgattcaagtgattctcctgcctcagcctccggagtagctgggattacaggcgtgtgccaccacgcccggctaatttttgtatttttagtagagaggaggtttcaccatattggccaggctggtctcgaactttgacctcaggtgatccgtccaccttggcctcccaaagtgctgggattatagacatgagccactgcgcctggccttattttgttcattcttatatctatgtagttccgtacataattgctgtatattatattagtataattcctttcagaacattcctggcttttttttttttttttgaggtggagtttcgctctgttgcccagattagagtgcagtgccatgatctcggctcactgcaacttccacctcccgggttcaagtgattctcctgcctcagcctcccaagtagctgggattacaggcgtgcaccacttcgcttggctaatttttgcatttttagtagagacggggtttcaccatgttggccaggctggtctcaaactcctcctgacctgaagtgattcacccaccttggcctcccaaagtgctgggattacaggcgtgagccaccacgcctggcccctgcctattcgttaaaaatatttattgtttgatttatatacagtaaaattcactctttggggagtttaagtctatgagttttgacaaatgtgtagaatagtataacaccgccaatcaagattgagttctgtcaccctaacgaatttacttgtgctgcccatttgttatctccccctccactcctaacattaatctgtttcattcagtcttgccacaaaatatatgtcccatctgaccacctcttgccgtctccaaccaccaccgccttggtttaggctctcatcttaattactgaagtaggcatccagttggtcatcttgcttccattcttgctctaataatcagttttccatactgtggccaaagtgatttatttaagatgtcaactagatcacatcgctcctgcccaaaatcctctagtgacattttatcacacttagaataaaatccggatcttacaaggcattacatttaggatctgcctaccactctgacctcatctcctgccacttggtggcattctgaccaccccagacttccttactgtacctcagacacacgagcttgtttctgcctcaggatctctggagttgtcattgctcatgcctggcatgttcttcccccagatccttatgtggctactctgcttaagtgtcacctccacaaagagaccactctcttcaaatatgtggctcctccctttagtttcccttaacctcctatatttttctttatagcatttacatataactaagtcagtacatattagtttaattatagattgtatgtatgtaattatagattagcttattcatgatctgttttccccactagaatataagatccttaagggaaagaaccttttgtttcattcacaactacatccttgacatataggacctggcatatagtaggctttcagttgtttgttatgaattaattaaataatatatatatagaatacctcttgagaaactgggggccaggcactgtagttcatgcccgtaatctcagtacgttgagaggctgaggctggaggattgcttgaagccacattcaggaccagccttggcaacatagcaagactgtgtcttcacagaaaaatgaagaaaaaaaaaaaaaaaaaaagccgggcatcatggcatgtgactagtcccatctactcgggaggctgaaatgggatctcttgagtctgggagttcgaagttaccgtgaaccgtgatcgtaccaccgcactccagcctgggcaatagagcaagaccagtctcagaaaaagaagaaagaaagaaagaaactgggagcagtggttgcaaggaaagaagcttgggagcagagatcagaggtagtggggaggttcacatgttatcactgaaataagtgtagtacaaactagtatttagggcaacataggccaatagaacttcgtatgataatgggaatgtttatatctgcattgtcccagaatagtagccactaaaccatgtgtgactgttgagtgcttgaaatatggctggtgggactgagaaactgaaattttaattttgtttaattttagttaatttaaatagccacatggagctaataccctatcagacagctcagttttagaataaatacagcacattaacaggtaaatacacatgttaagaacaggaagatatgttgcaaaaatgaaaatatgtattcacacatatttaatatcaaaacatttgcatctacaggtatgtattttgatatattaggttggtgtaaaagaaattgcagttttcaccactgaacataatggcaaaagtatataagtctgtataagcacaggaaaataatgggaaggatgtgcaccaaaaacaataattatctcaggatggcggtaaaagggggaaaatgaaatagagatagataatgggacctttaattttatttatgttgatacttatataaataaatgtgtatgtgtatatatgtatataataatgtgttgcagggaagaagattgaaactaattgctaatataacttcacagcaaatctcagcctggcgtgttggatcacgcctgtaatccctgcactttgggaggccaaagtgggaggatcacttgatttcaagaccagactgggcaatatagggagaccctatctctataaaaaatttaaaaattagctgagcatgtccgtgtgcatctatagttccagctacttgggaggctgaggtaggaggattgcttgagcccaggaggtagagtgcagtggtgaaccaggaccacaccactgcactccagcctgggtgacaagtgagaccctgtctcaaaaaaaatagccaacatatccctgtatctaacatttaaaaaaatattttgaaactcataaattaaagttggggcagttggggagggataattatgaatgcgtgaaaaaaaatatttttccatcacacacatatacatatacatgtattttggcttcctggtagccaaagcataaaaggaaaaaaaaatgtttcataactgtaatctgaaaagagggtacagagatgaggcattcgattctgaagagtatatgggaattgaataatgctaaaatgttttctatttgatcatgccttatgggcatttaagggctgaggagaaagcatgaacacaggtataattcagtgaaaaaatgtttgtggggagctaagtagtattttctacacagtggctttctgctatctttattagtgattttcactaggaagtaaatgaatagattacatttcttaactatcacttaagtaaatatcttaataacatgtaatacatttaacagtggtaccactagaaaatgaagctaagaaaccatataaagatgacttattttctcattatataaccttttattctattgaattttttccataagcatgttatctattcagaaatattttaaagtaataatatttttaatgcttttgactcaaaattacaaactatgtttatgtttcctttttattttttcttaaaaattaactatcatggggccaagtgcagtggctcatgcctgtaatcccagcactttgggaggctgaggcgggtgaatcacctggggtcaggaatttgagaccagcctggccaacacggagaagctccgtctctactaaaaatataaaaatcagctgggcatggtggcgcacacctgtaatcccagctccttgggaggctgaggcacaagaatggcttgaacccaggaggcagaggttgcagccagccgagatcgtgccactgcactccagcctgggcggtagagcgagactccatctcaaaaaagaaaaaaaaaaagaaatgctgttttattccttttacatgtagttcacctaaagtaaagtagtctgcagttaccaagtagaagtgcattcatacctgttttagtaaatagtgtttgtgggctttttgccactcctttgaattagtgtattatataaccttacaatagctattttctctttttgattaaagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaagtaagtatgctttctgtctacagaaagtctcctaacactgtcagagacacttactaactaactcattcactcttgtttaccatctagctgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacaggtaggtagtaaaatcgtagtaccagaatgggtaatgtttttacaaatctcacaacataaccagatgttaactggaactgtatacagtcatgggctgcatgacaatgtttaagtaaacaatggaccacataaatgaatgacggtggtcccataaaattataatggagctaaaaagtcctgtgctaatgtcatagtgcaacacattactcacgtttgtggcaatgctggtataaacaaacctattgtgctgccaatcatataaaagtgtagcacatgcaattatgtatagaacataatacttgatactataataagttaatatgttactggtttatgaatttactatacttttaatcattattttaaagtgtataccttctactttttttttttttttttttaaagttaactgtaggccaggcatggtggctcacgcctgtaatcccagctgaggcgggcagatcacgaggtcaggagatcgagaccatcctggctaacgtggtgaaactccatctctactgaaaatacaaaaaaattagctgggcgtggtggcgggcgcctgtagtcccagctacccgggaggctgaggcaggagaatggcatgaatctgggagccgaagcttgcagtaagctgagattgcgccactgcactccagcctgggcaacagagtgagactctgtctcaaaaaaaaaaatttttttaactgtaaaacagcctcaaggcagcccctacaggaggtattccagaagaaggcattgttatcataggagataacagctccctgtgtgttattgcccctaaagaccttccagtgggataaggtatggaggtggaagacaatgatattgatgatcctgaccctaggctagttagcctaggctaatgttggtgttggtgtcttaatttttaacaaaaaagttcaaaaagtagaaaagttatatttggtttttgtgatttttttttttaagacaaggtctcactgtgtcacccacactggagtgcagtggcacaatcttggcttactgcaacctctgcctccagggctcaagtgatcctcccagctcggcctcccaagtagctgagactacagatgtataccaccacacccagctaattttttttttttttcttgtagaggtggggttttgccatgttgcttaggctggtctcagacctgggctcaagtgatccatccacctgcctcagcctcccaaagtgctgggattacaggcatgaaccactgcacccagcccccaaaaatttaaaattagctagtacaaccactatgaaaaccagtatggagacttctcaaaaaacgaaaaatagaaatctacccaaaggaaaagaaatcaatatatcagagggatacctgtactcataagtttacttgcagcactattcacgcacaatagctaatagaatcaactatgtgtccatcagtggataaatggataagaaagaattaaatcatgtcatttgcagcaacatggatggaattgaaggtcagtatcttaagtgaaataagccaggcacaaaaagaaaaaatatcacattctcacttatatgtgggagctaaaatatttgaacacatggaagtagagagtggaaaaatagggctgggcgtggtggcttatgcctgtaatcccagcactttgggaggccgaggcgggaggatcacttgagcctaggagttcaatgcaagcctgggcaacatacccattgctacaaaagataaaaaattagccaggcatggtggcgtgtgcctaaaatcccagctactcgggaggctgaggtgggaggattgcttgagcccagggggttgaggcagcatgatcgcaccactgcacttcagcctgggcaacagagcaagaccctatctcaagaaaaaagagagaatggaaaaataggtaacagagactgggaacggtgaggggcaaggaggaggatgaagagagttaaagggtacaaacccatacacagtaagataaaaggaataaattcagtgtttcatagcagagtaggatgaccacccttaacaaaaacctattaatactcaggtgatggacaccctgaatcccctgacttgatcgctacacattatatacatgtaacagattttctcatgtgctccataaatatgcacagaaacattttaatggaaaaaaccatacaggccaggcgtggtggctcacacgtgtaatcccagcattttcggaggccaaggcaggaggatcacttgagcccaggagtttgagaccagcctgggcaatatagggagaccccatctctaaaaaaaatttaaaacattagctagatgtggtagaggcaggagaatcacttgaacctggaggcagaggttgcagtgagccatgatcacgccattgtacttcagcctgggcaacagagcaagactcttgtctcaaaaataaaacaaacaaaaaaaaacacacaagtagttaataatcatataaaagactactcagccttattagtaatcaaagaaatacacattaatgctacacatttagataccctttatacccacccaattggcaaaaattttaaagtctaaccaagagttggcaaggatttggaacaatggtcaggaattcatagatactactataggagtgtaaattgatgcagccattttggaaattaggccttatcttgtacagttgacgtgggtatactctgtgacccagctgttttagtctgtgtgactgagaggaacttggaggaagtatgtataagaattttcatagcagcaaaaaatcaggaaacaacctcaagattcattgataacagaataggtacatattgagcctaaacataaaaatggggggaaaaaagaataggtacataaattgtgactgtatttatagaatggaatgtttatttgtaatgactgaatgaataatcatttcaacatgaataaatcttagaaaaattgaatgaaaaaacaagttgcaacagaatacacaaagtatgatattttataattttagaaaataaatgatagcagttttagggtcatatacgtatatactacaactataaaaataagaaatgagatgtcacgtagcaaaaattataaagtggtaatactgtctgtcattgggcatataaggaaaagggtacctcacatacattactgagggaagtacggagttttatggtatctacttgccccaacatttctacttgtatgtgacaaaagataccataaagaaacttaaaaataagtctgttaactgggaaaaatatttgcaacttttatataaagagaaagaattacgagatgtataggttatataaagatttatttctgtaaataagagacctaacagaaggaaaccggtctgtgaaagatggccttgtaaacatgaaattattccaaactttgtgcataatgagggaaatgttaaagcagtgaggttcgctttttgtcagccgctagactgacaaccattttaaaatgttcataacaggcactctcatgtactgcccctgggaatgtaaatggtacaaatactctggaggacattctggcattttttcccttttttctttctggtttgactctgggatttttttccttccttttttccccccttatttctctgtacttcaatgaatataaattggcactatctcttgactttaagtgaatatagcttgtgatccttcaagaaatacatgtgtagaaatacacgtaaagaatggaggctgagtgggtggctcatgcccataatcccgacaccgtgaccaggagtgagaccagcctaggcaacatactgagacctcatctctacaaaaataaaattagctggtgtggtggtgtacacctgtagtcccagctacttgagaggctgaagtggggatatcttgagtccaggaggtcaaggttgcaatgagctgtgattgtgccactgcactcagcctggttgacagagtgagaccctgtctcaaaacaaaagaagaaaaaagaaaaagaatgtttactggaaaccacttaaaacaaacaaacaaacagagcttaaaggtaaaaataaagtctttttgtgaggggaaagattttgtacagtccttttaaagatgtgtactaaaaagcaagttgcaaatagtatctacatatatagcataaaaatcttaaaatagtactgtttctttctttctttctttttctgagacagagtcttgctctgttgcccagggtggagtgcagtggcgcgatcttggctcactgcaacctccacctcccagcttcaagtgatcctcctgggtcagactcccaagtagctgggattacaggcatgtgccaccacagctaatttttgtatttttagtagagatgaggttttgccatgttggccaggctggtctcgaactcctgacctcaggtgatctgcccgccttggcctcttaaagtgctgggattacaggcatgagccaccatgcctggccaatacttccgatttctatatgtatataaacttacatatgacttcacagaaatgttttaagaggacatgcacagaactgagtatttgctcaagcattgtttgtaatttgaacttaaataaaagaagtcatgtgtcagaagttaaccagaggacccataatttcactctttggtatttattcaagagaaatgaaacctttctacaaaaagactggcacaaaaacatgcctatgcagctaaccctagaaacatcgcaagagactggatacacaaatggtggttatattcatacagtgaactatgtccagcagtgtgaaggaacaaacccccatgcagcaacatggatgaacctcagatgggctgagtgaagggacaccagagtacatagtgtatgacactcttacatgaggttctagaataggaaaaaaactaatctctggtgataaaaatcaaaacgatagttgcttggaagggggctgaccaggaaggggcatgagggaactttctgggacagtgggaatgttctgttgtcttgacagaggtgtgggttatacaggtatacacaattgccaaaactgactgaattctacacttaagatctatgtattctctgtgtgtagatgatactttaaagagaaaaaaaggtgaccacggaaaattactgaagaacatttaccatttaaagaatgtgaagttttttctaacattgtttttttaatgctcatatttagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgattctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtctactgaatgtaaaatataatgcttggtatatgaatgataagcttgctcctggccatgctgttaattatcctaatgctacgtagaaatcttcacttaactgatacatttgtgtttgaccctcctgatgaaatttctcattagaagggtcttttaaaatgggactctgttgacttggcagcactttatgaaaagaaaaaaaagtttgatcgccagggggattacttatatcacttactaccttgtgtaaagccagaatctcaaactggtggcccgttaggcctaagaatatgaggaggtatgaggtcactgggttatgtcaaaagactttttcaacagataatatattattgggtagacaccgtgcttgtttacaacagaggtagcctagctcttagtgccttaacagctggacatctgcaaatatttgtaaactctgctgccttcagacttctggtgtagggccttgctaactagacccagttacttactctagctgtatgaaacaggtcagggcaaaccattaatggttccataaatgcataacaaattattttcctgggtgtttttctaattggaatccaatgtggggcttatcaaatttttaagtgattatagtccaaacatgaaattagacttccaaaatgcaaaagactaa

SEQ ID NO: 14950 - DNA, 24984 bp, Human
  misc_feature (1)...(24984): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacctcacatctttgttggttcatgggtctcagccctttcctatcatcccaaagagcctgaaattgttacattttgctttataaattcctttcttaagtattgtcagtttcaaaaaaaaaaacccaaaaaacgattgtctgcctgtaatagcaggtgtgagagaaaatgaggtgcctggagcatatttctctctggcaatggggtagagggcctgacatcatggggcctttaatggtagccccccagcttcatgttccctcacctttctggagaggagggcttgggaaaggcacatggagatagggtggagctgggggaaaacaggccttgtacaaaagctgagtagccagatgttcacttttacagctcttctgtaaaactggcagggcagatatagattaaaacgaaggacaaactccatttaaagtgcattacagctcaggaaccagcaccccctgggcaggagaagggagggaagggcacagaggccacatcagtctccttccttatctagggccacatgtctctctcctagctttgccaagggtgatttacacccccagctggaatgactctctttctgggctgattacatcggcaaatgccccccagaggccacagcaggatggccatattcagaagcagcagccaataaatctcagaggtttatattgcgattctcagtactccctgctggccctctgccaggctggctgtggaagtaaggagggggtcaagttagagggttaggggatgaaaccctccacttcctttcatcaccctcttctccttctctctttctatgcgctgcttagttctcattcttccaagccattctgcttctggctttatcctgggatcttgtgggaatcaggcccaggcccaataaatacccttatccttatgggtagacgtcctgtgttctgggcacagatgtgtttctacctagttgtttaatcctgatagagtagcttgctctccgaaagtctcatcatgtgaaaaggatgggctcctaaatggtctctccaggcaccttcctcagtgagctttggtccaaggaaatctctgctatttagtggagagtttaatcttccatcttccctcacgacaccatcggggctgaattttggaatctaatgccccaggtctgctcccccagcaaagccattccacctgtctgcgacccatctttgcagcatcttgagcttaataaccacccaatcttaccctagaagacacttaggagaggaaaaaacgagatcatagatgtgcaaattctaagaaaaatactagaaatgcaagtgcccttgtgttggcttgttcaagttttgttacaaaatctcttttgtggtggtgtctgttctttgatgtgtgggtgagtgggatccagaaagtgagaaagggtgcttttcttggagaaatatttggttctcctagatggcgagtttccagcggcagcttccacaatgtcttgctagtcgaacttgtcagacagcaggtgggccgcctcggaaagagcaacctcttccgcaccaagcccggcggctcccggggcgccggccctcccccgcccccacccccgcggtccctcggaccagcgctggaggcgcgtggtgtggacgcgcgcttcggagttggagggcggcgcccaggaccctggtgggagagtgtgtgcgtcgcgctggagggcgggaggcgggggcgggaggtgccggtcgagggagccccgctctcagagctccaggggaggagcgaggggagcgcggagcccggcgcctacagctcgccatggtgcgccccctgaacccgcgaccgctgccgcccgtagtcctgatgttgctgctgctgctgccgccgtcgccgctgcctctcgcagccggtgagtgtcagagcgcgcaccggccgggggtacagtgggagggggaggtgaggtgtaggcgaggcccggggcacctgtccggagagggcgcagcagcctcccggtgcatccgagccgaacaaggggaactggagcaggaagcccagggtgcctgcaaggggctggggtcacacctaacacagtgtacgaactgagatagactgagtgccagcaatggcctggccacccaagcatctcctcctcgcccctttttcccccctcttccctcttttgaggtaggtctacacagtcacagaacaacccacagccaggtcactaccaagacagcgtctctaagaggcggggagaatcagatcagaaacagagtgtcatttgctccacgtgggctttaactcttccatctgctttaaggactgaggaagaaactaggtacaggtgaagaaaaagaagttcgttaaaactgacttgtttcataaccttctacaatagcaggccttgcaagccgtctagcacagtggcttgccccttggataataaataatccacaatagatgttttgtagatgtagttcaaggcctggttttagaaccaggccactcccccaaggaagaacagcctgggatccgagatccctggaaggcccatggccttcgtgagtggtatgggtgtgtggaatcttattatgcggctcctgcccagagactgaatggagggactcctgagacagagagaccaccacactgccctgagacctcagtccacaacgcagtgctgtagaaatgctgccttgagacagatatggaaggaaggaggaaaaaccctggtctgtccacctgccaacatcagtaagtcagggcagcaagacatcaccagtctgatttgactgcccaggaaatttcactaatcctaaaggttatggctgcatgtcaggatcaggggaaaacattaaacacctttctcattaaatggtttaatgaagcagtgttggtgacagatctattttccacagtaatacttgacagcaatgacatctggttaagtagcctcattgaaaatccataaaacagtcatctaggaggtaccatgtagagccaagtgctcttcaagagcacagaccaacagagggctttgggggtggaaaatatcattgctcagggcctgctaaagccaagcatataggagacctccgattcatggggaagtggtgtcatgtactgaaaatcattctgaagtggataggaggctggagtcctgggttctagccttgactcggtcttgacttgctacatcccctggtgcacattacttttctttgttcatccaactataaaatggatacctgggttgtgggcctcactgatgagaaacaaatgaggatcttgtgccctgaggcatagcctgatctgacccattctgtagctactcattctctgatgagccaagaagcagaaaacaaagttacaaaaccaggttgctaacaaatcaatatgaaatagacgtggcagtggctgtataaatgaggaggtggggcaagtaatagaaagtggtatggactataacaagctggaaaaggcatgacttgtcaaaagggggcagtcattactccacccgttacatgtgggcccgagtgtttccatttttcaagacaaattggaaattaatagttttatttgaaatctgatttttttttttgagacagggtatcaatctgtcacccaggctggagttcagtggtgtgattccagttcactgcagcctcaacctcccatactcaagtaatccttctgcctcagcctccccagtagctgggactgtagtagtgtgccaccacacctggttaatttttgtattttttgtagagacgggtttttgccatctcggatgcccaggctgatcttgaatacctgggctcaaacagtctgcccaccttggcctcccaaagtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttggttacataagtaagttctttagtgctgatttatgagattttggtgtacccatcacccaagaagtatatactgcaccctatttgtagtcttttatcccttcccctcccccacgcttccccccaagtccccaagtccattgtatcattcttatgcctttgtatcctcatagcttagctcccacatatcagtgagaatatacgatgtttggttttccattcctgagttacttcacttagaataatagtctccaatctcatctaggttgctgcaaatgctgttaattcattccttttttttttttttttgagacggagtctggctctgtcgcccgggctggagtgcagtggcgtgatctcggctcactgcaagctccgcctcccgggttcgcgccattctcctgcctcagcctccgagtagctgtacaggtgcctgccagcacacctggctaacttttttttttttttttttttttgtatttttagtggagacggggtttcactgttttagccaggatggtcttgatctcctgaccttgtgatccgactgtctcagcctctcaaagtgctgggattaccggcgtgagccaccaatgcctggccaattcattcctttttatggctgagtagtattctattctatcacaatttctgttccattcgttgattgatgggcatttgggttggttccatgattctgcaattgcaaattgtgctgctataaacatgagtgtgcaagtatctttttggtataatgacttcttttcctctgggtagacactcagtagtgggactgctggatcaaatggtagttctacttttttttttttttttttttgagatggagtcttgctgtgtcaccaccaggctggagtgcaatggcatgatctcggctcactgcaacctccgcctcccaggttcaagcgattctcctgcctcagcctcctcagtagctgggactataggcacacgccaccacgcccagctaattttttgtatttgtagtggagatggggtttcaccatgttggccaggatggtctcaatctcttgacctcatgatctgcctacctcggcttcccaaagtgctgggattacaggtttgagccactgcgtctggcttgttgttttttgtttttttttttttcagacagagtttcgctcttgtgccccaggcttcagtgcaatggcttgatctcggctcactgaaacctccgcctcctgggttcaagtgattctccagcctcagcctctcgagtagctgggataacaggtgcccgcctccacacctggctaatttttgtatttttagtagagacgggcttttgcagtgttggccaggctggtcttgaactcctgacctcaggtgatctgcccacctcagcctcccaaagtgctgggattacggggtgagccaccacgcccagactacttttagctctttaaggaatctccagactgttttcctcagtggctgtactagtttacattcccaccagcagtgtagaagtgttccctgatcaccgcatccatgccaacatctactgttttttgattttttgattatggccattcttgaagtagtaagttggtatcacattgtggttttgatttgcattttactgatcatgagtgatgttgagcaatttttcatatgttggctatttgtgtatcttcttttgagaattgtctattcatgtccttagcccactttttgatgggattgtttgtttttttctttttcttttttttttttttttgagatggagtcttgctctgtcacccaggctggagtgcagtggcatgatcttggctcactgcaagctccgcctcccaggttcacaccattctcctgcctcagcctcccgagtagctgggactacaggagctcaccaccatcctgagtagctgggactacaggcgctcgcctccacacctggctaattttctgtatttttaatagagatggggtttcatcgtgttagtcaggatggtctcaatctcctgaccttgtgatctgcccacctcggcctcccaaagtgctgcaattacgggcatgagccactgcgcccagccaactgtttgtttttttcttgctgatttgtttgaatttgttgtagattctgaatattagtcctttgtcagatgtatagatagtgaaaattttctcccactctgtgggttgtctgtttactctgctgactgttccttttgctgtgcaaaagctctttagtttaattaagtaccagctatttatcctttttttttttttttgcatttgcttttgggttttggtcatgaaatctttgcgtaagtcaaggtctagaaggatttttccaatgttatcttctataatttttatagtttcagttcttagatttcctttttttttttttttttttttttcagatggagtctcaccctgctgcccaggctggagtgcagtggcacagtctctgctcactgcatactctgcctcctgggttcaagcgattctcctgcctcagcctcctgagtagctgggattacaggcgcccgccatcacacccagctaatttttgtattttcagtagagacagggtttcaccatgctgatcaggctagtctcgaactcctgacctcaggtaatccacccgccttggcctcccaaagtgctgagattacaggcgtggtggccagatttaagttcttaatccatcttgagttgatttttgtataaggtgagagatgaggacccagtttcattctcctacatgtgggtagccaattatcccagcaccgtttgttgaaaaggctgttctttccccactttatgttttcgtttgctttgttgccaagatcagttggctgtactggggcaaaactaatccctgatgttagagacaaagatactgccttttcgatccaccatctgcagtggagccaccaccaaaatgcagattttcataacaacctttatggagaaagccatcagtcttgaggttgaacccttggatacaaggaaatgtaaaagccaacatccaagataaggaaggaattccttctgacgagtaaagactgatctttgctggcaagcaactggaagacggatgtgctttgtctgactacaacattcaaaaggagtccacccttcttgtgttgagacttcgtggggccctaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcactccaacctgggcaacagtagcaagacctggtctcaaaaaaaaaaaaaaaaaaaaagcataaaagaaaaaaggtgaagctggctgtcctaaaataccataaggtggatgagaatagcaaaaatagtcaccttcgtcaggagtacccttcagatgaatgtggtgctgaagtgtttatggccagccactctgacagacattattttggcaaacgtctgacctattgcttcaacaaaccagaagacaagtaaaagaaatgaagacaggctgggcgcagtggctcacacttgtaatcctagcactttggaaggccaaggtgggtggatcacttgaggttaggagttcaagaccagcctgggcaacatggtgaaaccctttctctactaaaagtacaaaaattagctgagcattgtggcgggtgcctgtagtcccagctactcgggaggctgaggcaggagaatcgcttgagcccaggaggcagaggttgcaaggttgcagtgagctgagattgtatcactgcactccagcctgactctgactcaaaaaaaaagaaaagaaaagaaaagaaaagaaagaaagaaaaagaaatgaagatactggtttacttgggagcacagtgactggaagagggcttcagggttactgataatgttctattcctttatctggattctggctacacaagtgtattcaatttgtgaaattcattgagctatacatttttgattcatgtacttttctgtgttacacctcaacaaaaactttatttccaaggaagatgtacaaatggctaacaagcacataaaaatatgctcaacatccttagtcattagggaaatgcaaatgaaagcctcaatgagataccacttcatgctcacaaggatggttataattttttttaatggaaaataacaggagttggcagtatgtatagaaactagactccttgtacattgctgatgggaatgtaaaatggtacagctgctgtgaaaaacaatttggcggttcctcaaaaagttaaacatagaattaccgtatgacccagcaattccatccctaggtatgtatcccaaagaacaaaaaacaggtgttcaaacaaatacttgtacatgaaatgttcatcaaagcgctattcacaataaccaaaaggtggaagcaacccaagtgtccattaactgaagaatgcataaacaaaatgtagcatatcgatataatgaaatattagtcatccataaagaacaatgaggtactggctgggtgtggtggctcatgcctgtaatcccagcacttcgggaggccaaggcaggcagatcatctgaggtcagaagttcaagactagtctggccaacgtgatgaaaacccatctctactaaaaatacaaaaattaaccagatgtggtggcatgtgcctgtagtcccaactactcaggaggctgaggtaggtaggatagcttgaacccaggaggtcaaggctgcagtgagctgtgatcgtgccactgcactccagcctgggagatagagcaagaccctatctaaaaaagaaaaaggagaagaaggagaaggagaagagaaggagaaggaagaaagaagagggaagaaggagaagagttgatggtggcttgatctaaggaggtagtgacacacatggagaaaagtgggcagattccagatgtgttatggagttgacaggacttgctgaattgaacacaggctgtgaaagaaagagatgaattaaggcgcggtggctcacgcctgtaatcccagcactttgggaggctaaggtgggcggattacccgaggtcaggagtttgagaccagcctgaccaatatggagaaaccccgtctctactaaaaatataaaattagctgggcgtgtgatggcgcacgcctgtaatcccagctacacgggaggctgaggcaggagaatcgcttgaacccgggaggcggaggttgcgttgagccaagatcacgccattgcactccaacctgggtaacaagagcgaaactctgtctcaaaaaaaaaaaaaaaaaaaaaaaaaagttctcctagatttttatctttgaacagctagtgagatgatgatgttctattaccccatgttgagcaccctaaatcctaggatgcaggggcttccttccgggctgtggaggaatcttggtatttctgagtaagagacagggtcaggttaccctttctttccttttggaattagctctctaccccaaccccagccagtttccacctttcaggtatttttaaatgatttttaatgggagactcaaagttattgctgactcccatttagcactcccttgtccattctcaactctctggttctgatactagccctgcccatggcatggctctgcctggggaccccttcctctgtgcctgtcagggtcatcaggctcgccttcaaacaactattcccttcacctccctgaaggctgagcagcctctctgcaaacccctatttcttgttgggcctggtctgttctgtcccgactgtggcagctgcagactatccagtcctgctgggcttctctctctctccacacttattcttaaaggccttttgtgctaccctaagactttcacaaagtttcatcaggaatatccctctcccaacctcatgacttggtattcccagacagctattctaatcttacgtagcctcacctggtatctccctttacaggagacccccttcccacagaaagccgactcatgaacagctgtctccaggccaggaggaagtgccaggctgatcccacctgcagtgctgcctaccaccacctggattcctgcacctctagcataagcaccccactgccctcagaggagccttcggtccctgctgactgcctggaggcagcacagcaactcaggaacagctctctgataggctgcatgtgccaccggcgcatgaagaaccaggttgcctgcttggacatctattggaccgttcaccgtgcccgcagccttggtgaggctcccattatagagtggactaagctggggaagatggctcttgggggttgttttttaatcctgcaggatatgggccacatggtagaatctgaggaggaggataatgaagctctgcatttgacatcaggaaaggtggagggatagtgctgggatctccttggggccccataacactgccctctcttctccctacttccccctttcttacctggcaacatgtcagttcccacttagcagagctgtgaaccaggctgaggcccaacctggggagttcctggaacagcgggtatggacaggagatgggagaaaaaagtcttaacccataaacaggctccaaataccaagttcagagagatggggaggtaacatcttggtccagcctttaacagaaagaatactcattaaccagccaggagatgtaagagagagaaggcacagaaagagccaaagaggagctgcttgtcactctttccataggccccttattagtcagcttttaccggactatgttgctgtaacaaaacagtgacttgcaaaacaaaggtttaattcttgctcatgttctgtattggctctttcatgggccttcttcattctgggatccaggctcaaggtgcagcctctgtctgggatgttcccttctcgtggcagaaggaaatgagcattggcagaaccacatgatgatttttaaagtttctgctcaaatcttatatacactacgtctgcttacatttcattgagagagcaagtcacatggctaagcctgacatcactggattgagaattatacttcttccacagggagataccaaaaatcacatggcaataagtgaggatatacaatcttacagggaaggcaaagaatgattggaaacaataatacaatctaccattgtcaaagtattcatttctctcccttctgcaagtaaaatatacccacctattttccatggaagatgccctaaaagctctgttcaaacctgacatcaagccgggtgtggtggctcacacctgtaatcctagcactttgggaggccaaggcaggcggatcacttgagttcaggagttcaagaccagcctggccaacatggtgaaacctcatctctactaaaaatacaaaaaattagctgggcatggtggtgggcacctgtaatcccaggctacttgggaagctgaggcaggagaatcacttgaacccgggaagcagaggttgcagtgagtcgagattgcgccactgcactctagcctgggcgacagagcgagactctgtctcgaaaaaaacaagcaaaaagcaaacaaacaaacaaacaaacatgacatnnnnnnnnnnnnnnnnnnnnacaaacatgacatcaggcttcaagtctaggatctcatgatagtttccaaattgggtctggatgtggctcctcttaatctaaaaacttatgaactaaaaagacaagtcatctgcttcctatacgtactcagcatataataacggaacagggtcaggataaccacaacaaacattctcagaaaggggaggaatgggcatctaagtgtggtggctcacacctgtaacttcagcaacttgggaggccaaggcgggagtatccctaaagcccaggagttcaagaccagcctggacaacatagcgagctcccatcactacaaaaaaataaataaattagctgagtgtggtggtgcacacctgtggtcccagctactcgggaggctgaggtgggaggatcacttgagtccaggaggttgaggctgcagtgagccatgatcacaccactgcactccagcctgggtgacagagcaagaccctgtctcaaataaataaatgaatgaatgaatgggagacacacagcagacattgattcatagcaattctgaaatcctgctagacaaatgttgtaagggtcctcttccctgggaatagggattgttctttaataaggccctgtttttactccacgggagtagttgccctattcccccattgttttccagagctcttggcccagccctctggaaaggtccttcctctttcagttttctctttggccacatttgaaaagggtattagggactacattctccctgaggactgagccgcattctcagcctgcttcctgcctgagaaatgttggggcattttaagtctcaaatagtcacagtctcttttaatctacactggtagctctttgtagtacaactctctgaaaacataattgctgcttatatctttgatttctatcatctcatgtgcctgtggcctttcccacaattcaagacatgcctctttttctacacctaattagaagcacctagcccttatcaggcttctgtggaagagccactactttagtcttttttccctgagtacatttgtccaactggcaggacttattgggtaccatcttaatcgactgagagatatccacaaacagtgtgatagccacatacctcatttggtcttttccccaaggctgagttgtaatcaaccttatcactcaaagcatttttttttatgttttatcttttaccttatgaatacaagaaacagtggcatttcttcttcttcttcttttttttttttttttttttttttgagacagagtcttcctctgttgccctggctggagtgcagtggcgtgatattggctcactgcaacctctgcctcccgggttcaagcgattctcctgcctcagcctcctgagtagctgggattacaggcccctgccaccatgcctggctaatttttgtatttttagtagagagggggtttcaccatgttggtcaggctggtcttgaactcctgacctcgtgatctgcctgcctcggcctcccaaaatgccgggattacaggcatgagccactgcgcccagcacagttgcatttcttaatcctggaagtcctgaaatttctagattatcttttcctccacatttgggaactggccaattcttttctgagcttatatcttgtagtaccttgccaaatgcagccaatagcaatcaagacatactagtaaacttctgcttctcagcttcccctaacagtacaaactcattcagcatataatcttcccagttatcacacacaacaattttaccagatgctttgccactgcataatgaagactgccatctttccagcccccagtaacagcttccttaccacccattgcccagtaccaaagccaatgacacacattatattattttattactgtagcgctccacttctaggtaccaattgcattttatttttgctgttttttttagttggagtctcacttgtcacccaggctggagtgcagtggcacagtcatagctcactgcagcctcaacctcctgggctcaagtgatcctcccacctcagcctctcgagtagctgggactatatgtgtgtgccaccggacccagctaaattttttgtagagatgaagtcctgctgtgttctccaggctggtctcaagttcctaggttcaaggaatattcctgcctcagcctcccagttgcattttttttttttcagatggagactcactgtcgcccaggctggagtgcagtggcatgatcttggctcactgcagcctccgcctcccgggttcaagtgattctcccacctcagcctcccaggtagctgggattacaggcatgcgccaccatgcccaactaatttttgtatttttagtagagatggggtttcaccatgttggccaggctggtctcgaactcctgacctcaggtgatctacccgcctaggcctcccaaagtgctaggattacaggtgtgagccaccgtgcccggcaccccattgcatttttagtaagaatttgctaggttatgctattgcaacaaccaattcccaaatctctggctttcaacaacaaaaatgtatttcttgctcatgttacacatctgctggaggcttctatgagttggccttgtctctgttctacttgtcttcttcactggaagatccaggctggtagaggagaaagagtagcagcagaaccatgtgaagattcttaaagcttctgctcagatgtgatttacatcacttcagctcacaatccacagaccagagcaagtcacctggccaagcctgccatcagtggggtgaggaagtgtacgcctctcacagggggtgtgaaagttacatggcaacaggtggggaagtataatcctcccaaggggtggggaacaaataattggaaacaataatacagtttaccacactccttgctccctgttttctactcctcatcctaatcacttctctttccgaacttcctcagaggcttctccctgaatcctcttgcctccctacactgtgtgctgagcaccatcgcgtaagtgcgatggtgctcagcatatttatttacctcacttatagcatggtgctcagcacacagtgtgcttaacaaatggtagctcttattattcttatggcttattggtggagcccagcctataccttacggccctgcatttttctcatctttgcacagcttgcagctggttaggtagaggctgtgcttttccttttctccacaggcctttgaggtctgagccagcagcttcagcccctccagcctaccccaccctggtcctcagcattctggtgctccccaccttgtctctaggtaactatgagctggatgtctccccctatgaagacacagtgaccagcaaaccctggaaaatgaatctcagcaaactgaacatgctcaaaccaggtgtggagggcaactaggctcgggaaccagaggctggggctggaccctggaggaagggtggctggggaggggcagaagttggggagcttataagggaaatgtttctagcctaccaggtgactaaggaagactgtgtcaggctggaagtgtgagctctggggcatgatctggtctcacaggggtctccaaaggacagcagttattagggaggcatttgaagagagcccattagggctccctgtttccacaaggcgagcccctgcaaagggcgtggtgggagtggcagcagccccaggaaaaattgtgctgaaatgcagtatttacttgcattcaaggcagctgggaaagtagcctttttgtccctgaagactaggaaattgcttgttttcaaccattctaatgggatgggcgaggtattgggcaggaaaagagagtgtgactctgcacggggtgactcagggtggggagccatcagtctggcaaggactgtgttgcatgtttttcaggaaagtgaggctatgagttaattgaggaaaaacatacacacatgcactctctttttgagaaagatgtgagctttatcattagaattagaattttgagaaaaaggcatagagtttcatgcatgaaaaactctaagtgacaagatcagcaaataacctgttgcaattacttgattgctgtggctgctggaatattctgttaatagaaatatcaccataatttcccaagattcagagtatggggaacagagtatacatgaatcaattaatgaaagatgggcaggtgacattaaaatggaacaggataggtgcagacgaagccaaaaccaaaccagaaacctaaaatagaatttggatgcatctgttttggacagttctgaaagtgctttagaatgttgcaggtactctaggttatcatttctaccatcagatctcacagcatagcactgaggaaagaggtatggttatttaagctttctggctgcttgaattctagataaatgggtgttcgatgcatatagatgatgatagtgattattcttattattttacgtagtcaagatgaggagttgtgccgggcgcggcggttcatgcctgtaatcccagcactttgggaggccgagatgggcggattacctgaggtcgggagttcaagaccagcctggctaacatgatgaaaccccatttctactaaaaatacaaaaaattagccgggcgtcgtggcgcatgcgtgtaatcccagctactcgggaggctgaggcaggagaattgcttgaacccatgtaggcggaggttgcagtgagccgagatcacgccattgcacttcggcttgggcaacaagagcaaaactccgtctcaaaaaaaaaaaaaaaaaaaaaaaaaaaaaaaagaggagtagggtggggaaggcttcaaaacagcaggtagagtttgtggggagaggggaagccctggattaggagtgggtttattcatgacaggccttcttttcctcctatatccactaccttcttgtcaaatcaggggtttccggggttcctgtggaacctggggtgcaggcgtgcagagggcccagccgactgactccgtgccctttccccccagactcagacctctgcctcaagtttgccatgctgtgtactctcaatgacaagtgtgaccggctgcgcaaggcctacggggaggcgtgctccgggccccactgccagcgccacgtctgcctcaggcagctgctcactttcttcgagaaggccgccgagccccacgcgcagggcctgctactgtgcccatgtgcccccaacgaccggggctgcggggagcgccggcgcaacaccatcgcccccaactgcgcgctgccgcctgtggcccccaactgcctggagctgcggcgcctctgcttctccgacccgctttgcaggtgtgtagtttgggaggacagggtgggcagggatgaggcacacgccactccttcctggccacgttcctgtgctgagcagggtctgaccctcccagggaaccgtggacccactggctgcttcacgaagtagctaccttggatattttgtgaaagtcttttctcaaaaagaatatatgtcttttttttctttgctgtaaaacctcaggaaatataaaaatgtattttaaaaaatcattaaaaattctatcacctgaagataatctatcatactttgggaagcatttccttccagtcattttctatccagataacaaaagtagacattctgagaatgtatttgtgtcttactttttttctcttacggcacatgtctcatgagcatttttctgtggaggtggtgtggagtagtggtaagacaggatctgaagtcagacgggtttgaatttaaaccctgggtctctgcgatcttgagcacagcacttaacctaaaaactccatcactaaacctaaggttccgtttagtcccctgtaaaaactgggataataatgcagacctcatgggattctggtgagagttaaattacataatttatgtagagtggtgtagagtaccggtgaagagtaagtgctcaataaatggtagtgcttatttttttacttactgtcctttaagaactttttttttttttttttgagacagagtccccttctgtcacccaggctggagtgcagtgacacgatcttggctcactgcaaccactgtctgccaggttcaagcgattcttctgcctcagtctctcgagtagctaggactacaggcttgtgccaccatgcccagctaatttctttatttttggtagagatggggtttcactatgttggccaggctggtctcgaactcctgaccctgtgatccacctgctttggcctcccaaagtgctaggattacaggtgtgagccaccacacccagccaagaacttgatttttaaatgcctgcattatattccatgtatggatgccctacacttaatttaaccattcctctattgctagatatttaggtttttgttttggtttttttttgtttgttttttttttgtttgtttttttttgagatggagtctctctctgtcatccaggctggagtgcagtggcgcagtctcggctcactgcaacctctgcctcccaggttcaagtgattctcctgcctcagcctcccaagtagctgggactacaggcatgtgccaccaggcccggctaaatttttgtatttttagtagagacggggtttcaccgtgttagccaggatgatctccatctcctaacctcgtgatccgcccgcctcagcctcccaaagtgctaggataacaggcataagccaccgtgcccagcgatttttttttttttttaagacggagtcttgttttgtcacccaggctggagtgcagtggtgcgatctcggctcactgcagcctccgcctcctggtttcaagggatactcccccctcagcctcccaagtagctgggattacaggcgcctgccaccacgcccagctaattttttttgtattttcagtagagacgggatttcgctgtgttggccaggctagtctcgaactcctggcctcagttgatctgcccaccttggcctcctaaagtactggtattacaggtgtgagccaccgtgcccagccagattggtttttttcttcttcttcttcttcttcttttttttttttgagacagagtcttgctctgttacccaggctggagggcagtgttgtgatctcggcttactgcaacctctatctcctgggttcaagcgattctccagcctcagcctcctgagtatgttgggactataagtgcacaccacagtgcccagctaatttttgtatttttagtagagatggggttttgccatgttggccaggccagtgttgaactcctgagctcaagtgatcagcccacttcagcctcccaaagtgctgggattataggcatgaaccaccatgcttgcccaactcttactctttaatctttgtgcactaatgtagttattacttaggatgtgctgctactagtaccattgccagatcaaaggacatgggagattggtaaggtatttgatagatttgataaatattctcttcaggaaatttgaaattctgatctggctttcctgtgtcttctcaggacaaaacacttacaaaattgaagctatcattcattcaagtgacatttgttgacaataaccttggtttgcaacttggttctcctacttagttctttgtaaccttcggcaagttacttaacttctgagactaccactttcctcatctgtaaactatcttatagtcagggctcttaataatcataatactaacatttactgaataactaaatacttactagggctagatactgttttaagtacttaacatatattaactcatctaaacctcacaagaaccccaataaggtaaatcgatccttctttccttccttccttccctccctccttccttccttctttccttcctctctctttctcttcttctctccttacttctttcctttcttccttcctctctttttctccttccttccttcctctctctctccttccttccttctcttctcttctctcttttctccttctcttctctctgtctctctttctctttctttttttttctttctttcgttctgagacagggtcttgctgtgttgctcagggtagtctccaacccctgagctcaactgattctcccacctcagcctcccaagtagctgggattacaggcgtgagccgctatgcctggcttatgcattctcttacttcatcctcacaaaaatccacgaggtagtgctgctgtcatctctattttatagttgaggaaactgaggttaaagaagctatctgagatctcataagtagggatcgtggagcccaaactcagagtgaaatgctatgggttccaaggaatggtacatttaactgttacaggggcacacttcacagaggaaaggctctgggccaggctctgaaggcagaggaggatttggcacgacaatgggcatgccaagctaagggggaatgagggagaaggctgcaggctggaccctcaagagtgacttgaaatttttctggccgagtgcagtggctcatacctgtaatcccagcactttgagaggccaaggcaggtggatcacctgaggtcaggagtttgagaccagcctggccgacatggtgaaaccccgtctctactaaaaatacagaattagccaggtgtggtggcacgtgactgtagtcccagctactcgggaggctgaggcaggagaattgtttgaacctgggaggcagaggttgcagtgagccaagattgagctactgcactccagcctgggcaagagagagtgagacatcatctcaaaaaaaaaaaaaaaagaaagacagaaatttcccttcttccagatcacgcctggtggatttccagacccactgccatcccatggacatcctaggaacttgtgcaacagagcagtccagatgtctacgagcatacctggggctgattggtgaggctgggggcatgtgtagggaaccctatgttggctaggcctgagggtaagaatgctccggagataaaggatgtgatcctgacatgggtggaagaaggtgggagctaaagttagggttagcctaggccttgactaccctttccctcttcacagggactgccatgacccccaactttgtcagcaatgtcaacaccagtgttgccttaagctgcacctgccgaggcagtggcaacctgcaggaggagtgtgaaatgctggaagggttcttctcccacaacccctgcctcagtgagtgtgctgtacttgctcccagcccctggggctgagtcagctggactcaagggaaggaaaagggtcgactctgtggcccaggctggttccatccatctccaccaaacagagcagttcctagcataggctttcattgccatagcccaggcctttcttctgtctcccactccctgagaaacctcccacgctgcctgttcaacctgtctggaacccagggacatctccagctcaagaaacaagcagaatgagagagtatcccacttccacctcccacccacttgctcccctatagcccagggtccctgtggcattccctttccttccttgggagcctgagaaatctcctgcccccatacccttccaatgagccttctctcctctcttcagcggaggccattgcagctaagatgcgttttcacagccaactcttctcccaggactggccacaccctacctttgctgtgatggcacaccaggtagggcctcctctgttacacccctcagacctttactgggccggctggggaaaacccaaactaggcagacaaagggatagaggcgaggggctgacctcctcattgccctgaatactagagacctctaatggatacctcaggggaaggggaatacctcttgactgaggctgaggtagtgaaagggctaaagaaaatcccctgagctaactccattccatttcttccacagaatgaaaaccctgctgtgaggccacagccctgggtgccctctcttttctcctgcacgcttcccttgattctgctcctgagcctatggtagctggacttccccagggccctcttcccctccaccacacccaggtggacttgcagcccacaaggggtgaggaaaggacagcagcaggaaggaggtgcagtgcgcagatgagggcacaggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagcctttctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgacttaagactttgctctttttccattttctcaaattttgagtatctgtagaactagggtgttatagatgaaagaacacaggccaggtgatgagacacagcaaccctaccaccatgtgctatatgacttcaggtatgtctcctagcctctctgtgttcttgacttggagttggaagaaaaaatagcttatgtgaggctgtggacccgggatctgtcccagctccagccatttctcggatactgcctgggatctgccacagcagctgagatggggatccttagtcaaccacaccatttattgaacacctgcttgggttattggcctgctccagatcataatgggagccagaggaaaagagagagtggttcttttttttttttttttttgactcggagtctctatctgtcgcccagtctggagtgcaatggcacaatctgcaacctctgcctcccaggttcaagcgattctgctgccccagcctcccaagcagctgggactacaggcatgtgtcaccatgcccagcaaatttttgtatttttattagagacgggtttcaccatattggccaggctggtcttgaactcctgacttcaggtgatctgcccacctcagcctgccaaagtgctgggattacaggtgtgagccaccatgcctggcccagagattgttcttgatctcagggaatttgtaatcctattgggataaggacacacccacccatgcaaagtataatagttggaagaatgtatttatagagctctggacatctgtctattaattgattcactcactctttcaataagcatctgatgaatgctgactctgcacgacactgttttgtgtgcaagagattctggcataaaaggactcagatcctatgttcaaactttttacacaccagagcagggaagcagacaacagtccataagagcagtgcagtatgacgagtgatatataataattacgataatcctttttttttttttttttttttgagacagagtcttgctctgtcacccaggctggagtgcagtggcatgatcttggctcactgcaacctctgtctcccaggttcaagagattctcctgcctcagcctcccaagcaactgggattacaggctcacgccaccatgccaggctaattttttgtatttttagtagagacgcagtttcatcatgttggccaggctggtttgaactcctgacctcaggtgatccacctgcctcagcctcccaaagtgctgggattacaggcatgagccaccgtgcctggccctaattatgatgatcctcgtttatggagcccatactgtgtgccaagtactactgtgcattaaccgtgtgcaaatacatgcattcattcatttaatcctccagcaacatttgagtttgttaatcacaagctattaatatgtgac

SEQ ID NO: 14951 - DNA, 39936 bp, Human
tggggtggagaatggatcatggggggggtggggtaagggcagaaggagagcccgttgagcggatcattgctgtcattctcgggagagaccatggtgtcttgcccatggcccagaggtggttaaaaaaaagaaaaccagacattcagatttgggatatatttcaaaggccgtgtcgatagggtttggggtgcaagagaaaggtagagtcaaagatgattctgagtgtttggctcgagcttctggaggtttgaagctgccatgaactgaaatgggagttgcttagcggagagatcaagagtttggttttgtgcttgtggagtttgagctgcccattaggcatcaatgatgagtaagcagttgggaaaagttaagggcggaggttggagttgaaaataaaactttgggcatcatcaccatataactggtatttaaagccacaagagcaggtgggctcatctagggatggagtgatatggagaagagaaggggtctaaccattgagtgctggggcccccagtgttaggaaccagccaagaagacagaaagagtgaaaatcagagagttggggtgtcctggaggaaatgaagaaaatgccccaaagaggaaggagggaacaaatatgaccaatgcccctggcagagcaagcaggctgagggctgaggattgagcaatgggaggtcactggtgacagtttcactggagctggatggggaactagagggaatgggaggggatgggaggacttggggacagcagtacaggcaacagacaagggggcctgctgtaaagggagcagataaatgggattggagccaaatgaagaaggggagtgtcaagagagtgctttacttttacaatggagaattagagtgcattgtgcactggtggggggatttgatctcttagggagagaacagtgttagggagggagaatgcaggatagctgggggagggtggggggcttggccccagcagagactcaggacacttgggaagttgagcttccctgggcttcccctcctctcctgtctgcaaggggtcagtgggctgagatttcagcacttaagcaaagcatttgctcttggccccagagaaaccgggctggctgtggtctcaggaaggaaggaggtgtccaggctcaggcctgggcctgggtttcagggagggcccacgtgggtcgccccttgaccctctctttcagcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggtaataaaggagtaagaggaaggatgttaaggacaattttaggaaacagataatgagtgaatattttttctctctctttcccaatttaaactgaagcaggagaaactgaagctagacataatgattaacttcccaagctggtgagcttcctgagctggttagtgagaacagcactaaggccaggttctcctccccagatgtttaagatgagacaggacaatgcctgctcagagacagggcctggctgaattggccctcaggattctctctgctctgaggtttctggaagaaggccagggcagaggtgtggtgatgtagctgctgggaggacagagctccgagtcacgtggcttgggcgggcctccccttcctggtgtccacagaagcccaacgtcactagctggggtgtgtatggctcacacgtaggccaggctgccctaggcttggtgtgcaagggaggggcccctacttacttgtggcctgtcccctcgtgaatgtgtctcatgtccccagtggggtttttcagtgagggtcatggtctccaggatgcacaaggctttgtgccagaattgcttggaattgcctagttctggaaggctggttggccaactctggcctccggcttttcctttgggaatttcccttgaaggtggggttggtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggtaagaggagcaggcattgtcccgtcccagcttgatcctcagccttctttcatccttggccgcgacatgctcccaggcctggggtcagatggggagtgctgactctgtttctgggctgttttctggggagaatgggtcggcgggtttttttccccaggacctgggcagggtcaatggtgggggccgctgtcgcatccttggctggtgtttccacagctgagaaccactccagggccaagcccagagcttattctacccttttttgtcctctcttcccctgtcctcggccaccccaccctcttggctcctctgcttagatgtgggcacaaggaggagaactccttggcctgagagaactaccttagatcctggcttccagtggcctctgcaggggggtacaccctctctcccaagcagccagacacacaagtaacctcattgcctcagtttccccatctgaccagcacagggccccctgtgccccagcagcgttctgagagattggagctttctccttttgcttaccttggctaccgtatgaggacggatacagagtgttccccccacccccagcccaggggatatttgattcatgaacattccctcagtgtctttgtgggggacaatgctgtgccaggctcagggatgccaggacgagtaagacccaggctcccacgtggcccaggcagggagagagacacataaacaaccatcaggaaagaggtaaaatccccaggccacttggcatctgctcccttgagtgtctgggaatgtccctgatttataaaaagaagctgacggccctctttgttgtccatgcctacaccctttcactttcgtttcttcggggcactgcagcagcccttgtccacagaccccatgacaatcgcagaactgaccatgctgagagattttcttggctgctcagggaccctgccagggcttgaagctcctggagggtcacttgccctcaaattcccagaacgcacagcaggtcactgatgatagcagtggcagcagtctgtgcacggtggtttcgagggcgtgggagggaggtgagggccctagggcaagtgtgtgtgggaagtgttgatgggggacaaggcaccagaacgctcggaaacaacttagtttgcaccgtaatttttcacttcgcctaggacaggacctttagagcaatattctgagtctaccccttggagtagcagtgtgcaaaacacacagcacgggcttggggcccccgtggggaacccaaatgtaagagttagagacatgcattccggagtcatacatggctcgtgttgaaatcctgactctgcctgtctagctgtgacacatcgtacaaatcacttagcttcttggtgcctcagtgtcttcctctgtagaatgggtagatcataggcactacttcagagtggctgggagggttcagtgaattcctgcaggagagcacttagaatggcacttggtgtgtagtttatgcttaattaatattagccgttactgaaactgctgtagcctgaatccagccagcatgaaagagcccctctcaccctgcttcgaagagaatgaattccctgattgtttggaagatctctctctctctctctgtcttttttttttttttttgagaaacggtcttgctctcttgcccaggctggagcgcaatggtgccatcttggctcactgcaacctctgcctcccgggttcaagtgattctcctgtctcagcctcctgagtagctgggattacaggcgctcgccaccacgcctggctaatttttgtatttttagtagagacagcgtttcaccgtgttggccgggctggtctagcgctcctgatctcaagtgaccttgggagatctcttgctcctaatattacctcaagcctttttaaacgttttaagccggagaccaagcatggatatgggagttaggggtcttgatttaattcttggttgcttcaaactctgtggaaccttgaggtgtttcttgccttctctgggtctcaattttcacatctatatggtggggagcttggattgggtaatgtctgaggctagaaccatggccaactcgggttctgctggggctgacttgccctggccttccctgaccaccctgcatctggcttctggagaagtcccgcactgaccttgttctcctccccaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggtgaggcactcctggtgtgcatcacagagttctcaggaaaggggtgcttagtcaccaagactgatttgtcctcatgaagtcagcctgtggggtaacttggtccatgggatttcccctaaaaaggtagccaggcaggtaaaatttgctcttgactcttggcaggaaacgtacaactctttctttcttcttttcttttctttttctcactctgttaccctggctagaatgcagtggcacaatcatagctcactgtagccttgaattcctgcgctcaagtgatcttctggccttagagtagctgggactacggctgctgtaccaccatgaacagctaattttttttttttcttttagagatggggtgttgctatgttgcccaggctggtctccagctcctggctttaagcaatcctcccgccttggcctcccaaactgttgggattgcaggcatgagccactttgcctggccaacagaacacttctgccgagaggaagtgtgtggtggccaggaactcagattctggagccagaatggtgcaggctcaaggtcaaccctgtgtgatctcaggcttccctatggagcctctccagcctcagtctcccttgtttcagtttcctcatctacaaaacaatgttaatagtcaaatggtgcctatcctataaggctcttgggaggattcagtgagttaatttgagtaatgcttaggatagtgtctattaccactggctgctatttattatttctgttatgagtgatactctgtacttgtacacttttatttctgtctgttttaaattaacagcacaacagaccataacactgcagtatattgaatttattttataattaacatagcatattataaactaatatagcttaaatgtttatgtaggatttctgacatgaaattgcattagatcatagatgttcagagttggtatataacagcccctgagaatgtagtaactcagcagagaccagaaggtcagagaaatgaccactgagtatttttgaaactcttttgttttcttccaaatagtgattcttagggctcctgagaggcagatggaacaatcattaacattccactttataaatcgggaagttgagaccaaggaaagtagtttgaataagctcacagtagttaatgagggggccagtgctggaccaattggccagcactggtcattgacttattcatccatcattcatttattcagccagaatctattaggtgcttcatacatatttgcttaaagtttgttgtgttcatagagctttgcacacggtaggtactccataaacatttgttgatgaaataagtgagttactgaatgaatgattgaattagaatgacactgcagtgttaaaatgggctgggttggggaacattttagtttttgtttttgtctgttttccaaaaatgtatgtgttgttcacatgagtctggataaccctagattgagattgatgacataaataaatttgtcttcaaggctgcactaaagctggctcacatggctaggtatttacagagcagaagtggtgcagtcctctctgattagttgcacgtacagaagacatattcgttattggactgaccttagtttctcttataatttgttaggggaattgaatcagcccatctgagaagttacaagattgtgtcttgtcatctttaaaagttcagcaatgtgatgtggtacagatggtctgaggggtttggagaaggtagcctagatccctagggcccagagaagacaggatgtgaacagaggaagtacatggattggtgaagaaaagaaatgggataactcatgggtcaaagaagaaatcatgatggaaatcagaaaatattcagaaccatacaataatgagaatattatttatcaaaatctattggatgcagctaaagcaggacatagggggaaatttacaaccttaggtgcctagattaggaaagaaggaaggcatttgtttatttatttgtttatttatttatttgagatgggggtctcactgtgtcacccaggctgctggagtgcagtagcacgatcataaatcactgaagtctcgaacttctgggctgaagtgatcctcccgcctcagccttccaagtaggtgggacacaggctagcaccaccataccaggctaattttttttttgtagacacagggtcttgctatgttgaggtctcaaactcctgggctcaagtaatcctcctccctcggcttcccaaagtgctgggattacaggcatgagccactgcgcccatctaaggctgaattttaatgagctaagaattcatcttaagaaagggctaaatagacagcaaaagcaaacattgaaggttgggactgagctgagtgggtagcagggatgggagacaacagatctgaggagagcaggagattttgaaaggattgcactgcctgaggtttaagcctttagaatccagctctctctgagctccctttgagctctgacattctgtgactctgatttggtggccttcccttagtggccttactgatttcatttggatggtgcttgtggtatatccaaccaacatgtcttcccaaatggccttttaatttcctataaagaagtagttgtcattgattgcaggttagggacagaaaatgctgtggaatgaaacaaaatgcaagttaaagaactaaattccaaaaatacccattgctactattgactgagtgaattcctactgtgtgccagacactgtacccagtccattccctgtattgttttatttaagcctcacaagggtatagtgtgactacactgtttcttaacaatgaagaaactgcccaaatcgcccatctgggaagcggcccagctagaatttgaatccaggcctgttttcctccagagcttgtgctattctctgtctgtcataaaatgtgggggctttgtgtggtaaacttgctcagttgggcatagcagttgttaggaaacctgaggctggtaacaccagctgtaataccagctgtccgtctgactcatgcaactgttaaagttgatagggctgaggtgtcagactgagctctgaattgcctgattcctataacaatattaacttaaacattttttaaattgggaaatgcaccatgcatacagaagagtgtgtatatttcatatgtatagtgtaaactgttcccatcacccaggttaaaaaacaggatgttgccagtacctggggccttctttaactgcaactgctagaggtaaacactggcttgacttttgtgtaaatcatctctttgcctttctttaatgttttagcatcttttaaaataaatccccaaataatgtattgttctattttgaaaaactgagtagcaagccaaaaatagctgtgtaaagaaaggtcacttaaattaggctgggtgcagtggctcaagcctttaatcccagtactttgggaggctgaggcaggtggatcacaaggtcaggagatcgagaccatcctggccaacatggagaaaccccgtctctactaaaaatacaaaaaattagccaagaatagtggcatgtgcctgtagtcccagctactcgggaggctgaggcaggagaatcgcttgaacccgggaggcagatgttgcagtgagccgagatcgcactgcttgaacccgggaggcagaggttgcagtgagccaagatcgcaccactgcactctagcctgggtcacagagcaagactctgtctcaaaaaaaaaaaaaaaaaaaagaaaggttactattgccttttcttagatgaaggttcccaaggcagggaaagctaagtggagtctcagggacttggtctggcttttccttccctgggaatttataaggacctcttctgggaagtcagtcggcaatgccatgaatgagtctggggaaatattgggctcattgcaactggagggtctggtaggactgatgtgaattaggtgctgtgtccggaggaaaatggccagaggaagtgggctgctttgtacagtcagtggtaaagttgccaaaggctattatagctcacaggaatgggccaaggctaaacactcctgtggagtgaaatgaatgtcctcagctgactgaggcagcgggagttgaaaagaaacgatattagttcatggtgaagacaagtcaaatatagataaaggttagggtcaggcttgcctggacatctaggagataactgccctcaacttgtttgaatcttgagtcactgctccattttgtttgaactggtggccatctacttatagtatacagccatcaacctgagatttccctacatggtcttcctgccttggtctcctgtatcctgaatcctatggcctcttcttccctggtttactacattttgctagaccgtatcctccagtcaattccttagaatgaatgtatgaaagttaaaatttctgaggtctcacatgtcttaaagttccctcatactggattgatagtttggctgggtataaaattctgggctggccatcattttccttcagaattttgattgcattattccattatcctctcttttcaatattgcttctaagaattccaaaacctttttttttttttctttttgagacagtgtctcactctgtcacccaggctggaatgcagtagtgtgatctcagctcactgcaacctccacctcctgggtttaagtgattcttcttcctcagcctcctgagcagctgggattacaggcacccaccaccacaccctttagtagagatggggttttgctatgttggccaggctggtcttgaacttctgactttaggtgatctgcctacttcggcctcccaaagtgctgggattaaaggcgtgagccaccacacccagcctccaaaaccattttaaaactctttctggaagcttttaaaattttcttttagtccccagaattttaaaatttcaattatgtgccttggtgttcttccattatgttagtcacccaagaggtactttcaatctggaaacttctctatgttttgggaaatgttcttgattagtttacaggtgatttcttcctctccattttatctcttctcttttcatgaaactactattaattcaatgttagaattccttgactgatcatttaattttcttctattttccatctctgtgtctttttgctctacttttctatgatagtcacagctctatctttaaactcttgagtttttcatttttgatgtcatgattttaatttgcaaggggtaggtttgactgattcttttttgtagtatcttactcttgttttatggatgcaacatcttctttgacttaaggatcataagataggtgggttctttgtttgtttgtttgactgtttttcaccctatgtaaactttttctacaagtttctttccccttcccccctttttggcttctatctcccacattagatgctttctctgggctcatgatactctttggttttctttctcaagattgacaggtaggactttaaaacttgttgagcatgcgggtgaaacttgtctaccatgaatttcactgtagatattttggagattgacagtgtttatatctttagatctcgcctcctgggttgatcaagttatctgagtacaccacagaccttttgcctggggataaaccagaaatctgtttcagaaaccactttgattcagtcttccttgttttagtcatttccttcagttccggaggtccctcatgctgatcattccagagccctttacagatcctagggtacacactgcatggttttcaactttcttgttttggggttaagatttggctttcaggagtctcctcagtccgttactattcattcaatcagcaagtccttgagcacctgatttgtgccagacattcttctaggtgttagggatacctcagtgaacaaaacagacaaaaatctttgtcttggaaatacacacactccagtcaggggagagggacaataagccaaaggaaggaaattacagcgtgtgctagaaggtgataagtgctgtagaaagtaagtaaagtgggtttgggagttgagagtttgggaaggggataaatgatggcaattgtaaatagagtagtcagagttctcacttagaaggtgaaattcaagtaaagacttgaaggaggacagggaattagccacatggatggctaggggaaggcttccaagctgagaggacagccagagccaaggcccagaggcaggagcatacctggtagttttaggaaacaggaggccaggatgctgagtggagtaagagggggcatgaaaggagaaacttgggtccacgtggttctagacaggtatttttgtctgttttgggccctgaaggttactattggacttggactcttactctgaggaaatagggacgctattgggacgtttgtacaggagcaatgtgacctgagttttgtttgtaaaggattagactctggctgtggcattaaggctaggctgtgggggcaggaacagaagcagggggaccagttttgcagcctgtgcagctttccagataagcagggattgtggcttggaggaggatggtatagaggaggtgacaagaaatgactctatgtctggtatgtagatattggccacagatggcatttgagcactagagacctggctggtccacatggagtttccataagcacataatacacatcagatttcaaagacttaatatgaaagaaagaatgaaacgtaccttgctatttctttcttttttttttttttttgagacccagtcttgctctgtcacccaggctggagtgcagtggtgtgatctcggctcactgcaacctccgcctcccaggttcaagtgattctcctgcctcagcctcctgagtacctgggactacaggcacctgccaccacgcctggctaattttttgtatttttagtagtgatggggtttcaccatgttgtccaggctggtctggaactccggaccttaggggatctacccgccttggcctcccaaattgctgggattacaggcatgagccaccatgctcagccatatcttgctattttctacatggattacatgttgaaatggtaatgttttggctattgtggattaaatagaatatatgattaaagttgatttcatctatttcttttaactttaaaaaatatgtctgttagaggatttgaaattccacatgcggcttgcatttgtgacctgcatttcatttctgtggaacagtgccctttttgggacatgctttgaaggtggagtcaacaggatttggcagattacagacgagaggcttcaagggtgactccaagacttcggggcagagcacctggaagaaaggggttaatattagccaagatgaggaaggctgtcggtttggcaggtgcatgggcaggttaggagtttagttttgaatatgttggaggtgtttatgaaacttttaagtggagatggaaaataggcagttggatgtgcaagtccagggttcagggagacagttcaggctggagatgaagatgtgggagtctgaggagagattgtattcaaatattcaatccatgagacttgatgaaatcacttctcttccaaatgatttacagcctgcagaatcattttccctatctttgtaggtttatgtcttcattttgtttcatttatttttcagttattcactgttttagtgagttttgagtaggagccagattggatgcatgcgttcaattcaccatccaacactgtattaactacttgaaactcatgtggttgttcggttgtttttttgaccttttattctggatggaagagagatgcttatgaagttgcagtaatcagtaagccttcccacattgctccatcagccttcctggaagaataatgtcttctgcctttcctgtaggcaagaaggctgcttgatcttgccacggtgaaagcgaatggattggctgccttccttctacaacatgttcaggaattaccagtcccattggccctgcctttggaaggtaggtgtatgttctcagttaatcagaaagggaagggcagtcagtgcagatccatggttaagagcagaacacacctcggttaacatcccatatgctggcagtatagcctccctatgactcaatttccttgttttaaggctagcaccaccccgtctcattgggattttgggagcattaaaaggacaaaagcgtgtaatgttagctattagctttcattatctcccacacagtatactgacaattgggctaccatatattgagggctaactaaaggtgttacttaccatccaaactctcattatctgtaccgaaaagatatggacacatgttttgagttagggctggtatctcttgatctctgaaatttagcagctcacaatgggaaactcaagaaccaagtggatctagagactctggtatccctcagtgcccagggtcaccacccaaactcaggaacaggaggggcttggaccgcaccacttgaacataccaggcatcctgccaggtgctttatggacaatgtctaccctttgcaacaaccctgagaagtaggtggtgtttttttccaccttatagatgtggaaactgggcagggaggttaagtgacgagggaggggaagatgggtctgattgtaaattgtccccacctacactttctcttttcttgggagaagaaatgtcagttgtaaagagagagtgcaagcctggcactctttagggcttgttcctacaccactgtagggaaagctcattggcactgaagccccctgagctgtgtgtggtgctggcagatgggtctatcaccctgggctgtgtcctctgggcagcaagcaagcctgtgggcggggtggctggaagtctgtgcctggcactcgcgagtgcaccgtctcattgaagaacaggatctaaacatcagtgcgccacagcagggtgcgcggcacggagtgcaggccctggtttggcccttggttgaggtttgctgttgacatcatcaagcacagctagtcactgtaagaccaggccagggtgcaagattccccacacttctaaaggtgacaattggtgtgtttatttctctataaaatgacattttttttttctggagaattttagtatcattggtgatgactggaaaacctgcatcagaaatcaggtcggaagaggaagatatatatctgatatgtactggagaggaagatatctatcttatggtctaagttcagggatcctggtatattcagagggcagaaagctcagcaataatcatcaactctgggaacagaggtgacataaacacagggcgtcccctttgtgtgactgcagatagtcatcagtgagctcagagctctatgaaaattacttgctagtttttgggttgaaaatagtgggccagtgtttggttgggggcagtgaggctgtgatggcgggggaccatgccaagctcctaccagcctgggacgctaaaccagcacttccccatttcctgaaaggggaactaaactctgacacaggaaatggtttgcttgcattactttcaggatgagaaaggaagagcactggccttccaaacacaccccgtgcatgaaaactctccctgcatggggtgcatggggaggatggggaagtggaggcaggatcacagactcttgttcgagtgctcagctggggcaccccggtgaccccgaggccttcccttgctaggtccacccagatcaatcaggatcatctccccatctcgaagtttaactttatcacatctcagagttccttttgccacgtaaggtaacatattcacaggttctgagaatccggacatggacatctttgagggtctattgttgtgcctactatatccatgaataataatgataataagcaccattttttgagagtttgccatgtcagatattcttttaaactgtattttatctcgctgcctcctgaaaaaatccttccaggtgtatattgtccccatttttacagatgagagaactgaggcccagaaaggctaaatggcttgcccaagtgtatggtggacccaggttttcaaactcaggtgtgtctggcttcagagactgggctcctgagcccttaagccctttgttcccctttagaaaaagtcacctgaggctgagtggtgaagggatttatccaaagccacccggccactatggcaggacagatatcagaatacaggtcttccgatcccagcccagagccccttcccgtcatctagaactcctcctggtgtcagtaatgataacggcagtcactgatgtcttttgagcacttactttgtgttgagcacttacactgtgctaagcacttgacataggtcatcttagttgatccgtgtaaaactctgtgaggtagtgaccaacatttctcccaccttacagaggtggaaactgagggttaggaagtttccttgactgtcctcaaagtgcacagcttgtgaatggaggagccaggatgggcgcccgctggctctcctatcccttcagttatgtcagcgtcccccgcagcagcccattgtctggttaggtcccgtcttcaccatggtgccaccttcatctgcctcttcttctgccttccagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtagtgagtgttactgggcattgctgttcaggtatgggggagcaccatcaaggctaagtgtgggagcaccgagctgggctctagaagtctgggcccagcttcgcctctgccaccctgctttgcaacactgcccagatcccttcccttctgggccttaatttcaatatgtgatgatgacagccacactttattgactggcctatgtgctgggtctggtgctatgctttccggaatgacctcatctaatctctacaaccaccctggcgggtaggcaggaatgttattatctccattatccttgacttgaggctcagagaagtgaagtaacttgtccaggaaatggcagagctggggttcacaaattgcatcattctgattacaggttttctgcctcccaccagtctatggatacacttcagaggctccctgaaaaccttgaggtcacttgcagaaagttttgtgtagtatgtgtccgtatcaggaacaacaccaaatcagaggtgacttgtgccccatcagagactttaacaccccaaccagatgggaatttcaggacccaagaaatagaaagtggctgcagggttacaactactgttggattcctgaggtagcacagtgtccaaacaggatttcagcactacccgtattgcttagagccccagccaaagatgtgaggttttgccctttggagaatctgtgcccctgaactcgggggcctctttccacatcttgggggcaggcaagggcagagggtgtgcctaggcctgcggatcagcatgcgacagattccccaacatccttccagcttgaaaggggattgccctgcttctatttagaacctataggaaagcagaagttctagattgaagttaaaattgattcccagcctccaggggctttgggctacacctggatgaccttaattgaccctaagcatgggacaaaccacttcctgagagtattaggatggtatacatcttctctgggggcaaagcaacaagatttatttttcatcatggaccaaacacatggatacccactagaaactgtgtagtgaattttgttaaccctgacatagggaccatggtctttaggttaaagcataataacaacataatacataacatatatagcgaatatatatatgtattatatgcaatgaatgtaaatatgattatacccatcatggtcttggaggaaacagatgacacacttaaaatgggtgttttgaggagagtttgaaaaacagattgtttacaagccatgggcaggagttaggaagagtgagagggttggtgcaggggcctggggttagtaacagctgggggagggtagacttgaagggggaaggggagggagactaattagctggggggaaggtatggagacggctgcctgagcttctgcaaagtggaagaataccgcttggccctaactcctcaccccaactcttgctcctggccagcgccttccaccagctggacccatcagggaggccgagtgggctgtctgctggagtagtccccaggcatcagcctcccaggagccagggacgggtagagaagggggagagtggatctggccaggcaaatggaaaacagccagcaccaaactctatttccctaggagggaggatcatgatactttgagtgggaatttggaaacctgtctgttggagcaatttccctgatagaaataagaatgtgcattttcctgggtagtagactcagtttttaccccaagaggccaggcatcactggcctgtgtgatcctcataggccagtccatctctggaattcttgaatggatcatccatccttgattagggatgtccccgtgattaccagggtgtgcagaagggctctgggaaacctgtgggtctgtctctgtgttcagagaaaggtgagggtggcctggttctagctcatggtgctcagactgtggtgtgtaaaggcactcgtggcaatgcagattcctgggcctgcctctagtgattcccattcagtaggtttggggtggggcccaggaaatctatatttttcacagacacccctggtgattctgatacaagtggtctcgccctgggagaactactggtctgcagcaaccagcttggttttccattagcaattactgtccttgagcgagttttactgctcttcaccttacacacactaaaactgccaaggccgtaggggaggggaagcaaccatgaggttgctgtgagtgcactgtgtgtgtgtgtgtgtgtgtgtgtgtgtgtgtgtgtgtgtatgagagagagagagagattgagaaagagaggaagggaggaagggggagggcacaggctcctctcccacagtgccaacctgcctctctcccacttgaagtgtttccatgccaactgaaatcctcagcctctaggaaaccctatatacacagtgcccctatataggtttctttagactctggctctctcagactctagagtgatggctttaaaagttttttgaatgttacccacaatgattgagaaagagagagagagagcacgcaccaccatgtaaacatggaacctaagtttcacaaaatgacttcgctttatgaactctgagacactctgctctcttctgttctgttctatttccattttagaaatgctgctcaggaccttcaaaatgatttgcatgacctgcaacctgcagtctgaaaaatcactgcactacagaagtggccataagaggccctgagggagaagctgcacaatgtcatggttaagagtggggtttggagccaagccgcctaggctcaaagcctttatgtgccgtacaaccttggcaaagtcacttcgcttgtctgtgcctcagtttctttctcacgaatgctcataataatggttcccatttcactggcttgttgtgaggatgaaatagtgttattattgagaagtggtaagggtagtgatcagtgctagcgatcatgattctaggtgacttttactgtgtaccgggtgctcacaaggctttatgtgcacagcctggtgaggctgataatactattgttccctctttttttttttttgagacggagtctcgttctgttgcccaggcagggggtacagtggcacaatctcggctcatgcaagctctgcctcccgggttcacgccattctcctgcctcagcctcccaagtagctgggactacaggcgcctgccaccacgcccggctaatttttttgtatttttggtagcgacagggtttcactgtgttaaccaggatggtctcgatctcctgacctcgtgatccgcccgcctcggcctcccaaagtgctgggattacaggcgtgagccaccgtgcccggcctgttccctcttttatagatgaagagaccagcaaataactagtaagtcgctgatcaggatcacaatatccagctgaggcactccagagcctgagctgttaaccattcagtcagggcctcccaagtttgcctaaagataaagaatcatgtgcacagttgttaaaatatacagattcctgggccccaccccgcagatacttgattgccagctccagggtatgggcctgagaatctgtcttttagggaagctttcagatgatgttgtgatcaggtgagttttgggaatggtgccccaagaggagtggcagacagggcttgctcggcagggactagcctgttggagtggtgccattggggttaaggactgggcagcagggcctcactaaccacagcctatatgcctgtttctgaagttttggccactctcatccagctggtctactgtctgctgacctagatgatggtaaattgtccccaggggtagcctgtctagttcaggctgcacctttcgcatatatcagctcctttccaccatcatcccctttgtgaggctgctgtgattatcatgttccttttgcagagatggaaacattgcctcaaattagctctgtcatttcctaaggattccagggttctttagtagggggtctggatcctacgtcctgggccatccccatcatagtgcaccacgtcacctccctggccagggaccgtggggtctccacttttttggggtgctccatctatgcagggtttcctggaagcacagatgctggcacttcagggatgaatgaaagtctttttgggggatttgtagatttttttcttgtcttactagctccattttcaaatgtatttattttgtctctttagtttgcgcgataacaatatctcagaccgaggcatctgcaagctcattgaatgtgctcttcactgcgagcaattgcagaagttagcgtaagtcagcctgggctgtggacaatgggctccaagtgccctggtctcaccccaggtcgtgcagcctgggaagctgtgagtgatgggctggggcaggggctgtttgcatgatggggggtgcaggtgattcctgcccagaggggaagggcaaccctgggatttggtgctcactgtccaatgtgctttgcttctgtgtctcctctcttctggaactgaacagtctattcaacaacaaattgactgacggctgtgcacactccatggctaagctccttgcatgcaggcagaacttcttggcattgaggtgagcccaggttttccttattccctggaaactattttttgccccattcctgagtcagtctgatctggtcttggcctggcactgcccacactggctcctgacctcctgattgaatgcagggacagtgtctcattttaagcaggggttctctaatgctgtgatctccccagtaaactctggactagctctgctgaggacttcctgtcttttgacctttagcccgtagggcaagaaagcttttctaggcccctttccttttctgtgtctaagagtgtcacagctttctgggtttactgagttccacgatgcatgttgagctcgtcctggtgggggaggcatacacagttacttgccaccccagctgtggcagcgagttgctgcaacactcccaggaggtcctttcaccactcagagcatgcaaggtttgcagtccatctggttctgcatttctgctactccagtgtctcccagtttcaacaggagtctctctctctcctacctgatgcctttaaattgcccctctagctggccgctgggttggcctggcttctctctccttctctctctctcagatattcttgcctcctgtgatttgtgaggcagtaaaaaaagacaaagtaaagaattgcttccatctattcttttacctcttgggctgggtttgtggatgggagccgccattttaaaatggcgggccacatagctcagtctcggcaagggctactgagatcagaaccacaggtgccaatttgtacaaaggactcagtcctgctaccactgcctgatccctcagactcacaagcctggaataggctgtggccagacctggctggcccatccctgagaagggtgctagtttcagaaatggaggctgagtttgtggccaacacagtagtcctccggtatgtgcaggagagatgttctaagaccccagtggatgcctgaaaccatggagagtatcaagccctacacataccatgcttttcccaatacctacacacctgcaataaagtgtagtttataaattaggcacagtaagagagtaatagcaactcataataaaatagaacaattataacaatcaatgtactataataacactatgtgaatgtggactctctccatctccctcaaaatatcttcttgtactgtactcacccttcttcttgggaagatgtgtggtggtaaaatgcctgtgtgatgggaggaagtgaggtggatgacgcatgcagcactgtgctctagcgctgggctgctgttgacctgaccacacttcaggaggagaatcatctgctcccagagatccctaatctttgagcaacaatgaggtcggcagctggatgtcaggagcagacgatcttgatgattaccaaatgggagcgtatagagcgtggatgcgctggacggggggctgattcacgtcctgggtgggatggagctggatggcacgtgatcagaatagcatgcaatttaaaatgtatgaattgtttatctctagaattttccatttaatatttttggactgcagttgatttcagataactgaaaccatagaaggcgaagctgcggataagcagggggcagggattaccgtatatcattgtaatagagagcacaggctctggagccagactgcccgaggtttgaaccctcattagctgcgtgacctcaggtcagcccaatgtctgtgtgcctccgtttccccttctgtagaatggaggtaataaccctggctacctcacaggctgtagtgatgagcaagcaagttaatccacatgaagggctgcaccgtctggcaggggctttatatagtaagcgagtggctgaaagatgatgggtaaatcacacaagcactcagcttgtttctccttatgtgagtccggtcctccaagcagggattcaatgtgccacccatttattggggaaaagtcctaaaaggggaagtggggaagggagctgggggaggctgggaggtgtgtccctgagtgaaggagagagggaaggaaggaaggttgagactgggcaccttggacttcagtgcagtcctaagacatcttggcaaggctgatgaggagttcttgaaccaaattcaccaggcaggggagcctgatgtctcaggcaggggctggcaagtgcagatgcgaggatgttagattttggagcacagcagctggggcccttggctacctccaaggagctgaggctggagacctgaaaggcgagttctcctagctgccacaccccttctccaaggatacaataatatctgccttataggattgttgtgagctgagtggcttgacgttccttgaaagaatgaaagcgtatagttatcccaggaagcctagggttgcaggtgagagctctggggcttctccgaagctctccgaggtgtctggattcagttgcagcaggagccttccttgctgggatcttcccccacccctagccttggccctccctctctccttcctttctggaaggctcagtgggccccacccctccctccagccacctggacctgcccagcgctcttgtgcaacaggtaaagcctacctgtagcaacaacagatctgggaaggctgcagagggcacgatggggtctggatcgagggcggctgagaccagagggaaaggtgtgaccctgagtcaccctcgctgtcccggggaaaccacctcccaggacagctgcctactgtggctcctgcctggaattgtcacactgctgtgcaaacagcgtcccgctgcccctttccctttgctgggggaaaatgaagttgtgggagccgctgagtaaactagacctagcagcgagggcacctgatgtggctgctgcctcccgggcaggtcttcaatgctttcttcctgtgtttccctggccagggcacagacggccctccttttctgcctgccgctgtgttctctcagcctcctctgtcttcccttccaggctggggaataactacatcactgccgcgggagcccaagtgctggccgaggggctccgaggcaacacctccttgcagttcctggggtaggttggattccaggaagagggacctgcatggaggggcttgggacttttgaggatttaggggcaggtgaaactcttcagccaggaggccccagaggcagcccagctccagtggggaggacaagccagggagagagtgggcggcccttgactgccaccttcatacttggtctatgcctgacaaacaggaagtttgggatgttggggctaggggaggacagtgcccacgagctggtgacaggaagccctctgatcctcagggggcgctagggctgtactttagctgcatattaaaaccacctggaagcttctaaacactattgccaggcctcccaccccagactgatgaaatgcaaatatctaggtgcaaggcccaggtatcaggagttttaaaaagcttcccaggggatgtacagccaggggtgaggacccctgacctaagaaagagaaggaaatggggaaggataggaaggcacccaggataagaggggctgtgctaggtccctcggagctcttgctccctgtaggaccatgctagggcctgccagggaggggagtaccccaacctgcagccccagggtgggcttcctctgtttgctaggcacccaggcttgcacctgtgctgtttccagcagcctctctcctatcctgtcatgccctagtgtgaactggagtccatttgacaagaactgggagttttagaacctgggactgtaggaagagagaataaccttagggcctaggtgttccagcccatttcacagggaggcaagttgcccccaagctcagttttttgttttgttttgttttgtttgagatgtagtctcactctgttgcccaggctagagtgcagtggcacgatcttggctcactgcaacctccgcctccttggttcaagcgattcacctgcctcagcttctcaagtagctgggattataggcacccaccaccacgcccagctaatttttgtatttttagtagagacagggtttcaccatgttggcccggctggtcttgaactcctgatctcagatgatccgcccgcctcggcctcccaaagtgctgggattacaggtgtgagccaccgcacccggcccccaagctcagtttgagccacaaatgggactatgttgctctagaaatcaacatcttttccacactgcattagtagcaacagagtctagaacaaaggaggccacagccccactgaactctcttctgcttgaggtcacatctgccacatcaggggtatttacctctttcaacacatatttattagggcacctgtctgggccaggcgttgtgctaaaacccccaaacgctgtcatatgatacaaagtgttctgtaacttgcttggttttttttttgtttgtttgtttgttttgttttgtttttgttgttgtttttttttgcttcgccatatattataggaatttttttaggtcattatgacctctttatttacttaattatctatttatttattttactaatatttacagaaagggtctcactctgtcacccaggctggagtgcagtggttgcaatcatagctcattgtagccttgaactcctgagctcaagtgatcttcctacctcggcctcctgagtagctgggactacaggcacaagccaccatgcctggccgatatttttatgttttgtagagacggggtctcactatgttgcccaggctggtctcaaactcctgggctcaggtgatcctccctcctttgcctcccaaagtattgggattacacaagtgagccaccttgctcagcctgaccgcatttttcaaagagctgcagagtgttacataatgtatttaactggtcactttttgatgactattaagttgttttcaggttttttgttattacagtgtcatatccctggggcacagagcagtgctggcacatagccagagctcaatcgatacatacctaatgaatgaaagtacagtggacatcctaattcagccattctttgctaacttgtgtacatacctgtccagggtaggtccctagaatacagtcaataagtcagaaggtgtgagttgggatctaccttttggaaagggatgttttcaaactacagtgagtcagaggaggatggcccagaagctgggggagttgaagctgatggcgtgaaggaattaggggtgttaggaagaagcaggagataaagagctagcttgcagaagaagtgttagacttgttatgggcaggtactggagggtagctaaggacttgtgggtggcagttaccaggaagcgtatctgaactaagtgtcagaaaaagtgtcacaactgtaaattactcttgtcagtgagttcctgtccttaagggttagggctgggtagccctctactattctctaagtctgtaatgtaaagccactgaaaactcttgggttaagtttggccatcccacccaaaagatggaggcaggtccactttgctgggaccaggagccccagtgaggccactctgggattgagtggtcctgcccctctggctgggactgcagagggaggaggactgttagttcatgtctagaacacatatcaggtactcactgacactgtctgttgactcttttggccttttcagattctggggcaacagagtgggtgacgagggggcccaggccctggctgaagccttgggtgatcaccagagcttgaggtggctcaggtaagcttcagagtctatcctgcagttttcttggggagatcaggtgaagagggaggagctggggccagttctgaaggtctttgaactttatttctaccccacaatgttaggcaatggagtaaggaaaaaagaccattggatttcaagagaggacactcgagtctttctgggtgacttggaaatgtcccttgtcctctcagggttttgatacagtatctgtaaattgaagatattgggctggatcaggtacattttatcttaaggaccaattccaatccattggtagtgggtgcccagtgcaccacattaaaaagaattctaaggctgcacctgggcttaaagaagagcactataatcaattagtgatgtctaaaaaagctaaaaaaaaaaaaaaagagcactgcattcaattagtgatgtctaaaaagggtagaaaaaaaaaaaaaaagaaaaaagaaagagcaccgcaatcaattagtgatgtctgaaatggagcagaccaggagagcaccacgaattttgccctccataggttagctcatctctgaggtctttccctgctctgacatacttttgttccatgattacctccagcctggtggggaacaacattggcagtgtgggtgcccaagccttggcactgatgctggcaaagaacgtcatgctagaagaactctggtgagtttgggggattctctgctctggggaagtggatcacaatctctgttgatcccctggcctcatccataggagcggttgtgtggacagacaaaggtggatgattgagtgattgactgattgattgattgtgtttgtctttatatgtactgagtggtatgaagcttatagagcctggtatgtacatgctaatttttttatttaataaaatatatgggtttgctggtttggtgactgcctccacatggcataagtgttaagagcacagactctgtaatcaagcaggccgtgatcttaggcaagttaaataacaatttcagaatctcaagtttcatgtctgtaaaatgagggtaagaatacttccaaccataaaggatttttgcaagaattagataaagtagtgcctgtgaagaccttaatatagtgcctggcatatttgtaagtgctccataaatgttaaattagaataatggcagggttactactactattactgctgctgctgctgctgctgctgctacaactactatagtactgtgactactactactaataaagttttgttattttaaagtgattttgagttcctaggagcactgggtattcaagtcttaggtcattttggaaggtgtaatggagttttgatagttgaaagaggaaccatgaatcatgcttatactgttgacctgaagcagattctaagtttctcatcctttagatgccactagtatagttttctgacatgttctgggcagcttcagattatgtcagggagataaaatactgaatgtttgattttcccgggaagcagaaaggcactgcaacatatgggcattgccataaacagattttatggatggaccttggctgttgcagggcttactagctctactcaagtatgattgattctatcctgactggattttgccacttggaatttcttagtagaggagaaccttgttatgagagcatcagttatgattactgttaaaagaaaaactttaggcaaattaaatttagcagaactggtttgaacatacagcaatttatgaattgggcagcattcagaactgggagtgctccacccagcaaggtaggcaagcagtatctatagacaggaaaaggaagtgatgtacaaaacagcttgattggttgcagctgggcatttgccttatatgggcatggtgtgatgaggcattttctttatatggatatagactgatcagctggtagactgtgactgactgaagcctggctgctgtgattggctaagacttagctgtttgttataaggatatgttgttaggttgcagtttgctacataggaactcaaagtacagaggcagtctcaggccaaatttagtttaactatatgttaagctgcaggtgacagaatacctccatctatagaggtttaaacaaggaaagggtttattttttcctgtataggcagctggatgtaggcagtgtagggtttgtacagtggctacaagaggccaggaggggtctcagctctgtctcattctcttcctgttccatcatccttagcctgtgacttcattcacatggttggttgtctcatgatcacaggatggctgctccaggtgcagcactacttctgtattcccggattcgatctatatacccaggaaagccatctgggttctctcctttaaaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataaggaagaaaggaaagatggagatcaggaagctgggggatcagggaacttattacattgagagcccttggagtgaattctcttgcaaatatgtccctggaattgagaatccccacaacgtactttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgaataagatctgggccgctctccgctgggctaactcatgtgaggtggcctggtagaacagcttgccttggtctaggtggacaaggattccagtgcaagttgtttatctgggaggtggtcccagtaaatgctgataggagagtggtgaagtgagatggggaagtgaaggtaaccaataaaggggagttatcaagccagttatcaatgagggaaattggagctcagtactctggggcactcctggagccagtgcagaacacacatggtcacctacccaaccaatgggcaagaaagccatggcatttatccaccaaccctctgtccttcctatgttgatgtgcgctcatggggcactgattctccagcacttccagctcaccctcacccagctgaacatgcttctggggtcaggagaatggcctcaggcagagagtggaaggtcttctctgcaagcagtggctggggaggtgatgtgatggggagtactgtggcctcctccagtggctgactcagtggcttgggacttgtgccacaaagagatggacagctcaggtgaacatgaacccacctagtgaccatcatgggtttgtcagggtgctctctgaggctgatgccaaaattcttatttcaagtagacctcaggaaccccatcagatggctccttttgctggaggaaagtggcatctgcctaggcaaatgtggtcctaggaaaacgcttgcctttagagacagacagacagacagctgcctctgtgagtgccagctttgctgccaggctgctacccactctggcgacactcatttgtgttgctttcacaagctaggaagtttccaaatatttggagaaaacacttccactaattatttgggtggaaatgggctgggaagttggggtgaagcccggatgtgtctgagccagatgccagctttgcactgagggtcggcctttgggaataccaagcccattatcaaccaggtgtggatatggcaggtttgtcttccctccttgtcacagccttactccacttgactcccatggatgccaggcaatgaggctggggttggtcccatgccaccctgtcatcagccttatttttcagcatcctaaactatatcatcccccacaaaaattgaacttctgatatatcttttataaaaaagagaaatgcctacatctttcttttccaggcttagtttctgccaagagttggttgagagcccaggcttgctgggtgcagtggctcacacctgtaatcccagcactttgggaggctgaggcgggtggatcacctgaagtggggagttccataccagcctgaccaacatggagaaaccccatctctactaaaaatacaaaattagccgggcgtggtggcatacacctgtaatcccatctactcaggaagctgaggcaggagaatcacttgaacctgggaggtggaggttgccatgagccaagatcacaccattgcaccctagactggacaagagagaaacttccatctcaaaaaaaaaaaaaaaaaggatgagaaaaataataatttaaaaaaaagagtccaggctctggaaccagacagcctgggtcttacccctgctccaccattaccagccagttcttcttggatgagtgcctcagttgcctcaagtgtaaatggagataatggctggaccttcattataggccatgagcattcactgagagaatgtagctaacaaaagtgagttgtaggttggagcaaaagtaattgtggtttcagaccatgaactttaaattattataactaggctaaaatacatctttattaatcaaaataggaaccattaaaatcaacacatttttgccaataagaaataagtttgtttattcctgtagcataaaaattcatgcttcgggattcaacaaactcttggaaagcattttctgcatcctcctggttgtggaagcatttttcctgcagaaagttgtcaagattcttgaagaaatggtagtcagttggctagaggtcaggtaaatatggcggatgaggcaaaacttcatagtccaattcattcaacttttgaagctttggttgtgtgacatgcagtcgggtgttgtcgtggagaattggaccctttctgttgacgaatgccggctgcaggtgttgcagttttcagtgcatctcattgacttgccgagcatacttctcatatgtaatggtttcgcagggattcagaaagctgtaggggatcagactagcagcagaccaccagtgaccatgaccttttttttttggtgcgaatttgcctttgggaagtgctttggagcttcttctcggtccaaccactgagctagtcattgccagttgtataaaatccacttttcatcgcacgtcacaatcagatcaagaaatggttcgctgttgttgtgtagaataagagaagatgacacttcaaaatgacgattttcttggttttcactcagctcatgaggcacacacttatcgaggtttttcacctttccaatttgcttcaaatgctgaatgaccatggaatggtcgatgttgagttctcaagtagttgtaagaaaatcagctttgatgattgctctcaattggtcattgtcagcttctgatggcctgccagtacactcctcatcttcaaggctcttatctccttcgcaaaacttcttgaaccaccactgcactatacgttagttagcagttcctgggccaaatgcattgctgatgttgtgagttgtctccgctgctttacaacccattttgaattcaaataagaaaattgcttgaatttgctttttgtctaacatcattttcatagtctaaaataaatataaaataaacagaaagtattaagtcattagcaaaaaatcataaagtgagaattgtgcattaaaatgatgtatagcataaccacatttatttaagaatgtattccaatatcaaatggcaaatttcaacaatgcaaaaactgcaattacttttgcaccaatctaatagaagttcaataaatactggcaattacaattggcattgccttagggtcaacttgtaagacattcctgaaattgtgggaaagggggaggacctggagtggacattattggaaggcaaagctgtaaccaaaagagcaacctgggaaacacatgactcctctgttgctgtccctggccctatcctgtctcccctccctgttgtcagctacctcatatgttctctaatctctgtctctgtgccctcaaagacccccctgaaaatagaaatattactgctcattggttattttctatcaattaagtactgtattagtccgttttcatgctgatgataaagatatacccaagactgggcactttatgaaagaaagagttttattgaacttacagttccacgtggctggggaggtctcacaatcatggctgaaggtgaaaggcacatctcacatggcagcagacaggagaagagggcttgttcagggaaactcccctttttaaaaccatcagatatcatgaaacttatttactgtaatgagaacaggatgggattcaattaccttccactgggtcgctcccacaacacgtgggaattcaagagatttgggtggggacacagccaaaccatatcaagtactgtgcaagtgttttaggcatgcagagagtggtgggtcttcccagcaagcagagtgtggggaggtaatgggggactggtggctgacttaatggcccaggacccatgccacaaggagatggatggtggatgtgaataggagcctgcttacacccatcacaatttagattcttatgctcgatggcacgggtactcttttaggcccattttaccaatgaggagattgggactaatttgctcgagatcaaaaaagaagtggtgtaggtgggatttaaacccaggatgtctagcactaaaatgcaggtacttaaccactatcctaagggagtggctacttaatttgataaactcatctagtgaatggaagagagacggttacatttcactgatggtactgagcctttgttgatgagctcattgggaatctcagacatgagcaggatgtgtctaagggacaggtgggcttcagtagactggctaactcctgcagtctctttaactggacagtttcaagaggaaaaccaagaatccttgaagctcaccattgtatcttcttttccaggttgtccaataactgcatcacctacctaggggcagaagccctcctgcaggcccttgaaaggaatgacaccatcctggaagtctggtaaggcccctgggcaggcctgttttagctctccgaacctcagtttttctatctgtaaaatggggtgacgggagagaggaatggcagaattttgaggatcccttctgattctgacattcagtgagaatgattctgcatgtgaaggatctgattctctgtctaagaaagaagtctttacctctttaagtagggagcaatgatttcatttttaaaccttgactatttattcagcaacttctctgctctatgagatagtgtaggaatggggatgtggttgaagaatgaaaagaaaagtcagctcccgccctcctagaaattgcatctgccttcacaggtcaaggatattggatcagaccttctgcggttctgaatggagattacacaggttaggagcaggttgcacagtgtttccaattctctataattaaagccatagactttcatgtattgaaaaaagcaagaattgcattcttgacagattctttcattgccttaaaaagaatgactagccttgggagtctgggcagctgggtccagtgttgtagactttctctctgctgagccacagcttcaaagatttgtccttcttgtttccagggatctatttctcagacaataagtaaaggctttccctggcctaatgtgctgtaagtgaatgctactatatatgttccaggcactgggctagagactaatatttaaaagccaggaaatttcctatagaaaatctatatctcagggttttctcaaaagagctgggaactctggatgcccattcatgattccagtagttaaccagagtacaagaagggctgagtcttctcagatgggcaaacccactctggctgactgcagatccaccaagcctattgtcttagaccaggaccctttggcaactcattcccataagcctgtgacccttgctttaaatatgcaggccttgtcttctctcaaaaagcacatcaaggctgcagcgaatgcagatatcaaatgatgaagttaaaaacaaaagctttgctgggcgtggcagctcacacctgtaatcctagcactttgggaggctgaggcaggaggatcactttaggccagaggttcaacaccagaccttgtctctcaaaaaataaaaaattcagctgggtgcggtgtagttcctagccacttgggaggctgggatggaaggatcccttgaacccaggagttcaaggctgcagtgggccatgattgcatcactgcacaggcgacagaattagatcccatctcttaaaaaaataaaaaatttaaaagtgacttcaaaaatctatgctgtgatggagagatttttccttctgtatgattgtgatagctctgtggcctatgacgtcatcaggttctgggcaaagtgtaggttttctgtttctttgtttttgaaaccattgcacagtcctaagaaacatcacattctgggtcctgggcaccagccaacatgaggttgatattttaaggggtctgatgttatttgctgcctgttgatggaacttgggagggcaccagggtttgctcattgcattcttgacagattctcttattgccttaaaaagaatcactggccttggggagtctgtggctggctgggtgcagtgttgtggactctctctgcagagtcatggagccttgttcagaatgcttcctgagctgccctggttggccaagggtaaaaacagccctgacttccctgcaagaaacactgcagctgggccagagagtcagcccatcccaggcatgggtttaaaaagtggaggcttttgtttgaaagccctgctctaattttgtcctcactcaaacctctgttcacttgatctgctttaggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaacagccatcttccttgtgaccaaacatttaaaaatattctggctgggcacagtggctcacgcctgtaatcccagcactttgggaggccgaggtgggcagatcacctgaggttgggggtttgagaccaacctgaccaacatggagaaaccctgtctctactaaaaatagtggaggttgcagtgagccaagatcacaccgttgtcctccagcctgggcaacaagagtggaactccatctcaaataaataaagaaaataaaaaataaaaatattactaaaacttgtcaaattttaaagcacaattttctacttgaagcggaggaaaatgatgttttcaacccgataatgtatagcttaaggcaaaagcaattcttagaaaatagccaggcaatcaaaacacttttggcttcagtttagaaaagtttaaccccgtgaagttttcagctgtgcaggagcctccccgtacccagcctaaaaggctgcaacacatgtgaaaaggccccttggcccccctcgattccctcaaagtggctccaggagtctttaacagaaggatggagaaggtttacttatggctggctctccacagcgagcagcctctcatgcaggccttgtgttaaaatagtgcttagctgcgtttaataagcaagggatcaggtggtcacccagcaaggtaaaatcctacttccttgaaaggttttgcgtctggctgactcggtggtgtggcatctccctggaccctgcatgggagtgtgtctatgggttttctttgtgattggtgccctgttctgcccagaccattgtttctgatacagcagatcaggaggaaggtggtgttgagtctcctttcgctgaggagtacacacagcagcccatttgcatagcactgtattgggttgtcagtttgtcatctttaaattcattcagcaatgaggccaggcatggtggctcatgcctgtaatctcagcactttgggaggctgaggcagctggatcacttgaggtcagaagttcaagaccagcctggccaacatggcaaaaccctgtctctaaaaatagaagaagaaaaaaaaaagttagctgggtgtggcagcgcacgcctgtaatcccagctacttgggaagcagaggcaggagaatcgcttgaatcttggaggaggaggttgcagtgagctgagatcatgccactgcactccagcctgggcgacacagcgagactgtcataaataaataaataaataaattcagcaatgatttattaaccagttatattaggatgaccagtggattgacaaaacagacatggtcctcaaggtgcttaggtgagggtggagggagaggcaggcagaaaacaagtcagttgaaaaagacatgaaaaagtcttcatccaggcactgtggctcatgcctgtaatctcagcactttgggaggccaaggtgggcagatcacttgcggtcgggagttcgagaccagcctggccaacatggtgaaaccctgtctctactaaaaatacaaaaattagccgggcatggtagcaggtgcctgtaatcccagctacttgggaggttgaagcaggagaactgcttgaacccgggaggcagaggttgcagtgagctgagatcacactactgcactctagcctgggcaacagagcaagactccgtatcaaaaaaaaaaaaaaaaaagtcttcaggctgttaaggggctggtccgagacaggttgtctgaggaggtgccaggtaagctgtgtccccaagaatgagaaagatatggccaagcaaagagtgagagggaagaagggagcattctagtaatgggggacaagaggtacaaagaccctggtgagggaaggagcgtggtatgcatggtaggctcaatagtcactcccgaacatatgtagatcctaatccccgggacctgggaatgttgccttacctggcaaaagggactttggaggtgggattcagttaagggtcttgagatgggaagatcatcttggattacct

SEQ ID NO: 14952 - DNA, 32495 bp, Human
ctaaagaaatcaccatggatgtgcacagattattctacaagattgttcataacaacatagtatataatataaaaatataattatcccataacataagcttgattaaaaaaattatgataacaatatgatgaaaaaataccacgaagccagtaaaaaaagtgtgcaataattaatggcatagtgaaatactgcaatataacgtgaagctaataaagcaaataagatcctgttttttgtatgaaaaaatacacatacatgtaagaaaaagagacatcaaatattaccagtgattatctctggaaacagggatttgggtgattttaaaatttgttgggggtaatatttttacttttctgtactgacctggcataagttccttaatcgctgtgtgcctcagtttcctcatttgttaaaagaggaggttccaatggtatgtaccccctgatgatgtgcaaaagtgattatgaaactattttcaaaagtttctacaaaagcaagttacctctgtaatcaggaaaaagtagttcttttagtgctctgaatagtgtaataataatatttattttatttcattttattatttacccttgcagaaatttacttcttcggtaaaagacagactaggcatgtgcttaaggagccagcaaatgaccatttacattaataatttatttaatatagaaatttttattgaagtgatgacttctaaatgtgatttttgggggcattatacacttgcttcgaggtttaatcttcaatccacatgggggggcaccataatcactggtgcccagggccctcgtctagcccctgtgaggccctttgcagtccctcccttgccagcccctccagcctccgccatttgccccgtgggctctccaggttccacttgaggagctgccccctgccccagcccagctctactgctgtgtgacctagcgtaagtcccttaaccgctgtgtgcctcagtttcctcatttgttaaaagaggaggttccagtggtaggtaccccctgacgatgtgcaagcatcacagaaatgacacaagacacacactgagaacatgcctcgcgcgtggcaagtgctgactgttacctgccattattaggctcccccgccggggtctcagggccttggcacaagctcttccctctgcttggagcactttcctccactgacctttcctggcgctccaggtcaactccaggagccttcccagtacagtctaggtgccttctccttccgcagcgcctgaaccacacaggaataagtaaggcgagagcgcgcccagagaagagcagagagtgcagaaaggggctgagttagtagaggcatttccgcggggatccttctcctgccaggcctgcaccggggccgtggcgactgagaagtgcacaggtggctcccgggtgctccagaagggccccagagctcctggcccggctaaaggcaggaggcgggtgcgcgtctcccccgcgaagctggatcagtactgggggcgcagggggcgcacgccgcgcagcgagggctggcgggggcggcctgcctggggcgctgcccaggctcacgcgggagccaggtgggggcgcggggaggagcagctgagcaggtgccgggaaggaggcgcctgcagcatgccatggcgacccgcgcacgcgacggcggggcggccgggtggcaccactggcgggaccggaagggcgccgcggccctaggatctctgcgccgaggcccgcggcggaagccacgacggccatgaccacgctgacgcccaggctgcgagcccctcgcccgggccgcctgcccacccgccacgcccaggtagcacctcggggtcgccccacccgcgacaccggccgcagccccgggccccctcgcaggcgtggcccccgctcccaggccccgcccccgcccccccattggtcagtcccggggtgggggcgggcgacgcggaccgctgggcagggcagggcagggactcgcgggaaccgcaccaagcgggtggctgcaggagctcgcccatcgcccctgcgctgctcggaccgcggccacagccggactggcgggtacggcggcgacagacggattggccgagagtcccagtccgcagagtagccccggcctcgaggcggtggcgtccgcgtcctctcgtccaggagccaggacaggtgtcgcgcggcgggcgctccagggaccgcgctgaggccgcggtcgccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatgggtgagtgcggccgcccgcgcggggaccctcggagtaagctggctgcaggggaggggcgcgcatccgcgggctgtgccgggccctggccgaacggggaatcacagacggtggacgcgaaccacaggggagtgggaccgccgtggttagggaaggtctaagggtcatgggggccccctgggctgcggggtggtcaggagcagagtgtgggggactgtggactcccaggcgctgccttcaccctgccccaaacacacccaggagtaagaatcaggtgatgtctttgcccacctgggctgccccgggaagacagcctggtcctggggagacaggtgagtaaacagaggccgggatgctgtcactgtgataagggcagtactgaggagagggacaaagttcagcgtggaaacctgtggtcacatcggagtgaccagagctgagtcgcgtgccctgagtccacagcaggctcttctctgtgcggagcctgggtggggtgcggctgtcaggggggcggctggggaaggagcaaactcagctcgctggggcagggactgttgccttgtcaccctgggcccaacacctgggatgtgatctggtatggggtgagtgtccagtcctgtggaatggtccagtgggcagctggacccactttgttctcccaggcaaagcccggcttttcctgtctgcaaatatcttgtatcaaaccctggagctatttattccctaagatctcagagattttttttccagtactaaactctttggtctatggtcatgtagttactattggtcaggtcacccatctgctttgcctcctgtctgtggctagtgacagtctggggtctggggaaccaaggaccacagatcagcccaaagtcggggagctgtggggctgagaggagggagagggtccctggccccggccatcagcctccctccacagacagcatcattaattcttcatcctcccgacaaccctgataacagccacggtcttcatccccatctcccagatgaggacagtgaggctcagagaggcagcgccatgcctaggacagcgcagcctctacgctgctgagccaggacaggcccaggaagcctgactgtccatccagggctcaatgagatgacatttctgttgtcaggtcaggctttcagggtgcagagagctttctgaggagtctgggctgaggaacacagggtactgagctgcagcaggtcttgtggggccatcagccatttgcttcctacactagagcagaagagggcatggccaagcctctgcttcccgcaacccagagctggtggtggaggcgagcagcagaaggcagccattcaccatcgctgagcgcccagtgccagggacaggactctagccggtgggatctggatgctgcctttgtagttagaggacagggtggggatgtgggacagaggagaccatctgtgaagctggggctggggctctgtcatcaggacaggctgacactgggctcaggaccaagaagagttgtggatggagtcgtccaagaatgtccccagggagccgcccatcagaatgcgtcaccacccagcccacatccgacctcccctggcatcccctgggtcaaggcatgcacagcctggtggggctattgctatgaattgggcagggcctacccctctgtgtgaccttaggaaagttcctcaccctctcagccttcgttgctccttgtaaaatgaggtgcctggtgatctgtcctcagggttgttgtgtgattggtagaggggcaggagtagaaagcctgtgctgctcccctcagagggtgaacctggacctgggcactgttggccccaggccctcccagctgtggcctagttcggaggtgacaggaacatctccacatgtcttatacacatgtaaaacctagaaatggattctaaaagccaatcaaaaagtgtttgtacctgtttttagaatgaaaagtagcatgtgaactttcacagccttacaattcctcatttaactcacgtgagactgttttgccagccctgtttcatgggctcagagaggttaaatagccagcccagggccacaccgcacatccggggtgacatccacggctgtggatttcaaatcccagcttcttcccacaccagctttgtgcatttcatgaagacttggggcctccagcgctgcgagattaacaagcagatcattgttagtggaagcccaggctgtgggtgggcgcagccagctgtcagaaaggccttctttattctgctgtgctaactgcactagtagaactctctcagttagagtagctttaactggtaattactgaggctgggtggggcggtgggggggcatggattagacacataccaggatgctctccatgtttggaggcccctggaggttggtggcccttctcctgcctcagcctcccgagtagctgagattacagtcatgtgggcagaggccaccacgggatctaatagcagggtcactgtggtgtcaccgcccacacgcaggctcccacacctgctcctgccggctccacctctcctatcagcttcatctgactcctgaatagccaggtctggtgcccgtagggcccaactcttgatggcagcctgtgggacccagggggcggggctctcataggcctcccaccatggctcaggtctccgtgcagagcaggtgctttaggaagccaagcctgcgtcctgatgttcagagcctgcactgggaggccagggctggggtcagagccggggccctgcctggcctgtcatccatatcagcctgtagacctgggctctcttgggcaggacagtgatggagcggttggattctgtccctggtctctctgtgctcagggaggggagagccctgagctgggaggcaggacccaggttcttgtgctgcctgggcccaccattaactcctgcatgtcctgagccacggcccttcccttccctgggcctctgctttctcgtccattctacggtgatggcatcagaaaagcaaggtgcctcccagccctgaccctgtggctctgtggcagaggcgccttctcacaacaccgccatgccttggccccagtgcctcagggcagcccggcccctcctgagggaggaaggatggcaggaaggaccacctctgcacactccttctgaatccttctccacccatctcagcagagaggcaggtgcccatgttccagattgagaaactgaggcataagcaggactagcaggcagaagtccagccaggatcagaatgcaggcagcttcatttttgtcctgatcccttcctgaaccagacagatttgctcctgtggtctccggtggccatggacaggggtgttgatgaacagagccgtctggatttgggagaagcaggactgagtgggaattcgggacctggcccgggtcctgctctgcccttgccagccgtgtgacctggaacggtggcaccatctccgtgggccccagggccacttcctttggttctttaccagggacctctttcattttcccattcattcattcagcaaatagttctgtagcacctaccacggaccaggcagagttctagttgctggggatataacaatgagagaagtaaagtccctgccctcagggagatgactttctagtctagagacacataatacatacatgagccctaaaggtaattgtcgggtgtgctagacagcaacgccccatcgggaaacaggaggggctgaacaatggcaggacagacagggctagattgggggtttctgacctgagacccacacacaaggaatttgcatcctgacgccaacacctgatctcagtgtgatctgggctttccagtcaacctccccaagcctcagtttcctcctctgtaaaatggagatactcatcttatggggctgttgtgggcttgtgtgagatgatacccagcgatgcccacgtgcccagaacctctgcatctcttccttcattggtatctcacaattgccgtcacatctgtgtttgaaagagaggagagagaggctcagagcagataggtggttttcctaaggccacacagcagattgtccccctgcctccacatcttctgctcttctccaaaatagcagctgcctctccacacagcccagggcctggcccaccgttaaatgcagtgtgtgctgctgaaatggactgtgttgaatgggaacgtgtgatgtaaactgagactactgcttaaaaaatatgtttttattttcagagacagggtcttgctctttcacccagactggaatgcagtggcatggtcatagctcactgcaactgcaaactcctggcctcaagcaatgttctcacctcagcctcctgaatggctagaactacaggtgtgcaccaccatgtccaactaattgcttcaaatcttttgtagaggcgggatctcattatattgcccaggctggtctcaaactcctggcctcatctgatcctcctgcctcagcctcccaaagtgctgggattacaggcatgaaccactgtgcccagcgttttcttttctttcttttttttaactgcatacgttaatgctcactgttttgcaactttgttgtttttcatttaacaataaatcttttatccatcttaaaagtcaactattagggtgactgtatgcccaaaggtatttgtccttgcaataattgaaggtgggtcccttttccccaaagttctgtctggccaccagaatggtgcaccctttccatccctagtgactggtcctacccatttccgcagtgttttctcacccctgagtaaatgattatgactgccctcattcacagaggaggaagctgagtctcaaagagtgtaagtgactggccccgggtcctggatgcacagacccacaggagcagatatgaaaggtagatcacagctgtaggagggtaggccctggaagtggggcagcagagtggtggttagtgaccctggagtggggctcactggctttcaattctgagtctactgcttaagagctatgagctgttgaacagatcatttaaagtctcggcatctcagtttcctcatctttaaaactgggataataatgcctgtatccggccaggtgtggtggtgtgcggatcacttgaggtcaggagttcaagaccagcctggccaacatggtgaaaccttgtctctactaaaaatgcaaaaaaaattagccaggcatggtggcgcgggactgtagtcctaactactcaggcggctgaggcgagagaattgctggaacctgggagatggaggttgcctgggagacagagcaagactctgtctaaataataataataatgcctgtatcataatacaatgattaaataggttaaggcacataaaaacctagcaagtgtctggccaggcacggaagctcacgtctgtaatcccagcactttgggaggccaagcgggggcggatcacctgaggtcaggagttaaagacaagcctggacaacatggtgaaaccccgtctctactaaaaatacaaaaattagccggctgtggtggcgggcgcctgtaatcccagctacttgggaggctgaggcaggagaattgcttgaatccaagaggtggaggttgcagtgagccgagatcgcgccattgcactccagcctgagcaacaggagcgaaatgccatctcaaaaaaaaacaaaaacaaaaacaaaacttagcgagtgtctggcactgctcaataagtggctgtattatgagggaagggcctgcggattatgccccatcccccagtcatttacttagggacctagagcagagtagtaaaaagcatagctccagaatctgaccaggctgcctgggtgagatcctcattccacctaggcatccttgtagtggatgctgtggggggcttcccagagcttctcttcagcattgagtcgctcgtgacccagctgcctggagtgccggctgctgacagctcacaggggagtccttctctaggttttttttgtttttttttttttttgagatggagttttgctcttgtcacccatgctggagtgcaatggtgcgatcttggctcactgcaacctccttgggttcaagcaattcttctgtctcaccctcccaagtagctgggattacaggcacccgccaccacgcacggctaattttgtatttttagtagagatggggtttcatcatgttagtcaggctgatcctgaactcctgacctcaggtgatccacccacctcagcctcccaaagtgctgggattacaggcgagagccaccacgccctacccttctctaggtattgattgactgggcctaaagaactgcccaaggttaggcaccatccctggggacacccaccatccaacagctggtctatggcagtaccagtgcccagcccccttgccttaaagagagacagctctaaagggccaccagcccccagagctcccagtgtggtctcagttgtctgaggcctttgttgtgggtgcatccaaaacttgctcccttcattcactacaaaaagcagtaaactttccagttttcccagtaaactttccgacccagtgtctgttgcccagagagcctaacctaagatacaatttacacgattatggtctaatttatttaatgctctgagcctcagtttcctcatctgtaaaatgggagagctacctcattagatgattaggagtattaaatgagttaatctgtgtaaaattatgaaaagagtggctggtcagtgctcaataaatgtcagctttatttgtttttagcccaaggccagctggttagtggcaagaccagaagcaaaagttggtgatttcctttaactgctggctctatcttgagtagcagccgttccttctgaacagtcctggaccctgcacacatcagggttctggggaagttgatggctgcaagacctgggtgtggagaaagttgactcattcagggctttaagagcagtctatgaacactccttagcaagcactgctgcaaacctactgtgtgctgttcctcttcctgtttatcttgggggctaataaaagtatagccccagcccaacccaaagtctgctcatttactgagaaagagaagcccaaagacaactcaatataaatgatccccaaatggaagaaatgtccattcacccacctggcaaacatgggtgtgagggttcaacagttcagaagaccgacaagatccttctctcgttttctgggagacaaacaaggccaaaggagaggaggcatggctcccggctggagatggggtctcgctgtgtcacccaggctggagtgcagtggcgcgatcacagcttgctgcagcctcaacctcccagactcaagtgatcctcccacctcagcctcccaagtagctgggaagtacaggtgcctaccaccatgcccagataatttttaaacatttttttatagagacgaggtctcatgatgttgcccaggctggtcttcagctcctgggctcaagccatccatccacattggcctcccaaagtgctgagatgacaggcgtgagccactgcgcctggcctcttgcatgtttttgaaatgccagttcctgaagtgaaaatcccatcatggcttttcctgctcaggagcttctgtgtgtcccttcaagccagaatggaattcacgtttccccagcctggcattcagagttcagcgttctagtcaactgcaccgcttggtgctcccttgacatatctgcagcttggagaggtcgtggattaggagaagtgaatgtagactttggagtccagacagactttgacccaaatcccaccttggatgcttccagttgtggccttgtgcaaatcagttaacttctgggatctttagtgctctcatctataacctgggatgaataatgtcccccacagtgttgtcatggtgccgccttcaccatggccctcgatggtcccacttcctgagatgcacagagttctgtgtcccctccaacactgtgccagtgctggtctgtgtgaccaatagaatatgacactagtggtgataggtccctgccaggattagtctataaaagaccatggcttccatctctcggatgcctcgttctgggggaggccatgaggtgagcagccctatggagagggccacatggtgagcagctaaagacagcgcgtggaagtggatccgtcagccccagctaagtcttcagagactgcagccctagctgacagttgactgtgacctcataagagaccctgatccagacctacccagctaagttcctggattattagccctaagaacaatgtgcaacaatatgtgtttgttgttttaaactgctacatttgcataatgagttacacagccacagacaactaacacagtcaggttagcatgaacagaaaggacgtaccacgtgtgcccagcatggtgcctgacacaggtcagtgcttaaaaagtgtgacctggcacagcatctcccgcctctcagcctttccctgggtgactcttcagttctcttcctcagttcttccacccctcttgaatatgttttcaaggaaagttttctctgcctccttcttccaaagccctgtatgtgactgcgaccgtcactgaagcacctgtcctgcattgtgtgcacttctcttaggattccagtcgctttctgtctatgtgatgcaggggctcacctagcccctctttctcctcctccccagcaacctctgaacaacctgagaatagggaccaagtgtgactcttcctggcaccccccatggtgcacccagcccctgagtggcaggaaattgagggaaagaggaacccagcaggaggcagcgagtgccaagagcagggaggagcctgggtctggtcaggtgggacagagtagggccggccctccctgtctgtgtgcgggccgacaatgggtgccatagctccctgggccctcccctggaaccccaagtccccacagggccctgcctggaggaaggtggcttcacgggcattctcgggtgtctgttgataggagggccttgttgacgggtgacccccatcccaatatgtcccattgaactccagggccactcatttcacactggccccaagtgtgaacatccacatcacaggcctctaatctgacacgggcctctaatctaaccctggaaaccctctgtccctccttggcctcagtttccccatctctgcagggttgcctgaaggcctttccaggtctgaccaaagaatgtgcccaccccctgcctgctgatgggggctcttccgggctgaggcacagggtggggaggtgcacccagcccccctcctcccggaacctctttcccataggcaagagaggatgcgtcaccatgaccacttctttctggaaaattcccacagttcattctttcccgggatttcactggaggaattgtgtctttcttgctaacatctcctgggatctattcttggccttggcgggcttgatgtggaggcatgtgtgggtgttctcttttaatttggggtccagaactgtctgaggcctggaccggtaattatgagagcagcaccatttatggaaacagcccttgaagcaagccagtgatgagacccagctggaaatacctcagcatggagccctgggcccgcctcgaggcggtgctgagatttctgggtgggagaagccccttcaggacgcagaaccaacaggtcatgagtcccgccctcccttggcctgcagaggctgtggggcccaagccttcttttgggtctgaagtgcccctgccccaccgcctttgctgcctgtgggaccagccaggcaggcccagcccatgcacccggggctctgggggagccgctgtccaccctcaggggccaggccgggagaggaggcaggtccacagcaacgggaatgtcggtggcttctgatggagtcacatggggacatggtagccacacccagactggcagtgatacccagcccaaagggctctgagttccggacactgagccgctgtcctggggacaagagacccttgggaagaaggggccggggcacccccgctctggggccccgaaacacaggggccgatgagttgacgtgcgagcctcccatgtccacccacgtggctccgtcccggccctccaagggctcgctgtccagaggaacagctgaaccagagacagcaagccctggcatgggggccgggagaggctgaaagcctgacctgcctggggtctgaggactgggagccttctcagtcggactgagagggacggggccacccggggagagcagcttccaggagggactctgcgggaggcgtctgcaggtagaaggcacaagaggccggagggacagatggcagggccagcgaagggagggccctgggacactcttcctgtgggcctttcagggctggggagggtctgaggggaggtgggatgggtcacaggccacaagattctgctctgagctggaggatgagggtgtcttttgaagtcccactttttggtcagaaataagacagatttaggttgtctgggtgagactaaattgcccagagcacaaaaatagccagagcccttgttgatgttgggctgagggtcgcagagtttggcatctggaagcctagcctggagtggcaggcacagggccccagatgtggccagcggaagccaacttctgcccacagggcctttcctggaagcgtggggttgcttccgaagtttgctttatccaaggctggaggaggaggctgagggtttccatcagcacaggttggtgattcatgattgtttattttcccaggagccacattaaggtggtttagaaagcaaattcatttgctgcttccccagacagaagctggttcagcgtgagaccatttggggcagcttttatgattttgtagaaaataaatatttagaggtgcttatggaaccaggtatagcttggtctgtttcctgtgaccaacgaattgctctctgcatatgtcttttcatatttttgccaatacatctttggaattcttgtgtcaaatgtaattttgctaggtattgctaaattcctcctctacacagcattcctatcagcaacgcctgagagaatgttcatgtctgatcttaatctttttctttctcaaaggccatacggagcaccctatgaaaagcacccattactcttgagcccataaccttttctgtttccttcatagcatttacagtagaacaatagaaatgacatcccatattttagttgctttttgtttgcattttatgtcttccgttggaccgtaaactccctgtgtgtggaaaaagtatcttgtttattgttgtattgcccagaacagtgttgtacacacagtaagaactgaataaatttatttctaaattaaacatgatgatcttattagatgagtgaaagaatacatttatttagaaaaacttaattcaaagtattatttctgaccaaaaagtaagacttcaaaagacacccttgggtgctgtgggacaaggcacgttctttccttctccgccctgggctgggatgagcggccacctcctcctgcccacacacgtctggccccgtcccctgccccgcacagctgttcgcctgcccatggccggaccaggtccccaccacgaggacaggaagtgctccccacatccgcctcggcccgcacagcctggtgcttttacaaacctgaccgtggtcactgagcccagtaaccacagagaatttttaaaaagactcacaaacatatcattgaaatctcagtgctgggttttggggaaggcactgggcggctcccacccctgctttctggaaacacagatttctagagtttgaaacggatgggaggctaaagtgagactgccctaaatatagcgtcctgggtattttcggacacctggggaaatgtgggctttattccgcaactacagcctttgtttgattggcaggccagcccctgccacggggccctgctgcccatctcacttccagcctggcctctaccctcacctccactgtgtcttctaattcccctccacccacgccgcctccctgctgcccccgtcccctgtgcttcccactggccagaggcgcagcccaggctcctggcccgggattcgcaccctcagcaggcaggccgcagcagagctcatgtgccgtccccaacatcgctgacctgtgggcgcctccaccctgtgcatgcgaggtcccctctccctagagcaccctccctgccaccttctccacctaccaagacccatcccacccttcaaagccagttcagatgccacctgctcagatcccatcacccagtgagaccctccgacttccccagcacctgactggcctctctgggagttgtcactcctgccctggtttttcttgttcctttccacgtttccctccttcctcttccagcttgttccagaaaggaaacgtgggtctcctgccctctgctgtttcctggtgcttgctttccctgccctgccctcagacccctctgctctggccctctgccttggctggccggcccctgcagggcccgtctccctgacaccatggcagattcgcactcatgcctcagcccagctcagctgtcagccctgagccctcccctgccgcacctcccatccaggcagtgggcaggctctggatgccttgtgtcccctgagatgccgtcggttatgtcggttatgtccctgtctaccaggtttccctgcagggctggggcccttttctgccttgggtccaatgtccatcttccctttagcctggaagctcccagaggaggctccctcctgtctcatctctgggtcccaggaccagccgggccaagaaggggcgcaacgggagttcaggatttggagcctggggcctgctgagcaccagccaggtgcagggctcagggtgagcctggctgcagggcctcttggccctgtctacaccccgggaccaagcctggaacaaacgtttgcacaaaatgaagccggccccacccaggcctccctgggtccgctccaccttgagtggtgggtgtctgggggcggtggctcacaccagctctgccccctccagagcccgagccattctgagtgccagcccagcgctgctttgtcttctagtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacaggtgccttccccttggcccgggtgccccacctaaccccccacctcacagtctcatggtcaaggcagcccagcagggagtcgtggtgggctgaaagagagcctcaaagatgggaaggatgcttggcccgaggcccctgcactgtgggaagagccccagtgacaatcctgacttcaagtccctgccctgccatcctggctgtggggacttggacaggtcactgagcctcagtttccccatgtgtacacctctgtgggctgaggcaatgagatgaggctcagaaggggcgcagccagagtcaggtgggagacgctccggtgacagcccccagcgggccctggagacacggaggcagctgtgccggccgccggttaattgttctttcatgtccacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacggtgaggctgggggctctgcagcccctggggcttctctgtgccagcacaggcagcggtagtggcttcctgtggccctgggtgcccggcctcaccagctgtgcccgctgcaagggtcactgaggtccagggcacgaggtctggcctagtgggggtgctccctcctctccctctgcttcccaggaagcaggcggctcttcccacggagcagcctccaccttgggagtttctgtcctgggaagggaaggaggggaagtggctgtaccctcaggcactgaggccaggaggctgggtttgaagcccagcttggcagtgccctgcctcagtgaccttggctgggacttacctttccagaccccgtcttctcttccgcaggatggggattcacgcccttgttcattccacaggtgacactggggagagcctcttttatgccaggcagtaggaatacagaggccaaagtgggcacgagatgggtgtgtttgaggcccggcaagggggcgccatggagcagcggtgagggcgggggacccaggggccattctgagtcagagtaaaccagggccaggtgctggggttcttagcgtcatttattttatttactagcagtggaggacgacaggatctgattcaggttttaaaagagaaccctctgagatgcccccctctcggggtggagcagagctccccaccccttccgtgggctgcacccagtgacttgcttcccgaaagtgcggtgtggacagggcgtgggggacctgacgcgcagcgcctcagccaggtgaggaaggctcactgcagtgaccggcacggtgctagcatgtgccctgggtgaaagggaaggagaaggccactgagcctcagagggccccctccgtgaacccgaaaccccagtccagccacgagaaaaccgtcaaacaaacccaaagagaagggctttccgcagaatacctgacaagcgcttctcaaaaccgccaagctcatcaaaaaaaagggaaggttgggaaattggaggagcccagaggcacctaagaagaccagctcagtgcatgtggggtcctgggttgagtcctggaccagcaaaaggtcattagggagaagttatgaaatccagatcgatcatggtgtttacttaataataaggtatcagtattggttcattagttatgagaaaggtaccctgctagtgtaaaatattagcatttcccagaggaaactgggtccaggtgtatgggaactccttgtgtagtttttttttctttgagacagggtttggctctgttgctcaggctggagtgcagtggcgcaatcacagctgacggtaacctccaactcctgggcgcgagcgatcctcccaccttagcctctgtactatctttacaaagttttatgtaactatcaactgttgtaaaattaaaacttaatatatgcataaaataaagaaccccctgacttcagtggagagagcagactgagatggacaagagtgaagtcagagagacgtgtgggggccccacagtggtccaggtgggcgctgtgagtgacttgttggtagcagtggagatggagaaagatgagtcgatttcagtgtcaggacatgcttatagctggcgaggaggtgagggaacaggaggaagcctgaatgatgtgtggttggagccagtggatttttttcaatagatttttctttttggggaaaagatagatgaagggcaggtttgaggtgggtggccaagggttctcttttggctggaatattactgacccccctgggatgttactgagatcactggtcctcatggaaatgccattacagggaccggtgagcgtgaagacccaggcgagggaggtgctggcatgtaagtggatttaaagcatgggatgggaccaggtcatctagggaaggagggtagtgatggagaagaaagagggcctggcccagagccctgggacctccaacatccagagacctcacaaggaggggccacagagagcccacagagaccagccagggagggagcaggacacctggaggatgaggtgatctagacgccagagtaaagtgtttccagaagcaagggtttgtcatttgtgtcctgctgtgggcactgaaggcaagaacagagaagtgaccaagggttttgccatcacagaggttgttgatgacctaaatatccgtggagtgtgggtctgactgaggaggtggagggagacaggcagtggaggcaggagacagctctttccagaacctttgctggggaaggggagcagagacatgggctggggctggagagaacccgggacaaggcaggtcctttccaggtgaggagacgcctgcacgctgctgtggtgatgcagtgattctgtgcagagggaagaaaactgcaaaattccgcacaagttggagcagggagctggagtgggggaggtggagagggcggggggatgcagaggacaagacggggggcctcttcagagcagggacccttcctgatggaggtgagggatagtgtccccactgtcgcagtgaggggtgaacctgagctctgggaggctgtagtggggcaggcactcactctccgggttgtcacaggattaaaggagggtgcttggcacagagtgatgcccagtgaaggtgttcatgagcgtcggtgtcacccagcggcgcctgctcattggacacttggtgtctttaatgagctggggaagctggggggaagcttgggcggggtggttggagtttgtgtctgaggctccactggggcaggaggggacctagcctgtgccctactcgcggagcctgacctcagctctgtcctgcgcccgggcctgtgcgctggacacggaggactgactcggggcccccagcccagggcggagccggccccctccctgttgcgggtcgcgggcctggcctagagcctgcgcctggccggggagacctgctgggagggagtgcgtcagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggccccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatccggaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagggctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcggatgccaccgggttccccaggggaatacatgtccccagctctgggaggggtttgctactggcctcctactttcctccctaggtggacagtgctcctctagagagctgcgactttaattaaaaacaacaggaaaacagatcagttcctcactgtgtttctcgagcactgcaaggcgcaggtctgcagtggtgaggaatggatgtccgctttgctctgtgatgtttacacagagcgtgcacagctcagcgcattcacagcaagatttgattcaagcgcctccctcgtacttgaaccatgaaatggagataaaaactgacgagggagaaaatcactcaacccagagtacacctgaagggacattttactactgcagtgagaaataggcgagcaaagatgtgagtttgtgattggaagacatgctatcttcatgagcttgttttttctttttccttctctttcttttttcttttttttgaggcagggtctggctctgtcactcaggctggaatgcaatggaatgcagtgatctcactgcaacctctgcctcctgggctcaagcaatcctaactcagcctcctgagtagctgggactacaggcgcacatcacaatgcctgcttatttttttttattttttaaatttatttatagaaatggagtttcaccatgttgcccaggctggtcttgaacacttgagctcaagcgatccacttgcctcagcctcccaaagtgctgggattacagacatgagccactgagttgggccaattaaccttagcttactgtaatttttttttcttttttagacagaatctcactctgttatctaggctagagtacagtggtccagtctcagctcactgcaacccctgcttcctgggttcaagcaattctcatgtctcagcctctcaagtagctgggattacaggcatgtgccaccatgcctagctaatttttgtatatatatttttaacagtagagatagggtttctccatattggccaggctggtctcaaactctgggcctcaggtgatccacctgccttggcctcccaaagtacaggcttgagccattgcacccggccttcttgaacgtttttatccgttatctggtatttcttctggggcctttgttgttaaattttgtttccctgaagcctcccctcctcctcccacatctctcctcctgggacctatgagatgttaagcttctagatgtccgtagaaggaaagcaggaccatctccaagggaagggaccgggtgatgggagagactgagaggggagaggctgccggtgctgaaatccaccaggaagcttcctctatctgtgtgtggccaaaggctacagcctaggacaggaggagttctagaaccctaaccaagggactagatgagttttctcagcttcatttgaattgttcctgcatcattcacaccagacacttaggccctcctctctgggatggaggcccaaactggccacttgtgtgatggtccgttgtaacccaagaggctgcgaggcatttcctcctgaatctatagtctcaaaaactaaaattaagattgtgtgtgtgtgtgtgtgcgcatgcacgcgtgcacacgtgctgttgacagccaagcctggcctggtgcatgcactgcataagtgtagctctgggggttcccaggccattgggggcatgtggtcagagtagtaagttctcactggtcaaggacagactttccaggggcccattggagcctcaccctgcaggaaaggccagatcctgggaaggagagcagggcagggagagttggcgctcatggagggcacagactgggggtgtggaaaaggggccagggactatggctggggttgggggcttgaaatgaaatgtcatctagtgggcagtggggtgccttttggggctcctggagaggggcacctgatttgccctgggcgtcagtttcccaggagcagtgtggaaaaggctgaggtatctagaagcggacaagtgaccctctgggcctccaactccacctttctggaaggggcctgcccacagctgggcagcctgagagccccccaccttgactgcttggccttccctgcagccagctggagccagggagtcctgcctaagaatgggtgggtaagaagcagagctgatggagaagggaggctctgggctctggaaggagagggctggggatgggggagcttctccaggcctgccagatgcagggctctgaacccagacccactgttagtccccttcaccaccccccatcttgcccagccacatccagctgggccctgcagtttgctggaaaagtatatgacaatcctggctccgacccaccttgctctgggaccttggacagttgctgctctctctgggccttagtttctgcttctgtaaaatgggaacctgggattagctgcttccaaggttccctagtcaggctcgcctggcctgtgagacctacagaggggttcccagcacccaagccaggcctggctcagaggggctctgtgagggtctgtggtgtaactgatctaatgcgacattctatcctgtgtctgggagaccccccataagacccttgaacacagctgcacagaagcaaatagtgaggaaagcctgcaggactgatggcctctcaggccccatggcaggcagggctccccagggagtcacaggacagagctgcaagtggagccaggagggctgccctgggccccaggctgtccccatgggtcagccagtctgcagagtgacactccagtgcccgggctggtgaccaccaccaccccactcaggctgctctgttctctctccgttgtgacctcacttgtcttttcctctgtgccccagctctgttccttgtatttctgctgcttccccataaccttgactcaccgtgactcaagccctgcccagtggattctctctgggcctccttcccatgttagcatctgcagctcacagcctccctgtctcagcagctcttgtccatgctcgtgagagggagggagcctctcctgccagtgcatttgtttgtggcggatgatgtcacgggtcaaaggttggtctctggattcactggttgttcagtcaagtggccaagggacaccagggctgaggcacagctgcttaagggctgacctttgagtgggactgagggtggggcaggcagtgtccttgacctgtagggtgtactggagaactacgtaggaataaatacatctgtgtgtgtgatgtctgtctgagcgtatgtgcatctgtgtgtttatgcaaacatatgcctgtgtgtacatacgtgtgtacatctgtgcttataacatggaggtgaaatgtactttcgtgtaaactgaacaactggcactgtttaaagagacatgaaaatgagctggtaatcatgcttctgccattcagtatcaggaaatttcacccatgcacggagtgaagaggctccattgcactcccatctttatcatgaaagccgggaaataacctacatgtctatgatgagccaatatcaagtcaattacggtatactgctccaagggattttataaatttgaaatgtttattgtggagacttatttaaacaaccagaaaaagttttgtgttttgttttttttttcttgaaacacactctcattctgtcgcccagctggagtgtggtgacacaatcacacctcactgcagcctcaacctcccaggctcaagcagtcctcccacctcagcttcccgggaagttcaccaccatgcccagctcatttttgtttttatatttttgttgagacagggtctcactatgttgcccaggctggtctcaaatgcctaggttcaagcaatcctcccacctcggcctcccaaagtgctgggattacaagcgtgagccaccttgcctggcctcaaaagtttctttacttaattgcttttacaatagaaaggttattgaaatccaaacaagtacaggatgatacacagttttattggtgaggcttggcatctccagggttagttatcatgttttcagcggcatcctcagtctggaagcggctgtgggggacaatcccgtttacaggcttcactcctcctggggctgaggcccaagtcagatctctgtttcagccttttctttctttcttttctgtccataagcccagctcgtgcataagaactcgggctctggaatgagactgccgcaggctgcaacctgggctctgggacttggttcaatgtttctgctctgcctggcatctcccttgtgggcatcagggagacagttaatgccctgctcttgggctgtgcccagcagaacaagcactcgctcaacctggcagatgctaccacgagctgtctcggtgataagtttgacattcacaccccagaaagtgcgggacggaagacagaacacaggtctcggggtccttggaccaaggtgggagcgctggttctcggagtcactggcagtaggactctgggtctcctgtgaagtaggagctgcagggtcactgtaaggacccaatgaggtgatccatgggaaaaatcttccaacttgtaaaacacttcacaaatgttattatttgtgacgcagctgtcactaataacaccgcctgcagctcactgagcaccccctcccacctcctccaaatctgtccccaggagagacgtggactggctggggctggaccaaggactccaggcttcagatgtggaaactgaggctcagcaggaccccttgggtcctcagcctccacgctcctggacctgcccaggccccggcagagagaccgctgctgtgtctgctgcagggccactgcccgtgagtgacccctctctcctttctgtctcagggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttggtgagggtcgggcaggctggggccgaggccctgtgggcttctggctgagagaggcagggcgagaaccaagtggtggcccagagccctcaggctcaggtcggttcaagctgacggccactctccagccacctttcctgacaccatcttggccctgatgcaccctggtgaccggcactccggaggcctgtcctggctgtccctgctgcccagaagtctccctctctccccctggctcctccgggtctttctcaggagcctccttcagaatcagctgccccttccctgggagccgcagcccctcatgacctgcggttgtgcctgggcaccctgtgggatcctcggttgcttatgcgagttttctccccaactgggccaagcccttcaggatcagggacaggcctgacccaaccccgtgccctccttcccagggagtcggcccttgactggcctggtcgtgagccacttgaacctcgggaatgggtgtggcaggagagggtgggctggagtcacaggggtctccagagaggaggaggcacaggatggccgagggtcctgctgggctgtttactggagcataaagacgctcataggctgaaggacaggggaggactgggcacagtgtcactctagccattgggagccatggcaggcttctgagctgggtcatggtacaagcagagttccagggatgggctttatgagaccaaatggtttcctgtcattcatttatttgacaaatgtgctcatcagggcatcccccaccctggtaccccatagtagctgcacacagtaggaaccccagaaaagaccttgccccttctgtccctgcagatgacgtccacggctcccacggccggcaggtctgccgtcggcacgagctctacgtcagcttccaggacctcggctggctggtaattgctgactcttcttgtttctgaaatgacaatcaccacctgtagatcagaagtgaatctgcagggaggacatagaatcatggtgacttcaattttcttatgtatttttttcttctgtgttttccaagttttctaaagtgagaatatggtgagaaagggttttttttttgttcagttttttgttttttttaaaaccatgaaaatgaagactgaatcaaccaactaagctgtcagcattgctgcagggtaactgagacctccctgcattggctacgactgcagctctgggaggcgtgggcaggggagggccggctggggaggggacgcaaagtgaagatatgggggatgttgggcctgagctcctgcccagccttttctgccgggggttcctgggtggattcaagcctcttgggggagacggccctgcagggctggaggatgggtttgggccctgaggctcagggaggggcacatggatgggactcaccttctcccttgccccccaggactgggtcatcgctccccaaggctactcggcctattactgtgagggggagtgctccttcccactggactcctgcatgaatgccaccaaccacgccatcctgcagtccctggtcagtaccatgcccatcctgcccagccccctggggtggggggccctgtggagaggggtctggtccagctggctgggagggcagtgaggccacctgctccgcgtctcagggggctttgtctgcacagtcagtaacgtcgctaacttcccacagctctgcaggaactggtccttatacagccacactacacgtagactcgcacccaaacacggacatacgtgaacagtcgtgtacacatgcctgttctatgcaccgaacaaactcctgtgggacacttacgcacctgtgtgcagcgctcagaggcacagcacatgaaacagatgtgtacactgtgtgggggctgtgtgatcttagcacacgggccgccgagtacgctggcaagtctgaccgcccgtgatatgtgtgcacagtgtgtggggtgtgcgtgtgcactcacccacctgtgccgcaccgcaggcaggaagcttctagatggtgtggctctcaaccttttggcttttcccccagtttctctcttggccatctttgttttttctggatcccctggcttttgatgccttggtatctggggcaaccttaaaggacaaaagcaggtttctgatgggatcactggtgctgctcactgttgagtgctctgtgtgtttgtggattctggcaccgaggcttccttctagaactttttacctagaatcccagttcctggtattgcacagccttatgttttccccttaggaggttcaacggtgatgccttgatcaggtgcggtggctcaccctgtaatcgcagcacacgagcccagaagttcaagacaagcctgggcaacacagcaaaaccctgtctctaaaataaaaattaaaacacacacacacacacgtgcgcacactatgccttggtgtgagaggaaataaattaccaaaagctgctctgagcctatgataatgcttcctttctgggcagtcaaatggtgtttgctggacacctggagccacctccttggaaaggcccagggatgatgaggacgcgtggggcggcccagcccagccaccctttatgccgtgtggttctcatggctgcatgtgtgggaggcacgcgggaaggtgactgcatctgcagctcccagactccatctcctctgcccttgcccctgcccctcaggggctcaactaaagtgagcactcgtaacctgctgggcagcaaacagacaggcgctgcgctctaggggaggctgtcggtttgttggtttgtccaaagcaaaacaaccgtggaggtgacgcctcctgtgaggaagagcagagtggctgctccatcagtggggagagactgggcctggcctctccacagaaggagggggccagtcagcagctggaggaggaatgttccagcagaaggagcaattccaaggccctaagacagcagtgagcttggcaggttcagggccagcagggagaaggggctgggtgcagtgagtgggaggagggcggagggaggtgacaccagggtgggcagggccggctcccctagggcctgggggtctgaatgaaggtgttttattccaagtaacccaagaggctgtcggagctctttagcaaagcagtgttctggtccatgtcaccctccagaaggacctctctctggctgctgggggaggctgggattgggggtgggggtggtggtggaaggtggaggagcaggggatgagtgaaggctgctgtggtcacctgacaggtgatggcagctggacggggcaggtggtccaaggcagcatggaggtggaggttgagccaggggctgctcccagggaagggaggaggcaagaggagtcatccaggaggcctcccaggcgggggctatgatgtcagggcgggaggaactccatgttccgctgaggccccattagaccccaagtgcagaagtggcgaggggagcaggatccacaagtctggagttcagaagagaggtccaagctgagcctggggagtggagaggtgcgggcacgtgcagggccttgaagtgctgagggcggatgcagtcctctgggggaaggagcagcacaggagaggggcggaggcctggcctcccagagactggggagggaggccagggtgtgggaggcagagcctctgggggtccgaagggccaaaagaagaaagtggtccttccaggctcccccttggggacctcactaagggcacaaacctggccacacagttctccttcccattatccccaggaggaagtctgagcccttggcctgggactccaggcccctcattagcgccttgcccacctgctgcacaccccctgccatgtgtccctccctgggcactgcgtgttactacagctcccactcctggagccttgaggactgctcttattcctgttaatagttattattattgtgctgctcccatgtggcctggagatggccagggcagggagcaggtggagctggggtggggctgggtgggtccttggaggaggccactgggctcatgcccctgcctgtgccctcttcctggccaggtgcacctgatgatgccagacgcagtccccaaggcgtgctgtgcacccaccaagctgagcgccacctctgtgctctactatgacagcagcaacaatgtcatcctgcgcaagcaccgcaacatggtggtcaaggcctgcggctgccactgagtccacccgcccggcccagctgcagccacccttctcatctggatcgggcccctcagaagcaggaaaccctcaaacccagccagaccccaggccggggcattgccagggaggaccctcacaaccacgtacatgaccctttctccttcatgccaggctcctatgctccccttgccctgccaggcatttgtgtgactgtcctgtttccagcccaggtggtctcaatcatcaggcagtgttctacccaaatgcaaacgcctctcccggaggcatgtcctggctggttctttggggttggcacagaagtcctgtctgaggtcctatccatgccccttactggctcaggtcgtgagatagatgtggaatgacctgagaggcacctggagcccactgttggccaccttgagctcttcaccatccatcacagggtgtggtgtgtgtagtcagggtctggttggctccccattgcctgcccgaggtgcaaggtggggtataaaactggataacccctgaagtattgtatattcatggatctgaagcactgatccactggtcacaggtagacatgtggagtcaactcaagaaaaagctgagtgaacagcatgatttagggctaaagccaatggcatttatcttcccttgtcttcctgctttgcatttgcctctgccatctaggaaagacatgtaagagcatggacattttactttggagaaacagaaaaatcttggggcttccaattgacccatctatctgccaccatgttgccccaccaggagctcagctctgtggagttttccctttgctgagcaagcatgtggttgcattgggtggcccaggatgacaatgcacagcacagatgccatcatttccctttcccctctgaatggcagacatcagtaatcaatctggaatgtttttcttccaaatctgagtggaattttcaaatgatcagcacagccactgccaacagatatgatgtaaagtgaaacctggttgccatcttctgccatgctgaggagcagtccatccctgcccgagcatgtatcggcaacatgggcagcctgtgaccgggtctggggcgaggccaggggccatcaaaaacaggctgatcaccaaagtcagtgtcaccctggatgcccagcagccctgtcctgtgtcttgggcctgtgagtcaaagaaaaggtccttttcagggagtgacaagtagtaattaggctgagttgggtggagaggtttgtctcagcctctgctgttctcggaaactgctgttctccttggagcagccactgggagttggagtgtttatttgatttctgacttgctaagcctgtaatttacctgctggaatagacagagtccagctgcccaaaccgtgtcattaaaagcagatcctgcgcccgccccatccacaggcacagcccggcagagtggttccacctccccatgggcccaaggatgcgcctctctggagttcacgtgctgcacccccagggaggggcctggggaaagctggtccagcagcaggggtggaggctggggccacactgcgggacagcagcccctccacctggaccagggagggcctccatgtgcaagcgcagaggaagagaccctcccatgtacgcaaagggcagccccaggctgtctggaagttggagaattccctatcagcacagggatctcagctctggcctggaggtgaagagacctgccttgtaggtggcttccttatctgcgcctccattttctatctgcactttttgatctccaaacaaccttcagccaaagaatctgtctaccaactcctcatagtgagccagaagcagcctcataaccctgaatgtggggctctggtggctgtcacgaagcagagttggcacataacatggaacctggccaggcatggtggctcacacctataaccccagcactttgggaggccaaggcaggcagatcacctgaagtcaggagttcaagaccatcctggccaacacagtgaaaccccgtctgtactaaaaatacaagattacctgggcatggtggtgcatgcctataatcccagctactcagg

SEQ ID NO: 14953 - DNA, 21855 bp, Human
tgtaaagaacattaaaaggggtcagagagacatgcaaggcagaggtcagtcctccaaggcactctaatgggatagggtaggcaaaaagtattacctttggggtcttgataataaaatttggtttctcttgatgtgctttcagttgggatgttaacactgcctctgcaacctggcagaagaatgaatgtgagatgtggcttctctggacactggccagacctgtggcatctctgaccctgttgaccaccaacctgcaaagactcttcaccctgagcaacaggaagccaaagcaccatttcatctatcccaatctcagtcccaccccaaagaatctatgttgtatttacaattacacgtgtaatatatatgaggtcaggtcttcaccacacaagcttcctcactgtatatggatttttttttttttttttgagacagagtctcggtctgttgcccaggctggagtacagtggcacaatcacggctcactgcaatctctgcctcctggttcaagcaattctcctgccttagcctcccgagtagctgggactacaggcgcgccaccaccacgcccagctaatttttgtatttttagtagagatggggtttcaccatgttggccaggctgctcttgaactcctgacctcgtgatccaaccgcttcagcctcccaaagtgctgggattacagacatgagccaccgagctcagccgcatttttaatattctcaaatactttaagaatctgagaataatgaaggcactgaacaacccaccactaccaacaccaaccattcaggggtagggattatggtgatcttctccaggtcaccgttcctactgaaagagcaaaaataatttttttttttttttcagatagagtcttactctgtcgcccaggctggagtgcagtggcacgatctcagctcctgcaacctccgcctcccgggttcaagcgattctcctgtctctgcctcccgagtagctgggattacaggcacatgccaccacgcccggctaatttttgtatttttagtagatacggggtttcgccatacaggtcaggctggtctcaaactcctgacctcaggtgatccaccccccttggcctcccaaagtgatgggattacaggcatgagccactgtgcccggacaaaaaaataataatttttaataaggtagcactggttatcaggtttagagagaggaaaactgtaacttgaagacaagggaaccagctcaaggacacagaacaagcctgtggaatgataagatatggatttcttgaatgagctaaaaaactcagactgataagatgctgtgattgaatatcaataaaagatctgtgccctattgttcacgatagcacaaagcatctgctaagagagcattagaatctttccgaagtaaggcaaaacttaatcagtgacattaccagcacgctgtatgcccttccaaaaatagaggatgtggtggttccatactatggcgattatctgccctaagagaagtccaagttcaagtacacaatcccttatctgcaattccaaaatccaaaactctctgacatctgaaaatgtttttctgagattcattttgaggtaaattctaagatgaactcagtctacttctgatctttagtcatctcatttactaggaatattcatatatttcgcttaaaaatgttactgtttgagtccaagagtttcaggaaaaagtgtggatatgaattaaaatactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctggtgagatttaggcagcaggggagagggccaaggcaaagcctgggaggacgtaaagccagggtgttcgggacatagggtagagatgtgagggaagcgaccagtcttgtagggaggagagtgggctgcgtggggagacatccggggtgggtcccgagagaaacaaagctaggcctgagcagagagatgtgatgagggaggaatattgaatgaatggcgggggagggaggagagtgacagatggatagctcagcgccttctttccctccacagatcgaggaggaggtggcgaaactcctgaaactgaaggcacagctgggtcctgatgaaagcaaacagaaatttgtgctcaaaacccccaaggtaatatcattcctgtagggagccactgagaaagtctctaactctactcacggggcgcttatgtctgcctccctaaaccaggtcattgaggaggatctgaaatgctgcagaggagaggacagtcgctctgggcgctgggctggactggactctacctgagtcattctgggatggcaaagtgatggcagaaactaggccagctgggtgatcaggggagtcagcctgctgctgctactccttcgttcattcaataaatgtgtatttagcgctatgtctctagcactatacaaagcactgaatatataccatggtggacaatatagcctaccctcatggagcttacattctactgaaggagagagacttagaacaaataatcccacacagatttttttgttttttttttaaacagagtatcctctgttgcacaggctggagtgcagtggcacatcttggctcactgcagccgctgcctcctgggttcaagcgattctcctgcttcagcctcctgagtagctgggactacaggtgcccaccaccatgcccagctaatttttgtatttttagtagagacggggtttcaccatattggccaggatggtcttgaacttctgacctcaagtgatctgcccgcctcagtctcccaaagtgctgggattacagacgtgtgccaccgcacccggccaccacatgtggttatgtaattacatattgtgaaaaatgatataaagaaattaaggttgctctgagaaaaataagggagaactggggagtctgagaaaggctaactgaggaagtgatatactaactgatctaatgaatgagtaggagatagccagaggacaagtgtgacaaagataggtccaggtagagtatggaaaccctaaagtgggaaagaactttggtagttttgaggaactagaggatgatctacatggctagaactaagttaaggagagtagagtggaatgaggttggagattctgagctcatcctccagttcagttccactttctgtaagttctataaacagaactgtttaccccttcatctaggtgctcttggcacttcatacatatttgttattacaccaactttaagtagttatttatgtcgtttatttaccctgagactgagactagatgcctaaataggtatagtcagccctccatatcccaaggtcccacattcacagattcaaccaactgtggatcaaaaccattcaggggaaaagaaacgattaagaaaaaaaatctggctgagtgtggtggcttacacctgtaatcccagcactttgggaggccacaaggggaggatcatttgagcccaggagcttgagaccagcctgagcaacatagtgagtccctatctctaaaaacaaacaaacaaataaaaaccttttgaaatctaacaataaaaatttcaaataaaaaatatagtatagcaactatttacatagcctttacattgtctaaggcattataaacactctagagactatttaaagtatataggaggatgtgcatataattttatgtcaagggcttgagcatccatggatttttggtattcacatggggcccagaacaaatctcctgtggatactgagggatgattctatttaatacatgtatttgaaattgaattccaaaggagaggggagatggtctgttttccttgtgttaaggttaattctttgggatcctaaattcattgagctgtttctttctacatataactaatttttgaaggttaaagagacagtgtaaaatcccaaagtggtgatcatcaatgatttttcaaactattagatgaaaagcttactgtggaatttatgatggatcagtctgtcctcactagtgatcagttttaacatcactaaaagtaggacaactagacattatgttcctgctgatgtgatgcaagaagaagtacacagcaccacctgggaagtattcttgccaagtaaattgaacttgaatctaatcagatctttggactaactatcagtttacaggaaatactagagatggaggaacatgttagatggcacatcaagcatattgttcaccaaatctagaatgtgaaaatttttttttaggacaaatggcccaatttcctcagttaataaatgacctttttaaaataaaaaaaaaaagttggggagggaaggaaactattgtagattaaatagacatatcagctgattacaacgcatagacttcattctgaagctgattcaaataaatcaaccataaaaagatattattgaggcaactggggaaaactgaccatggcttagcattagataatattaaggagttgctgttagttttgttagttataataaagatagagtctttggggttttttaaatgtccgtatgagttagagattcatactgaagtatttatggatgaaatgatatgacgtctgggatttatttaaaaatatgtaagaaaaacatgtcagggcttaaatgaaataagaatagcagatgttaatggttgttgaagctgggtaatggataaatggtgacctgtaatactattctctatattgtgtctttgaaaatttccatactatagtgttaagattatgctagagagttaatatccattttagtattaacaatagaaaactcagtattgtggggacaagactctttcaagggatcttcatggtcaaaactatttctataataattcttttgttttgttttgttttgttttgttttgttttgttttgtttgagacggagtcttgctctgtcgcccaggctggagtgcagtggcgtgatctcagctcactgcaacctccgcctcccgggttcaagcgattgtcctgcctcagccttccgagtagctgggactacagggatgtgccaccgcacctagctaattttttgtatttttagtacagatggggtttcaccgtgttggctgcgctggtcttgaattcctggcctcaagtgatcctcccacctcggcctcctaaagtgctgggattacaggcgtgagccactgcgcctggcccttctataataattctaagacattatctgcctttttcgttgtgttaacatttgcactgaaggcacaaaagcgctggtgagtagaactgctggtgccttagcatacattaagacagtgacactaaactgtactaatagccagtgtgttcttcactgccatgcactcacagtaagtaaataaataaattaattaattaattaatttaaaaaattcagttttacttaactatgtcattgataaaatggtaaaactttgtttgttttggggtttctttggagacagaatctcactctgttgcccaggctggagttcagtgtcacgatcttggctcactgcagcctccacttcccgggttcaagcaattattgtgcctcagcctcctgagtatctgggattacaggcgggtaccaccacatgcagctaattttttgtatttttacagaaatacaaaaaacatacaagaaacctacaacatgtttcaccatgttgcccaggctggtttggaactcttgagctcaggcaatctgcccaccttggcctcccaaagtgctaggctgagccaccatgcctggccaaaaacttactgattttattgaatcttgacccttgaggaccctatttttaaatatttgctatgacaaaatgggaagtacacataaagcacttctgcacgccaaggtagggaaaatgcttatgccattgttcaagttgcaagctgatctagctacttttttcatagaacatcttgttttatttgaattaacaactgaaagataaattatggtttttcaaacttaaatatttggcagacatttttacaacaataaacgaagtgagcctcgtcacctcaaggaaaacatctgacagtacttgtaggcagtgaaaaaattcaagtattcaggtgaaagttagaattttagaaaacttagtcagggcatggtggctcaagcctataatcccagcactttgggagaccaaggcgggcggatcacctgaggtcgggagtttgagaccaacctgaccaacatagagaaaccccatctctactaaaaattagctgggcgtggtggcgcatgcttgtaatgccagctactagggaagctaaggcacaagaatcgcttgaacctgggaagcagaggttgtggtgagccgagatcgcgtcattgcactccagcctaggcaacgagtgaaactacatctcaaaaaaaaaaaaaaaagaattttagaaaacttgcatcttccatcataagcttgacagcttcccaataattaaagagttttctactgggtgtggtggcttacgcctgtaatcccagcactttgagagaccaaggtgggcggatcacctgaggtcgggagtttgagaccagcctagccaacatggtgaaacgctgtctctactaaaaataaaaatttagccaggtatggtagctcacgtctgtaatcccagctccttgggaggctgaggcaggagaatcgtttgaacctgggaggtggaggttgcagtgagccgagaacacgccactgtactccagcctgggtgacagagtgagactccatctcaaaaacaaacaaacaaataaaaacaggccaggcaaggtggctcatgcctgtaatccaagcactttgggaagcagaggcaagtggatcatgaggtcaggagatcaagaccatcctggctaacatggtggaaccccgtctctactaaaaatacaaaaaatttgccgggcgtggtggcacgcgcctgtatgtagtcccagttactcaggaggctgaggcaggagaattatttgaacctgggaggtggaggttgcagtgagccgagatcacaccactgcacttcagcctgggtgacagagcgagactccatctcaaaaaaaaaaaaaaaagactttcttgatgagatctgaagtgatgtaaataaataaggcttcctgatattgtataatgaaatgtatcaacatttgaaagacctgttatgaaatcatgcacaggcaaaggatccattcattcaaagtacaaaatacagtagtggatttttttttgtaggaaaatatacgtaacataaaatttaccattttaatgattttttttttttttttgagacagagtctcactctgtcaccaggctggagtgcagtggcatgaccttggctcactgcagcctccacctcctgggttcaagcaattctcctgcctcagcgtcccaggtagctgggactacaggtgtgtgccaccacgcccagctaatttttgtattttttagtagagatggggtttcaccatgttggccaggatagtctcgatctcttgaccccgtgatccacctgccttggcctcccaaagtgctgggattacaggtgtgagccaccacgcccagcccattttaatgatttttaagtgtacagttcagtaacatgaagtacattcatactcataaccatcaccattatccacctccagaattttttcatcatccccaattgaaactctgtacccattaaacaataactccccacttcaccctccctccagcccctggtaactgctatcctactttctactttctgtctctatggatttgactattctaggtactagataagtgagagactaattgttctttttttttttttttaagttcattgatctagctttcaaattccacattgcaaccaatctttaagaaacaaccacttgttggattctgatgtagtaccaaagaaaaatatccacagttagctgaaaagtttgttaaaatactcttccttttacaactacatatctgtgtaaggttagattttcgttatatacttcaaccagcacgacatatcacgacagattgaatgcaaaaatcacatatgagaatcctgctgtcttctattcagtcagacattaaagatttgcaaagatgtaaatcagtgccactcttctcactaaattgttttggaaaacagttacctttttctaaaatattatttgcgttaacatataatagatatattatttgtgttaacatatgttatttgttaaatgaataaatattttaaaatttttgccgttctaattctaatacagtaaatattgataggtataatccactttggggtcttgaatacatagtaagagtgtaaagaggtcctgaaaccaaagactttggagtagggtataaaagcccagattggaagctctgacctggaaggacaacacagttctagtcctgactgccacgaacatgctgaatggccttaagaaatgacttaacttctcaacatcctgtacttcatctgtaaaatttatctgcctagcctatgtcatagagttgttaccagaaacaaattagagaacaaacagttgtaactaagatttaaaagaaaagttatattgggagagaaacgttgcttataaaatttggaattcaattagttgagccagtttgagttggttatattgcctataatcatgtaggtatttttttgttgttattatttttgtttgtttggttgggtttgtttttgtttttgtttttgttttgacagagtcttgctctgtctcccaggctggagtgcagtggcactatctcagctcactgcaagctccacctgccgggttcacgccattctcctgcctcagcctcccaagtagctgggactacaggcacctgccaccacgcccggctaatttttttgtatttttagtagagacggggtttcacagtgttcgccaggatggtcttgatctcctgacttcgtgatccgcccgcctcggcctccccaagtgctggcattacaggtgtgagccaccgcgcccggctggttggtttgttttgtttttgagacagagtctcgctctgtctctcagtctggagtgcagtggtgcaatcttggctcactgcaacctccgcctcccaggttcaagtgattctccctgccttgagcctcctgagtagctgggattacaggcacctgccaccaccatttgtttgttttattgagacagtctcactctgttgcccaggctggagtgcagtggcacaatctcggctcactgcaacctccacctcccaggttcaaggatcctcatgcatcagcctcccaagtagctgggactacaaggggcgtgtcgtcgcacccggctaatttctgtatttttagtagagacgaggtttcaccatgttggccaggctggtctcgaacccctgacctcaggcaatccatctgccttggcctcccgaagtgctgggattacaggcgtgagccactgtgcctggcctcaggtaggtgtttgttattaggccaggaaatgttctgttatctgagagagagtgtttagaaaaatggcttaaagaaaagagttctaagaattttagaaaatagacccaaacttaaaagggaatggagtttggaaggcagatagcaaatgggtgtgggaattaatagggaattatttgtacttgttttaaaactcagtggcctgtaggaaaatctgtttagagcaggatttgctttttcattattgaggtcatccttttatatttccaaaacatattgttcttggttttcaaacctcatttctggttctctggctgatttcaactccaagggcacaagagactatagtccccggcagatggcagttcgcgagaaggtgtttgacgtaatcatccgttgcttcaagcgccacggtgcagaagtcattgatacacctgtatttgaactaaaggtgaggaatgggcaagaagaaactacatggtagatgagtgggcatttgaataacaaagaagatgacaacaagagagtgagggtccaaagggcccactcctgttgtggacacagaccagtctttgctccaataagaagggggacaagaatggcttggagggagaggccctgtcttttattatcttggttgtggccagcagattccaaaagagagccattctttggaatggtaattgttctgggtcctctctacattgtattgcgtggcatctgtacttggaatgttttctagattcatgcaaaccatacgtacataaatatgcaaccactctcctattgatggactctgaagttgttagtagttctttgctattaaaaactagattgcaactgggcacatctgtagttcctgcttctcaggaggctgaagcagaaagatcactggatccgaggagttcaaggctgtagtgtgctatgatggtgcctgtgaatagccaccatactccagtctgggcaatgtagcaagcccctgtctctaaaacaaaccagccaacccagattgcattactacctgcttcaaacccagtgattcccactgcacttatagtacaacccaaactctttactcaggtttacagagccctaggtgatctggccactgcctctcctacctcatctcatgctatttttcctcttgcccactatgctactctggtcttcttcctactcttggaacatagtcagtgtgtttgtacctccacacctttgttcttgctcttcccctttcctgaactccctttccttagctctttgcatgatttatttcagattatactagagactgcagattttaattcctttttaaaaaaaaaaaatacaaatagagacagaggtcttgctatgttgcccaggctgcttgcgaacgaacccctggcctcaagtggtcctccttcctcagcctcccaaagtgctgacattacaggcatgagccaccacgtccagccagccagattttaatttcagagctcagctaaaatgccactcctcaagtaatcttctccaactaccttctttaaagtagctgttctctctcttatcacaatgagctagtttattgcctttaggctataaaactgtctgaaattatctgttgtttccttcatcaatgtctctttttattgatatttaattgtacatatttatgagactgtttttacctactgtattagtttgctagggctaccataacaaagtaccatagactaggtagtctaaacaacagaaatttattttctcacagttccagaggctggaagttgacataacatgttggcaggcctagttctttctgaaggccataaggaaggatctgttccaggcctctctccatggcttgtagatggccatcatctccctttgttttttttttaattgagacagagtctcgctctgttgcctgggctggagtgcagtggcaccatctcatctcactgcaactccacctcccaggttcaagcgattctcctgcctcagtctcctaagtagctgggattacaacacgtgtgccaccacacctggctaatttttctatttttagtagagacgaggtttcaccatgttgaccaggttggtggtcttgaattcctggcctccagtgattcgcccaccccagcctcccaaagtgctggaattacaggcatgagccaccgcgcccagcctccctttgtctttacatcgtcttccctctgtccctatctaaattttctcttcttacaacaacatattggatcagagcccaacttggagacctcatgttagcttaatcatctctttaaagaccctatcaccaaatgtagacatgttcagaggttactgggagttaggacttaaacaaatgaattggggagggtggggccagggggacacagttcagcccgtaacactagtgtgttactgtttctgatactgcatactgggaagtttcaggctttttaatctttgccaacctggtaagtgaaatatgctattaccgatgatagacatcacagggcaaggactgctgtaatgcccttaagacattccccagtttttacttttgacattattcgaatctcaggcatcaaaaaacatttatgtttattggtctgataacctattcctagtagtttatcatcaagaaaaatacttttttttaaaaaaaaaaagagctatatacctaaatattagatattgaaatgttatggggaatttttttttttttgagacagagtttcactctcgtcacccaggctggagtgcaatggtgcgatctctgctcactgcaccctctgcctcccgggttcaagcgattctcctgcctaagcctccgaatagctgggattagatgcctaccagctcccccagctaattttgtatttttagtagagacagggtttcaccatgttggccaggctggtcacgaactcctgacctcaggtgatccatccgccttggcctcccaaagtgctgggattacaggcgtgagccgctatgcctggcctaaaaaaatttttttttaaattagaataacctaaacacctaacagtataacatgagggaggaagtaagtacagagcttcttctcactggaatttatgcatcttttaaaaacacttcaggccgggcgctgtggctcgcacttgtaatcccagtactttgggaggctgaagcgggcagatcacgaggtcaagagatcgagactatcctggccaacatggtgaaaccctgtctctactaaaaatacaaaacttagccgggcatggtggcacccgcctgtagtcgcagccactctggaggctgaggcaggagaatctcttgaaccccggagtcagaggttgcagtgagccgagatcacgccactgcactccagcctggtgacagagcgagactccatttcaaaaaaaaaaaacaaacttcatgctgagaagtctgaagaaaaaaaagatttttaagaggaaaatgtgtaagaaaaatacttcagctctgttacaaaatcaaaatagaaaaaaacacaaaattggtgtttccttttaatgataactacatcagacacctaagaattgggataaagagcagagggaaatgtagacaagttggaatcagtcatgtttgttttcaaaacttccttttaaattgttatgtttattattatgaccacatttatttatgttttctccaggaaacactgatgggaaagtatggggaagactccaagcttatctatgacctgaaggaccagggcggggagctcctgtcccttcgctatgacctcactgtatctttctaaacttgggctcttgagactttggatggattggcactcacttggctcaggtttaagaatggtagagtaggtaggatcaaatatgaggcctttggcgattaggggaattatttctctaaaccaggagtggaactttggctaaacagagcatacacatccttagaaatcttctgaatcctgagtgagacctcagcttgatgtcagggcccagttccaactctacagtcatcccctggctccagaatacctctcccctgccctgtccagtgaacaaaattcttcttaatggactagcaacacatttcccttgtctccaagctacacagagaatcatctgcttagaaatcccatatgggggcctttttctggtcgcctttttctggtctgtggccaacctgcccagccccttgccatgctcaaaaaagtccagtcaacactacaaaagggaaaggtgccttaatcttttttgagccttcagctacctcatgtggtagcacagctgatgctttctgatgtttgtaagtgctattaatcttatgggtggcagttttacccacatagggaggggttagaccccagcttctgttggtgatgataatcaacttgcagacagtgataggaggggctttctccttaactctttgtcatcaggttccttttgctcggtatttggcaatgaataaactgaccaacattaaacgctaccacatagcaaaggtatatcggcgggataacccagccatgacccgtggccgataccgggaattctaccagtgtgtgagtgttgggaaaccgtggggcaggatgagttacttggggctctctcaagccagcagaatctattgagtactcacggtgtcctgagcaaattggatgacccagataatgctcttagggtttctatggtggtttttttgtttgttttttgtttttttgagacggagtctcgctctgttgcccaagctggagtgcagtggtgcagtcttggctcactgcaacctctgcctcctgggttcaaacgattcttctgcctcagccacctgagtagctgggattacaggcgcctgccactatgcccggctaattttttgtatttttagtagagacggggttttaccatgttggccaggctggtctcgaactcctggtctcatgatccgcctgcctcggcctcccaaagtgctgggattacaggcgtgagccaccgcacccagcctcttctatggtgttttcatgcagatttcacaaaatccctgtggtgggggaggagaataaagtctcttcattttacatatgagtaaacttgatacccagcccatgaagagatcatagggataagaaaggcaaagtcaggactagaactcttggtccagtgctctttattttaaaccacagtgataggatcacagcagagaataaggaaattagctttgatacatcaaatcatccagactgatgccagggcttctggatgaatagggaaaatggctaagcactaaagccatataatcaccccatccagtaggaggagttaagaagatgatgaagtagaaaatgaaggaatagcccagtagatggaaaggaaaccaaaactggtgagaagcccaaagatgccggggtttacctctgggctgatgatcagaaaatgaaagagaaattctatgcttgagtgcaaccaggccttcctagaggacagagctcccagagtccccccttcagaaaggtgaatccctgaagaccgctggctaaccctctccctgcaggattttgacattgctgggaactttgatcccatgatccctgatgcagagtgcctgaagatcatgtgcgagatcctgagttcacttcagataggcgacttcctggtcaaggtcagagctgacaaggctgggagggcaaagttgggcctggcctctcacaagagaagatccttgtgcagagggaccagtagcctaagtgaccatgactattgcaggtcatgtaagaaaagagattcccccctcactatgcattggttccttgcaggtaaacgatcgacgcattctagatgggatgtttgctatctgtggtgtttctgacagcaagttccgtaccatctgctcctcagtagacaagctggacaaggtaacaacccaagtacttgacttcttttcccagatcccaccctgccttgggaaatggaaaacaagattgagagagagagaggtgcatgcctctatacccaccagaggaaggttagccccaggatgtaggctcatgggcagctactgctctaaaacggttccccgaggacagtacacacttgctctgtggtgcggaagctgcccaggggtccctgactggtgtctgtctgcctaggtgtcctgggaagaggtgaagaatgagatggtgggagagaagggccttgcacctgaggtggctgaccgcattggggactatgtccagcaacatggtgaggaacagaaccaagcctccccagcagccgtcccactgccctcagtcctaaagttgaaactgttctgtgttatgtatgtaggggagtgagtgtgtctatgcatatgtacacacacatgcatgggcgactagagtccaggcaagaaggtcaaccctccttaccttttttgtttccttgtcagcctcactcacaagtctgtctccccaggtggggtatccctggtggaacagctgctccaggatcctaaactatcccaaaacaagcaggccttggagggcctgggagacctgaagttgctctttgagtacctgaccctatttggcattgatgacaaagtgagtcaagttggggacgggatcccttctgagctctggggcttcaggtccctgatcttaatctggcactgaccattttcttatctccacagatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggtaggtcctaggaggtaggtagaagatagtctgagcaggtggtggcacctaagctatctgatctccaagggagcaagtggtgctgctttgggcagggagcatctcacagaaatggagaaaagattattgctctttttcacagatttctaccccattatatgtaagttttatggatctttaatccataatctttctgcactcaatcctctgctctgggtctctacttccttcagggctgtcacaaacctgggctggtgtatccaagacttagatcttcctcatgatacggaatacttaacattttactgccttgtgccaggcactgtgcttggtgcttttcatgcattatcaaaatataattgttactacagccctgtgagagtagctaattttattaattgcattttccagatgagaacactgaagcattatagatcaaataatttgcttaaggccatgaaacttgtaagtggtagggtcagaatttgaatccaggcagtctgactccaaagtcttgccactaaccacactgcaatactgtctctaaatgggaagcatgtgtctgaggccctgggatccctcagatggctaccgtgactctctagcacctagagtaacaccaaggaagcctcttgtagcctcaagccctcctttgttgctgctggtcttaagtggctggttgcatttcatcttctgggaaatgctctggcaacctccccacagtcctatgccttttctctagggtggaaaccacccatttcccagttgagatcatttttccagtaggcatcttacattctaagaactatgaaaatagttttcctgaaaaagacaagggaagcagcagcagcattctcctttccccacacccatatacacgcctgtgccctgtaactgaagtgtgagaggcacagtgtcataaatgggtagatagtaagtggggactaaaactgtcaagggtgatctaattggggtgggctcatagtagtacttctgtgtgaatgctttggtggacccttaaggtactacatggaccagcctgggcaacatgatgagaccctgtctctacagattaaaaaaaaaaatttttttttttttttaaattagctgagtatggtggtgtgtgcctgtagtcaggaggctgaggtgggaggatcacttgagcttgggaggtcgaagctgcagtgatcacaccacggcacttcagcctggatgacagagaccctgtctcaaaaaaaaaaaaaaggtactacatggagataagcttgaagttactgtaaaaaagctacctttactcttgccctaagttatttattctgatacgtcctatgtacaagtcagtcagttcagtcctcatatctactaaaagctacctttatgcccaaggtgctagatgagaagacagggcccctgccctggtagagctgagttgggcctggtctcaaaatcccgactagagcctgctttgtttgctccttgaaggtgttagcccagctctcttttatctgccccttccccaggctttggaggagaagatacggaccacggagacacaggtgcttgtggcatctgcacagaagaagctgctagaggaaagactaaagcttgtctcagaactgtgggatgctgggatcaaggtatgggaggcaagccccagggtggcagcaaacttaggtgtgctggacacaaactgaataaaagctcacccataatggatcctgccattacttctcaaaagtagagctaagaacagggtgccagcttggacaccctctgtccctgaggacagcagaagccagccttcatcttctgctcttgtcccctgcaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtgagggaggtgggcaggaaggctaagggacagagaatgtatgccattttggcaggcccatgcccattcaagacctgagaaaaagcctggcattgatattagtacaactcataaaagccttgagggcttaacctgttactgtggtcttagtagggtgagatctccatccctgcatataccttatggtttgttggctcccccaagaggcacactctagcctgaggtgtttaattaggttcctgctcccagctgagacaagcctgatgcctagagggctagaggaaactaggcactcggggagcagtggaatggaagatgcttataccaccttcttctcccatcctggccaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctcgggaggcagcccccgtacatacgcacccgcgactttgcagctttcacctgaaggtctgagcgaagcccgggcggcgcacgtgcagtggatacctccacccccctgggaggcggggtcgcgctcagagccaatgagagcttgcggggtggaggggtagggaagcttccagaggccggtggggaggaagttataaagagggtacgagggggccagctggagagccatgcagtccaagcgggattgtgaggtaagcggctggcgacttgggggccggcgagccccgccggagcgggggtcggctttagggaccccagtaccacaggagaggtgggggcgcgcttggcgatccgccattccaaccttcctttccctctcagctgtggtgtgagagggtgaatccagagaacaaggcggcgctggaggcgtgggtcagggagacaggcatccgcctggtgcaggtgaacgggcagaggaagtatggcgggccacccccaggtacggtagtcccagcccctccgcctgtccggctacaccagccccctttgggggaggggctgctccgagccttcactgtcagaaactgcgaactacccggatttataccccccagcaaaggaggaactgtggctccacgtccacccgccccgtcgagggagggggccaatctcaaggtgtacctactctgtgccagcccccttgttagcgcagtcacctaattatgccaaccacccagggtacgggtgtaaacccatttcacagacctttgttcacatcgcctcccacccccgcgcgctgggtccgtgggctcagaattcgaaagcgtcgcctgacggtggccttgcataccctcttcccacaggctgggtgggcagcccgccgccagctgggtcagaggtgttcatcgggcggctgcctcaggacgtgtacgagcaccagcttatcccgctgttccagcgcgtgggccgcctctacgagttccgcctgatgatgaccttcagcggcctgaaccgcggcttcgcctatgcccgctacagctcgaggcgcggcgcgcaggccgccatcgccacgctgcacaaccatccgctgcggccgtcctgcccgctgctcgtgtgccgcagcaccgagaagtgtgagctgagcgttgacggcctgccgccgaatctgacccgcagcgcgctgctgctcgcgctgcagccgctgggtcccggcttgcaggaggcgcggctgctgcccagccccggaccggcgcccgggcagatcgctctgctcaaattcagctcgcaccgggccgctgccatggccaaaaaggccctggtggaaggtaggctggggcgggggtgctggttggggccaaacgcgttctgcccggcactttatactgagcatagctgttaaagttacaagatcttagagtcaaacatgccagaatttgcaaccttttactatttgatctcagatttttaaaacttccaatggtgctaccaccaccgcttacctaaatttgtgacacttcccgagcattacctcctgacttaattctcaaccttcccccacccccacaccgcaaaataggcacaggaccctcaagctatgaggaaactgttagagaaattgatttgctcaagggaatccaactgagctttttactactatagaatctgtttcctcagactgttatgagaattaagtaacataatgggtgtacggtacttagcacactgactgacttacagcaagttttcccagtaaagattagccattatgatggttatgaggcagacaaagcctgcaattaaccagtacttctccaaggaaacttgtaaggtagcagtgtgttatactccctttgcaaataatgga

SEQ ID NO: 14954 - DNA, 11876 bp, Human
atttttattgttagatttcaaaaggtttttatttgtttgtttgtttttagagatagggactcactatgttgctcaggctggtctcaagctcctgggctcaaatgatcctccccttgtggcctcccaaagtgctgggattacaggtgtaagccaccacactcagccagattttttttcttaatcgtttcttttcccctgaatggttttgatccacagttggttgaatctgtgaatgtgggaccttgggatatggagggctgactatacctatttaggcatctagtctcagtctcagggtaaataaacgacataaataactacttaaagttggtgtaataacaaatatgtatgaagtgccaagagcacctagatgaaggggtaaacagttctgtttatagaacttacagaaagtggaactgaactggaggatgagctcagaatctccaacctcattccactctactctccttaacttagttctagccatgtagatcatcctctagttcctcaaaactaccaaagttctttcccactttagggtttccatactctacctggacctatctttgtcacacttgtcctctggctatctcctactcattcattagatcagttagtatatcacttcctcagttagcctttctcagactccccagttctcccttatttttctcagagcaaccttaatttctttatatcatttttcacaatatgtaattacataaccacatgtggtggccgggtgcggtggcacacgtctgtaatcccagcactttgggagactgaggcgggcagatcacttgaggtcagaagttcaagaccatcctggccaatatggtgaaaccccgtctctactaaaaatacaaaaattagctgggcatggtggtgggcacctgtagtcccagctactcaggaggctgaagcaggagaatcgcttgaacccaggaggcagcggctgcagtgagccaagatgtgccactgcactccagcctgtgcaacagaggatactctgtttaaaaaaaaaacaaaaaaatctgtgtgggattatttgttctaagtctctctccttcagtagaatgtaagctccatgagggtaggctatattgtccaccatggtatatattcagtgctttgtatagtgctagagacatagcgctaaatacacatttattgaatgaacgaaggagtagcagcagcaggctgactcccctgatcacccagctggcctagtttctgccatcactttgccatcccagaatgactcaggtagagtccagtccagcccagcgcccagagcgactgtcctctcctctgcagcatttcagatcctcctcaatgacctggtttagggaggcagacataagcgccccgtgagtagagttagagactttctcagtggctccctacaggaatgatattaccttgggggttttgagcacaaatttctgtttgctttcatcaggacccagctgtgccttcagtttcaggagtttcgccacctcctcctcgatctgtggagggaaagaaggcgctgagctatccatctgtcactctcctccctcccccgccattcattcaatattcctccctcatcacatctctctgctcaggcctagctttgtttctctcgggacccaccccggatgtctccccacgcagcccactctcctccctacaagactggtcgcttccctcacatctctaccctatgtcccgaacaccctggctttacgtcctcccaggctttgccttggccctctcccctgctgcctaaatctcaccagctcggcgctggccttctgctgcttgaggcctcgcacgcgctctccctgaagtttcaccagctcctccagcgccgcacgctctgccatcccggctgtccacttgagccgcctgctgtctcgacctgcggtggttgccccagcctcagcaaggatgacttccggctatcgagtcgctgggtcgcacgcctagagagcctccgccgagcacaaaaattatttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggtgagcgagacagaattatctctggtctgtcccagcagggtctccagatctgaacgcatagcctcgcggcctgtattccagtagtgttacaatcggtttttatcgagtgcccactatgtactgacactgaactaagcgatttggatgcctggtcatttaatccttggagcaatcttgagaggttggagttttgatttccattctgcagttgaggaaacggaggctgcaagattaaatgaatgacttatacacggatatgtagtaagggagtattttaattcatatccacactttttcctgaaactcttggactcaaacagtaacatttttaagcgaaatatatgaatattcctagtaaatgagatgactaaagatcagaagtagactgagttcatcttagaatttacctcaaaatgaatctcagaaaaacattttcagatgtcagagagttttggattttggaattgcagataagggattgtgtacttgaacttggacttctcttagggcagataatcgccatagtatggaaccaccacatcctctatttttggaagggcatacagcgtgctggtaatgtcactgattaagttttgccttacttcggaaagattctaatgctctcttagcagatgctttgtgctatcgtgaacaatagggcacagatcttttattgatattcaatcacagcatcttatcagtctgagttttttagctcattcaagaaatccatatcttatcattccacaggcttgttctgtgtccttgagctggttcccttgtcttcaagttacagttttcctctctctaaacctgataaccagtgctaccttattaaaaattattatttttttgtccgggcacagtggctcatgcctgtaatcccatcactttgggaggccaaggggggtggatcacctgaggtcaggagtttgagaccagcctgacctgtatggcgaaaccccgtatctactaaaaatacaaaaattagccgggcgtggtggcatgtgcctgtaatcccagctactcgggaggcagagacaggagaatcgcttgaacccgggaggcggaggttgcaggagctgagatcgtgccactgcactccagcctgggcgacagagtaagactctatctgaaaaaaaaaaaaaaattatttttgctctttcagtaggaacggtgacctggagaagatcaccataatccctacccctgaatggttggtgttggtagtggtgggttgttcagtgccttcattattctcagattcttaaagtatttgagaatattaaaaatgcggctgagctcggtggctcatgtctgtaatcccagcactttgggaggctgaagcggttggatcacgaggtcaggagttcaagagcagcctggccaacatggtgaaaccccatctctactaaaaatacaaaaattagctgggcgtggtggtggcgcgcctgtagtcccagctactcgggaggctaaggcaggagaattgcttgaaccaggaggcagagattgcagtgagccgtgattgtgccactgtactccagcctgggcaacagaccgagactctgtctcaaaaaaaaaaaaaaaaatccatatacagtgaggaagcttgtgtggtgaagacctgacctcatatatattacacgtgtaattgtaaatacaacatagattctttggggtgggactgagattgggatagatgaaatggtgctttggcttcctgttgctcagggtgaagagtctttgcaggttggtggtcaacagggtcagagatgccacaggtctggccagtgtccagagaagccacatctcacattcattcttctgccaggttgcagaggcagtgttaacatcccaactgaaagcacatcaagagaaaccaaattttattatcaagaccccaaaggtaatactttttgcctaccctatcccattagagtgccttggaggactgacctctgccttgcatgtctctctgaccccttttaatgttctttacagtaaattttaaaaatatatactattcttgagatactaggtgcggctcagagtcatttgaactcagtagatttcagctccagacctgagattacataataagtgtagtttaactccttgtctgaaatggacttattttttgtttttgttttcactatggctgcttttggtttccagggtaccagggatcttagtcctcagcatatggttgtgagggagaaaattcttgatttggttatcagctgctttaaacgtcatggagcaaaggggatggacaccccagcatttgagctgaaggtaaggggagaagaaagagtacgtgcaacctcactcacttcttcaatggcgttcagtgtcccaaagggcttctcatctgtgttttggagtcatgctttcaactgtggctcattctgtttgacccctataggaaaccctgactgagaagtatggagaggactctgggctcatgtatgatctgaaggatcaaggtggagagctgttgtccctccgctatgaccttactgtatccttttgagtactggagcctgacctgtctctttccaaatccagcgggctttctctgacaaaagtggagaacgtgactttgggatcttagaggtccattgcctatacttctagtttctcccagaaggcagttctgctacggaagcctggcctggagccctgtcatttaactctagtgtgtatcataatcctttgggggagcttgcagaagcacagacatttggctgcagtcccagagattcttagctaattctgtagctggaatggggctcaataatttgtattaaaaaattgttttttttggccagacacgtggctcacgcctgtaatccaagccctttgggaggctgaggcaggtggatcacctgaggtcaggagttcaagaccagcctggccaatatagtgaaaccccatctctactcagctcctgctgagctctggggctctcaggttctgagtctagtttgggactgactgtcaccttgtctccacagatctcttttgacgtaaaaagttagctggctgtggtggcaggtgcctgtaatcccagctactagggaggctgaggcaggagaatcacttgaacccaggaggcagaggttgcagtgagccgagattgcgccattgcactccagcctgggtgacaagagcaaaactctgtctcaaaaaaaaaattttttttgtggagatgggtgtctttgttgcccaggctggttgtaaactcatcgtttcaagtgatcctcccatcttggcctcctaaagtgctggggttacgggtgtgagccactgcatctggcctacagtctgcattttaaacaagcatcgtgggtaattaagatgcatgtagtcctttccctgcactttcagaaccagtagcttagaagttgttaggcaaatccaagttctgaagcttgactattttgagatggttcggaatcgatctgaatgggcagaaagacctgaagttagttcttgggtcacttctatctctacttgccttgctttctgctgaacttttagttttgctaggtgagattccttcatttgacactattcaatatatattgaattccaagcactgctaggccttggggatagtggaaaaaagggaaggtccttgttcttaccctagtggatgagatccaggcccagtcctccctaatgtctgtatactgggcctaatctttggatgcagtatccctcttccttaacccatttatgtgaggttccctttgctcgttatctggccatgaataaggtgaagaagatgaaacgttatcatgttggaaaggtgtggcggcgagagagcccaaccatagtccaaggccgttatagggagttctgccagtgtgtaagtgacctgatgggagcagcacagtttgatagttctaggggccacaaccttgaaactggctggataatggatgttttttcccatctttttctttgctgtaggattttgacattgctggtcagtttgaccctatgatccccgatgcagagtgtttgaagatcatgtgtgaaatcctaagtggattgcagttgggagactttctcattaaggtgaggccagggctgagaactgtgggagaagtctggatttggcctaatactgtttatgcaagtcccaaacttgggtgactccaacccttaagcctgcaactgtaggactttcctagtaaagctgttgtatttcctatatgtctgtactcttcctgtgaaatttccatcctttttgtgtgtcaggaaagtaggtactgccattgttttgagtggaagggcattgacaagcacttgggtcactgacattgagttctcaggtaaatgaccggcggattgtggatgggatgtttgctgtctgtggtgttcctgaaagcaagttccgtgccatctgctcctccatagataaactagacaaggtaacaaagaagacatacttcagtagaccctatctagcttctgccctgccctcaaatccataccactagtgaaaaataaggagattgtggctggaagtgggctattttggggtggaaggtaaggaggcatactctgaaggaagatctgagtcatgctatacagtggggattgtgactggatttcttaagctgtctctgactttgctgagtatacagttagctacttgtgatgtatatactgaatggaagttgagttgtcctttttcagtttgagaaagaaagatcttggggctgggctaatgtttgggtgtttatgcagatggcttggaaagatgtgagacatgagatggtggtgaagaaaggcctggctcctgaggtggctgatcgaattggggactatgtccagtgtcatggtaagaaccagggttttcagagctgtgatagaaccaggctgaaggtgacatgtgctcaaattctacctctgaaacaactcttttctgtagatatgctaagctccagggcctgtcctgaatttaatttctcttttacttattgtaacgactttgtgtcttcagatggcaaagctagaggcaaaggaggagggtcttgtcatgtgagactgggatcttttttttttttttttttttttaaagaaaatgaggaagactagctagagcacattagggataattttgaatgaaacacatgtgagtgaacagcagagactttatttctctccaggtggggtatccctagtagagcaaatgtttcaggatcccagactatcccagaacaagcaggccctggagggcctgggagacctaaagctgctatttgaatacctgactttatttggaattgctgataaggtaagctgaattgcaaatggacctcctgctgagctctagggctctcagggtcccgagtctagtttgggactgactgtaatcttgtccccacagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaaggtaggtcctagataggtgtgaggtggggctggagacctaaaaaccctcctgtttctggaggtgtagttggagtggttttctgatgattctttttgtcttgatttttggaattgctggtggaaaggaggtttttattagttttactttcttctctcttattagaccaaaggtgagaaggtgcggactacagagactcaagtgtttgtggccacaccacagaagaactttctccaagaacggttgaagcttattgcagagctttgggattctggaatcaaggtatggtggagctgatatctgagccatctgggtatgtgtggaatttaggacccagggctatatctatcttatgtctggggtggaactcaaaacctttttagtctgctagctactactggctactagattggctttttagggtaggcggactagccacttatctctggctttcttggatatccatgttcctgaggtttgttgctgtgttcacttctaagtcccttactctgtcttgatccttttcaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtgagtggcggcagcagaaatagaagggacgaagtgtttctgcctttcccagattctgtaagaaatatgcatcttctggctgagaaattatcttcatggttaatagtggtagagatgaacaaacactcactcaagatgaccattgctgcctgtgagtattgactgggtggccagaagaaagacaaatgaaatccgaatgggtattttgagactaatcaacataatagacatagatcaggtgtttgaatccctttcatcttgagggtatacattcttcaggtcaacccacactactcctttctggttgtataagtaatgggagaagatgcagagtaaaacaaatctggaaaaacagtggctaaggagttagtatcactttctagtttatcacatgaggattctcttatgtttcaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagtagtttgggtaatttgttattgttatcaagggctttgtttgcatagaccatagaaaatgcttgagtgtacattggagaattctgtgaggtagaagtaacctccctgggatgatgcttctgtattcagtgatgagcagccacagtttctccctctttccctgtctcctcaagaggtagtttttttgtttgtttgtttttagacggagtcttgctctgtcacccaggctagagtgcagtggcgtgatctcggctcactgcaacctccgcctctcaggttcaagagattctcctgcttcagcctcccgagtagccagctaatttttgtatttttagtagagacagggtttcaccatcttggccaggctggtctcaaactcctgacctcataatccacccacctcagcctcccaaagtgctgggattacaggcatgagccactgtgcccggccaagaggtagttttgttgctaaaaatcaacatatagtgagccggtatgccacagtgcttcactctagagtgttgttgatgactggcctttccaaatccaattatgctgattaaattatgttctactataaagttccccagatgatggaaaaataagtgaaccaaagggtggtagcattgcttcaaggaaaagagcccaagtgcaaaacatgctttttatatgtgcgtcgggaagggtgcctctgttgcaaacgtttcagtgtagtttagggtcatatccctagtgcatgcaggtgaatgagaggcatctagaccccctaatggcgcttcggccttaaaaaaggtttagaaattcttggcagtggacgcaaagttgctagactagatcagagaccactgttttgcgaacctcagtttccttgtttgtaaaatagttgaactaaatcttgaccctttaatgcttgttttgaaatccaaggcaaaaaacaattgcaagcgcccttacttccgtgttgcttcatactcctcttgcgcctgcgctgtctccttggagcagaggcggggccaacaagcctgttttagaaaccctccagtccttagctcgtttagaacacaagactccaagcttattggagggctatcttgccttacggctccaagccgctttttacggcgtttttcagctcgccattcacttcgctgtgaagatggcgtcgggcagcggggtaggtgttgtgtctgaggaggaggttttgcggggtggggaatggtttttcagacctgaatagagacaaactcctgcacccgactggcttcccgatatctcctcgagatcccagggttcaggttcaagaactccccagtaataggccttggcagagggtcagtagaatcgcggaggtttctcgggttggggtcttgaggctacctcagtcttctcgtacagtccaaagaggctttgctttcaaaacgtcctgtagacacctggaccgcgagggcgcggttccctgcttctctaggggcccagacacggcgacggatcttgacgctttttcctccccacagacaaaaaacttggactttcgccgaaagtgggacaaagatgaatatgagaaactcgccgagaagaggctcacggaagagagagaaaagaaagatggtgggtgctaactacatcaagggctaagggtatcacagaggcgatgcgatgatggagagcgggtgggagttgaagtgcgctgccttcccacgcggtgtaagctctggcagagtgctgcttccctgggcctaggtttctgcatttacaaaatgagagcgaggaggtgggatgaagtaagtagttttgagatgctcttcagctctatttcactctgcttccttgcccaccctttgcttggctcgtttaatgctttcctgaagtacagagaagataacggcatccttagtagtgacagagaagttaagtagagtattttgctgctgtgcattaccgctatcagtgacccccctctttcccttgaaatttcttaagggagagaacattcctggcccaatca

SEQ ID NO: 14955 - DNA, 27317 bp, Human
atggctgccactttcttgtcacaaagctcttggttcaaatgttacttcctctaagagaacttcttgagccctagaacatcagccttctcgccaaatgaaatgatcttacttgttttcatgtttagtgtctattgcttcctatcccctagaggatgtaaactccataagtgtatgaattatatctttcttgttcactgctgtatccctaggtccttcaacaccgtctagaacatggataccctcaataaatgttttccaggaaaaaataaaggatctgaaatgatgtctattagagtcattcctttcaagctattcctgggagaggtagctgatcaagctgtgatcagctagtaacacagctgagtgaattcagtgagatgatgactttgtgtaggtagaatctggggactaaagagaagggacatcacaaaacgaagtaagttccaatgacccagggtaatttccatggcaccgctggtcagggagctgctataggacttgggtgtagacaggtgacagaagggtgggggtggagacaggatagaaagaggctgggtcttagaagcatggtccatcagagggggcctggagggccactgactcaggtcttacattccatcgagatctttaaatttaggctgggagtagtggcttacacctataatcctagcactttgggaggccgaggctggaggatcacttgaggcaagagttcgagattacagtgagctgtgatggcaccactgcactccagcttgggtgacagcatgagacctcgtctctaaataaaataaaataaaaatcaacttttaaaaagtaacaactttcaaacttagtcttttaacattatttagtattttgatattatctccaaaagaggttacaaatagtcacagacacaccaacagggttgaaaaaaatgctcatttgtataactgtaattacaaaatgcaagtatcaagaatattccagaactcatctttcttttttttctttgagatggagtctcgctctgtcacccaggctcgagtgcagtggcaagatctcagctcactgcaacctccgcctcctggttcaagcgattctcctgcctcagcctcccgagtagctgggactacaggtgcccaccaccacacccagtaaatttttgtatttttagtagagacagggttgcatcatgttggccgggctggtctcgaactcttgacctcaagtgatccgctcgcctcggcctcccaaagtgctgggattacaggggtgaaccaccgcccctggcccagaactcatctttcaaaactggcccgcagcatctgacacagttgttttcctccttctggccaccctctcttcgagcttccaggacactatactctcctgattgtacttccttgctggctactccaagtctccactagtggtccttgctcatctcatcatccaccccagattgtccatttccagaaggcagcagagtgagccccgggggcctcacctgaagttcctctgcaggaacagcctccctcgaggctggcttcctcacttcctaatagtcctaggctgaaggtcactttctcagagaggtctctttcctaccaccctacttaacactgcattccctccaatcctctctcccctcttccttcccttaattttctctagtgctcactaccaaatgacatgcatttcttgtttagtgcttgtctcccctgactagtatgtcagttccaggaaagcagaggtttgtcttttgtttactactatttattatctagcacagtgtctgacacacaataggccctcaaggaaattctgttggtcacttttcaattttgctggtttgcacttaaaaatatatagggagccttaccaggagccctagaccgaacgtgagtctaaggattggtatggttttcctccatacaacggctaaagcaagggacagagccgacactcaaggaatatttcttgaattaatgaccttctggagtggggtagcattgtgtcaagtttgcagggtgcagcttggatgtggtgctagaaggggaagcctctgggctgagcatgtaggctcgtcagtagagttcaacccgcaggagtaaattactgcagtgggaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtaaccgctcccacccgcagggagcccgggccccagggaaccacaggatctccgccggccgcgcccctgggatcccgtcccctctccgaccccgcccccagcccgtgttgcccggcaaccggtcggcgagcaccttgtggctccatcctgcagaggacagtggggtcttagaggaagagcttttctgagaagttgacgttttcttgtcatcaggcacttggagtcaggcgaggtcggggtccctggacatagggagcttagaaaagagacgtctcctgagggaaggggtttggttcgggttagcagtaataaccgaccccagattcaagccaggggcctctgcttgtcacttggaactcggaattcctctgactctctaacactgcttcttcttcctttttttttttttttttttgagacggagtcttgccctgtcgcccaggctggagtgcagtggcgcaatctcgggtcgctgcagcctccgcctcccgggttcctgcaattctcctgcctcagcctcccgagtatctgagattacaggcgcccgccaccacgcctggctaatttttgtatttttagtagagacaggatttcaccatgttggccaggctggtctcgaactcctgacctcaagtgatttacctgcctcggcctcccaaagtactaggattacaggcgtgagccactgcacccagcctttcacagtcctttaccgaacaacgacaaaagaatgcaatacaaaaattaacttattcaaattgcacttttgatccttgcccatgtacattcagttctttccccgtaatttattcactaagtattaggtgtttactatgtgcgattactgggcaagatgtgagagtcaaagagataaaagagaaatcatgtaacattcaccagacttctactaaacaccttctgtatagattttggagactcggatgtaaaaggagtccctactttcagaaagcttatagtccagaagctaacagacaaggcaaatcagagccctgtgtatttgacggaggcatgcccaaaatacatggaatgtagtgacaacgctaataacttataacaggcacaaaactttattacatgagtcatctcagcgtcgttgtcacaaggccaacggcagcagcatggcatagggatggtgtttcttggctccagtacctactaatttcatgaccttgggcaaggcacttaataatagtacctaatacgtggggtcatgagctttaaaaaagttaatacatgtaaagtgcttgacatataggaagtggtcactgattgttacctgttattttctttttatggttctcactttattgactagaaattgcagttcagagaggttcaatacagtgcttggagccactcaactagaaagtgtggaatgtggtcagagtgcatgttctctgatccagtgtggatttaataagctaggatttgtgtaacaatttatagtttttaggacacttccatgtatattgtatgttatatgccttgggatacagaagtaaaaaataaggcttcattttcattaagtagtataacagagttaagctattaatacggggtctggcacatcatgatgttagttattgttacagttagaagtcactgacaggctgggtgcagtgactcatgcctgtaatcccagcactttgagaggctgaggcaggcagatcatctgaggtcaggagttcaagaccaacctggccagcatggtgaaaccctgtctctactaaaaatacaaaaattagccaggtgtggtaggtgcctataatactagctactcgggaggttgaggcaggagaatcacctgaacctaggaggtggaggttgcagggagccgagaccgtgccattgcactccagcctgggcgacagagtgagactcggtctcaaaaaaaaaaaaaaaagcactgacaaatgccaaaaagaacttcatgttgcttgtgctgtaggtgcatagcagatttataaatgggctgaaaatatcccattggtattaactcagcccctaatttgagggcttactatgtgctgggcagtcttcttagctctgcaggtgcattggagaatgtgacagacaagtttttgcccccttggagcttacatttgagagggggaaccaggtagttaactgaatatgcaagtgttttcataggagaaaaagaataagggattcagtgtgatgggagcttggtgtcttagacaggtggtcagatggcctctaataacatttgataagaggtttgaaggaactgaggaaacaagctctgcagatttgtgggataagcgccttgcaggcagagggatctgcaggtgcaagggccttgagctggagatatgcatggtgtgtttcaggagcacaaggaagccgctggggctggaaggcaatgagggtggtcatgaggtagacacaagccagatcatataggaacttgtaggccatggcaaagaccttggtttttatactgagtaagttaggaagtccctgaggattttgataaagtgggtgttggaatttgctttatgttttagataaaggctaactggctggtatgtggagaacagatgttctgtgacgggatgtagggaggtaggtgtcggagtagaagcagggagatcgggcagaggtccctagggcagcccttagatagagtgtgacctggagtggaaggcaggaatgcttgattgtagggctgttgtcgaaaatggcctaataataataataataataataaataaaataaaggagatcccttgtcctgtgtaactggatggatactttgtgttcagctctgtaaacaaatctaaaaagttctgacctgatcttttatcttgagaccttaaaaagaattagtagtattttatgactcaagtaatgccatgaatatattttcttaaaagcaattaaaacattccagctagggttaaagcctgcatgtctagaaacaggactttatccttacagctgggaccctgttgtgaacatggagctgactctgagccttagcaaggatatttttttaaaaggaatctctggccgggcatggtggctcaacacctgcaatcccagtactttgggaggctgagaggggcagatcaactgaggttaggagttcgacaccaacctggccgactgaaaccctgtctctactaaaaatacaaaaattagctgggcgtagtggcgcacccctgtaatcccagctactcgggaggctgaggcaggagaatccctaggacccaggaggcagaggttgcagtgagctgagattgcaccactgtactccagcctgggcaatagagcaagactccgtctcaaaaaacatataaataaataaaaggaatctcttgcagggtgaatattagagttttcctctggggacattttttctctcatggtaatgcttaggggtcagttgaatttatattgtttgcagcacctcctcagctagaacaaaagtgtgaacttcagcaagtcctttgaaagccctgggagtggtctttttgtcgtatgactgagattggctttctttccttgcctgaagggacagacttgtctccctgtggactctctttgagtgtagagaacagcaggagggaactgggggaaagtctgactcctgagatccttgttgctcttgacaaaaattgcaaactctttccattccggtaagaatgaatatggagcccgtaagctatttctgctcctgtactttctcagcatattggatttctggaaaactttgtaagaattggtttgttcagaactgttataaaaggaagtgtgatgtggtggtggctggagcgcagggcctggagcacaccaggctcttgtcttagccctgtcaccagtctcaagaccttggcaaagggccttaactcttccgacctcatatggaaatgaagggttggtgtcaggttcaaatgcaattaacattgaccaaggcatgttataaagtgttacacaaacggaacatgaaggcagtgttcagtggctgcacgttttctatgtttttagtcaattcttttgaaaattattttttgttgaataggctgccttgggtaggtgttaatttaaaattaattctgtttggatttatgtgaaagagatgaaatactcatgtaaattttaaaaattttagaactagaaggggctagagggatccctagtccagtgtttttcatcctcccaacctttttggtcatattgcccaccttggaacttttttagaccaagaaaattttcccagtgaaattctgatacctcagatatactttgtatctctttttgtactgtggtcctgcgaagggctacacgattccccatcgcaaacccatttacctgtcctgggagtgatctcgcccctcttaagactgcattttatagtccaaacctcctttttacaggtgaagtctaggaaagttgaataatttatgcagacactcagattatatttatgatagttgaaactgttgaatttattatctttgggctaattacttagttctatgtcactggtataaactgtgaaagccttcaagatacttgatttgcatgactcggtttaagtttgtgaaacaggtttactaactagcagaccattttaaggtctaggaagtgattcattaggtgcttggatgaaagataataaaggaagtgtttattctgttttccatgatcttcttggtgtgtggcaatcacattgaaggtggtagcagcttattctaggttgatcgggaaaaggctagctcctaagagtgctttgacatcctgctggtgggtagcatgtaagctggcctggtaagcagtgactagatcttgttcattaccttgttccttacaaggctaagaaccactggatttccgtgatttcataatgactgaaagttgtccatgcattgaactatgtacgagtgttttaagtttcataggagattaaagtgacctcttgttaatgtggatgtgttaataacctggttcttttttaaaaaaatgtatgatactaattttttatattttaagggaatgtaattagttatttttgtttcaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggcaagtataacctttataaccataaaattgtcattactcattaatgtccattttttatgcttagaagagatcagatcatttattttggtctgtttgttgtatgactgttatagtataggtaaacaacatggagattttgctgttaacatctgctttatgtactcggaacttatttatttggttatggttgctaatcgcttggtgacactcgagcttatctctatgaggtatatctgtgatactgccatctgtcaagatctgttgagaattcagccaagagctgggaagccaatagacaggtctcctggtggacttgcattcaagtttagtgcaatagtttgtagaagcccttactgtagcctgccacctacaggctgctgcaactttaatacccaagcaattcatatttgttacagaaaagataaggaagtaaaaagtaaaagaaattacacctattttttcatctagaaagagcacttaactgttgagtttttgaatccagattttttaccaagcatatatgaatacattttgtagtaaaatggggtcatatatacatgtagccttttacttgtttttaccctatagcagctttattaagatatgattcacatgtacaactaacctacttaaagtatacaattcagtggtttttagtgtatccagagagctgtacaaccatcaccatcatcaattttcaacatttttattaccccctaaaaaacccatacccattagtatcactccccatttttctttaacctcctaaccttaggcaaccagttatctactttctgtctctagaagtttgcatattctagacatttcataaacaatggaattatataatatgtaatcatttgtgactgccttctttttcttagcatgatattttcaaggttgatccatgttgtagcatgtgtcagtaattcacttttatggctgaataatattccattgtatgtatataccacattttatttatccatttatcagttaatggacattccactccctggctattatgtgtggctctttcattcaataatatgttgtgaacatctttatatgaagttactacatacccgttatgtcattcttattggttctgtagtatttcattgtgttaatgtaatttgtttaaccgttccatgttgttgaacatttatgttatttccattgtttctgtattacagttcatagtgtaataactgtatctctttgaccacttccctgattatttcctgaggataagttcctgaaaatgcagatggttttctttctttttgtttttgttttctgagacagagtcttgctctgtcacccaggctggagtgcagtggcatgatcatggcttactgcagccttgacctcatgggctcaagcaattctcccacctcagccttctgagtagctgggactacaggtgtgtactaccacacccagctaattgtttattttttagagagatagggtctcactatgttggccaggctggtctcaaactcctgggctaaagcagtcttcctgcctcagcttcccaaagtgttgtaattatagatgtgagccactgcatttggctggttttcttctttgtctattttttgttgaggtaaaatgtacatacatgaaaatgcacagaccttctgtgtacagttcaatgagtttggatccctataaccaataccccaataaaaatagagaacattttcatcacctcagaaaatattgttgtaccccattccagtcaatttctatctcccatagacaatcactgttctgacttctgtcagcttagattagcttttcctgttgttgaactccatacaaatagtgtctggcttctttcacttaacataatacttgtaagaattatccatattgttgcatataaaagtagtcttttgttgttgttgctaagcaacaaaaatagtatattccattgtgtgaatatactatggtttgtttatccactctcttggtgatagacaagtggctggacatttggattgtttcagtttttaacaaccatttttgtttaagacttgtttttaataagacttttttatataagactttttgtagatatatgttttaatttatcttgggtaaatacccaagagtggaattgctgggctatgtggtttataagaactttatgacactgtgaaactgtttttgcaaagtggttgtatcactttatactcctgcctgcagtgtaggagagttccagttgctccacatcctttgtcaacatttgttgttgccagtctttaattttagccattttggaaggtgtgaagtgatatcttaggtgtggtttcattttgcatttccctgataatcattgatgcagagcaccttttcttgtgcataaatggacatttatgtgtcttccgtgaagtgtcttaagtcttttgcctattttttattggtagtttgtctctttattattgatttgtagacatttcttggatatactggatacaaactctttgtcagatttatatataataaatattttctcccagcctgtggcttgttccactaggcatgtgtcttttgatgagcaaaagttttgcatttttgtgaagtccagctgatcacattttttctttagtggttaggactttttctgccctttgcctatttcaaggtcacatcgtttttgttcagaagtgaaatcgagtttaggactgtattagtcagggttctccagagaaacagaaccaataggacatgtacatattagagggggaaatatttattttcaggaattggcttatgcagttgtggagcctggcaagtcaaaaatctgcatggtgggccagcaggctggagatctaggagagaattgatgttgaagctcaagtacaaaggctgtctgctggtagaatcccttcttccttgggggaggtcagtcttttttctattaagtccttcaatacttgatagaaagttcttaatagaaagtattgaaggacttaatagtaaagtagattattatccatatgtgcgtgggccagttaatgtgtgaggcccacccacattatggataataatctgttttactcaaaatctgctcagtttactcaaaatttggcccaattaatatgtgggcctgcatattatcgtgtctaagataatgtgtccttttacttttcttaggtagcagatggggcaaatgcaattgtgctggggacattgggagacatttcttcccctcttgcgattattggtggcaattgtgctctgcaaggtttcaatcatgaaggaagtgatctcttttggacggtatgaagaagaaaacattctttttggtacccttaagcatttttacttttaatgttcttttttaaccaccaactctactgagtaataatatttataattctgtgcattaaaaaaggatatgaataattcgaatagcattcattcgtgttttgtgtaatcctctccttcatgtagctaatatatttggagtaaatggagaaacgatggcatgctaatggtttggggttttattttcaggttactggagacaatgttaattccttggccttgtgtgactttgatggtgatggaaagaaagaggtatgtgggggaggagatatctctcttgtgtgttcagccaaatgaattttgccatgacagtgacattagtgttgacagaagtgtaagcttctcctggctgattttggtgctctgttgcctaaatgctcagccagttggccccattcgtctttctcttctcttttgaacaataaatcacttgtgcttgtgtaataaatacaaagatcaaagccatggtgtttcagagacacaggagagggcagagagggtagaagagttgggatttcagtcatattcacggtcttatgaattgctcctgatgctttgaaaccatattagtatatagttttcaattttggccaactgttttgaggaatctaaatgttttagagattggcttttagcctttgaaattattcttatggttaccctagaaattagcttcttgagcagttagtaggtgtgacgtgctgtgttgggcaccgacttgcccctctcttgtccatggacactggactctggtgtttgaacagggcttccatctgtaggcagagaaagttgctgatccagggagccttttcaggtactcagggaaataacgtattctggcaagatgtgcagctcccatggcaggataaaagctgcagtagcccctgttccttcattgattgaatctgctgatcctcccattagagggagcatttctgagcatcaaacgattatgaggttgtcaatcttgggtggcagaagcagcatgcaaagtactgtgcaattttttgttttgtttacagaaattttgttgtttgcacttactcacctgaacatgtatgatatttccccttcagcttcttgttggatctgaggattttgatatccgagtttttaaggaagatgagattgtggcagaaatgacagaaacagaggtaagaagctccacctcgaactatggtaaccttgagcaagatagatcagtactgtcagatgaaacatcaagtgagagtgctggggcatctccaaacccaggtggttttaggataaaagcttggggagggggtcagacagagctgtatgttatggtaagaaaagcaataaaaatcctaattaagatatattttgaaaagactgattaaatagagaaaaattattgcatatagttgaatacataaaggcatttcttttaatgagttaatacatgcaaataataataatggcaatcatttattatgtacctattgtatgccaggtagtgctctaagtactttatatgaagtaacatattgaatccttacaacaaccctaataggaagataaattattattatttctatagatgaggaaaatggtgttctggttttttgtttgtttgtttgtttgttttgaggcagagttttactccatcacccaggctggagtgcggtggtgcgatctcggcttactgcaagctccacctcccaagttcaagtgattcgcatgcctcagcctcctgagtagctgggactacaggcacgcaccaccacgcctgggtaatttttgtgtttttaatagagacggggtttcaccatgttggccaggctggtgttgaactccagacctcaagtgatccgcccaccttggcctcccaaagtgttgggattacaggggtgacccaccgcgcctgtattttttgttaagttacttgtacgtagtcttggctatgaaatggcatggtcagcatttgaacctttatgccccttcctcctcatcatgtgtattcagtagggctgaagtgcataaatgagatgtctatatttttttcttcctgcaaattcagtacttctttggcacatttctgtaggtaaacttaaaaattatagaacttgtgattagaatcactcatgtaactgaacctgagatatttcttaatatcccaggttgtttaggcctgatgtttaggcctggtgcagtggctcatgcctgtaatcccagtgctttgggaggccaaggtgggaggatcacttgaggccaggagtttgagacccgcctgggcaacataacaagactccatctctacaaaaaatattaaaaaattagccagaaggtgatggcacacgtctgtagtcccagctgcttgggagactgaggcaggaggatcccttgagcccaggagcttgaggctacagtgagctatgatcacgccactgcattccacccagggcaacagaacaagactctgtctcaaaaataaaatttttaagaagtaacagtgttaagagttaggaaaataaagacaaaaataaagcaaaaagcactatctaaagattacctgtatcctttatggttttgacattcttaggatatttatttgctgctggttttccaggattgggcaagactcaaacagaaaaaaataagatattcttaattaaggaataagaggataaaggagcaatagcttgtgaacgttgtaagtggacagaaagaaaccagtaaaagagagtcttagagatcagaatggtgggattttgcaaaatttagttatgtggtatttaggagtctgtatcagaaaagctcgagggcactagtctcaaaactgaccttggccacttgtctttaaattacttgcttcatgtcactcataaaagctgcctaagaaggtcagacttcttttctcctaactataaaaggagacgaaaagcaaaacctacacattgacatacagtgctaccaatgattttaactaagttatcctatagcaagagtcatcagtttttatttagtcctactatactttttatatattcacagttatcatgatgtaagatgatagttgtggacagagaagaaatgaagaggagaaatgggtgccaaaaggagcagtctgaggatgtgtgtttatacagggagtctgttttttattttattatttttttgagatggagtttcgctcttgtcgcccatgctggagtgcagtggcgtgatcttggctcactgcaacctccgcctcccaggttcaagtgattctcctgcctcagcctcccgagtagctgggattacaggcacctgccaccgcgcccagctaatttttgtatttttagtagagatggggtttcgtcatgttggccagactggtcttgaactcctgacctcaggtgatccacccgcctcagcctcccaaagtgttgggattacaggcatgagccaccatgcctggcccgggagtctgttttgtgtgtatgtgcttatatgtgctttctgaagagagggcccggagccttcattacattcttaaaggggtttgcaacctcccccaccaccaaaaaaaaacaacttgagaatccctggctgatagatggtgtgtcccgaattctcatatccctttcattctaatttgtggtaaatcttttctcctttggtgggaatcattcagattttgttggatttttattgcttgttaatattagatttgaggagactgaattctttgaaacatctctttcctaaatcctagaaaagaggacaagaacctggaatagagttagggatttgaggggacttgttgatcttctagtccacaaaaggaagaaactggtgaactaaggaagcagtaaaagagctgaggaatctggggctaaatttatgaaaatatggacttcataacattgttcacttgcagggccattttcctgttctctttgttaggttttgctcctagctcaaatatcatttcccagatcagcaaaatcatgattcatttggcagttgaacagtatgaagtattgtcagaagaatgccttgagctaaataattctggaatcctacacagcactttgtattcatagttaagtgaagtgggtggttttgtagaaaagctgtaggtgtaaaggaaattatataactattctctgctttatacaatttatttcttaatatctcttgtattaggaacagaattagaaagtagatctgcaggatcatggatatcattaagctttggttttaactttaaaggaaagttttgttcagtacctaaaattttatccttttaaggatgtcaaatccttgaacagtcctataaatatttctgtatcatatatgcattctgtatattgttatatactacacaaatccacgtgcctgggtttttacttttcaaaggattatgtgttctttcttttacctctagcaaacaaattatgtcatagaaagaaaagtgtatacatgaagtaagatattcaattgtgtattgttataagtcttttaaaaattgagactgtaggatgttataagttaagtaataatcattaaagcctcttgggtgaacatatataatatctattgtatatgcatattttcgatcttgtgtagttagcttatgttttccttagtccttcagttttcatgtgttttttaaaaataattttgtgaaacttgccacataaggttgctctaaaacaccaaaccctgtgagtttatttaaatctgattatacaactctgaagtagatgacatgtatcgtagagaagaggaatacattccccactaatggattggaagcgcttttaaatctaattttaacatagttgtaacaaggagtgtgaagtcttataaagccgtacttgacagtaaactgagtcttaatgaaaagatgttgtgtttttgtggattgttttgcagatagtcacctctctttgtcccatgtatggcagtcgatttggttatgccctttccaatggcacagttggagtttatgacaaaacatcccgatactggagaattaaagttagtataatttagcctttgatattcaggcgcttgatagttattgtgagacttctgtgctaattattaaaattctttttcagtcgaaaaatcatgccatgagcattcatgcttttgaccttaattctgatggagtgaatgaactgataactggttggtccaatgggaaggtaagtttgaatagcaaagttcaggtataattcagagtagtaattgtccaaggtgtattggctgtaggacttagaacagtaacattgggatgtaaacttcagttcgttccttggcaatgtttttacatttaacttaataatcttgacacattcttcctgctatcattgtcaagagctgcacagtgagagagtgtaagtcttataagcggtgtttgggggaaatcttcggggagattctgtctaaatctcttatttgaagtgctgagaatccatcagccagattgattctaggtagtacaacagtaaaaaaggagttttaaggaattgtttgaatagctcttttccaatacatcttcaaaactgcctgaaaacttagcactaataggaagaatcatgttagcatattgttttctgagctataactttaaaataaaatccttttgcttgctttccttttttaacttcaaatcagaattttttacagtcttttggcaagtcaggattgtcttcttagaagctgcctaggtagctgccagatctccatggataccatttgccctcgctttcttgtctgtcagtgttggattgcctgaaggggatcagcaaattcttatcttttcttctttgatttatctttacttttctctagcaccttgtaagcattcctttggtgttacgtgaagaacggattctaaaaagctgttatgttggtttctgcttcttcacttagttttgtcattagtatgggtactaaaaattataagactgtatagttgcttattaagaaatatgaaagtctgtgaaatgggtgtcttagttggtttgggctgctgtaacaaaataccatagggtgggtggcttataaacaacagaaatttatttcttatagttctggaggctgggaagcccccatcaaggtgttggcagtttcagtgtctggtgagggaccacttcctcataggagccttacagggtggaaggggcaagggatctctctgggccttcttttatagggcactaatcctgttcatgggggctctgcccttatgacctaatcacctctcacaagctctacttgccaataccattcattaccttggctaataggattcagcataggaatttgtgggggcaaaaacattcagatcatagcagtggatcatattttgagggaatataaattattatgactgacttaagaattagaaaactactagacttgaaaacttgtcaggttaccttgaaatataattgttgacctagatgtttttatagttaaatgcttttgaaattttaagggatttctattatgtaatgcgttcctgagcatgaaaaagataagaaaattatataagtggaaaaaccgattatctacatctaacagaaatatacaaaaaggaaatatacagatccaacttgtgaatacaggtgtgaaaatattaaataaatgctgctagacaattaactttgtcttttgtatgtcatttgatgagttggagggccatcctttcctttcagggtaaaacctcccagttggattaagcaaaagatcagaatatccacagaaatattaatttgtagtcctgcttcttagttagcaaatgagccttcttatttgctaaatattgtggaaatgcagtggtagaagccattaggtagctaggctttaactagaaagaagcaagttcaggtcagtctgagttagagggctacattaatgtgctttgttaaaaatgcaggtcattcgttctttcacaggctttagcattcataattttcaggcttccatgatgttattaatagcattaatacttgacagtgatatactgtagacaaggggtaggctgtaacctaaattactttatgttttggttgcaaagttttgcccagaagattgtttatgaaaagacaaaactagtgagtagcattggtcatcgaaatgattgctatgctagattttctgtagctagccttttgttgataatacctgtgtccttgcctggaacataatcatctttttttttttttttgagactggagtctcgctttgtcacccaggctggagtgcagtggcgcaatctcggctcactgcaacctccgcctcccgggttcaagcgattctcctgcctcagcctccctagtagctgggactacaggtgcgtaccaccacacccagctaattttttgtatttttagtacagacagggtttcaccatgttagccagaatggtctcgatttcctgacctcgtgatccgcctgcctcggcctcacaaagtgctggcattacaggcgtgagccactgtgcccggcctcataatcttcattttaagtgatggtcacttattatcacttttgagatgcatttgtttctgatcagtcatttatttatttgttctctctcttggaaatgggagacttagaggataggagagctctctaaagtatctgaatagtttttatgtggaagaggaactcttaacagggttgttgtaaaaggttgcatggtggaagactgggctaactccgtagtttctgaacttcagattcaacatactttatacatttatatataataaagatacaatttttatatagagctaacatttattacgtacttctgtgtgtcaggccctgttgatatatgttaacttcattaggcctcagttatacccaatgggatatagtactgttaatttctccatgttctggttattgaaccccagatgaaaagaccaagcacagaatggttaagaaacttgcaagatgctgtggatagtacgtggcagagctagattctgaacctgagcggtttggccattaagcccatgcccttttgcactgtgctgtgtgtactatatgtactggctcttagcagacccgtttcttcaagtgaagcattgtgtgaaggcctatgaaaaacagcttttatttaaaaagaaggaagcacagctggttgaggctctttagggtccctcttggccccagcagtcataggtatctcctgagaagttgtagggcttcatagaatactcttgaaaactgctagactaaatgacctttaaagctgatttttatttttaaattttgtggtttttaaacatgtagcataagcaacttttaaatttgtgttttatttgtaggttgatgctcgaagtgaccgaactggggaggtcatctttaaggacaatttttcttctgcaattgccggtgtggtagagggagattaccggatggatggccacatacagttaatctgctgctcagtggatggggaaagtaaattgggatgagaaaaatccttaaaaagtcacgttttccatttgattgggtcaaaatatcaggaaatttcacctgaagtatttgtaccgagatcctgtagttctaataaattcaccaaagttggggagaacttaggtttttgtttttaagagcaggtaattgatgacctaaaagtatacctggttatacttgcggttttttccttctgttcagtccggggctacctgcctggcacggctgagatgaggggcaacctcatggacaccagtgcagagcaggacctgatccgagagctgagtcagaagaagcagaatctgttgctggaactccgtaactatgaggaaaatgccaaggtaggtgtaggtcctaatgtgaccaggtaatggaggctgaaatgttgagactgaccgggaggatcagcaaatatggaagaatgagagtgtcattgccagggtgtggcctttttgccattgtcagaattgagaggggatatatgctttcgtcttgaaatttcatttccaggtagttaaactgtagaaatgttttcctgattgtttaaggacatttcctgcagcactatttatttatagcagtgaaaacagctggaagaaacttagatgttcgtcagcagtagggagtatgtgctaaggaatattaagcagctcaaagaatgaatacttggactgatatggaaggatatctgtcgtcttaccaagtgacaaaaggcaagaacaatatagaatgtcttttatctttttcaaaaacaaacatgttaaaaacagacaactgtaaaaactgtgtgtgtgcatacagcaaactggctgaaatattcctttaatttgtcctgtaatgcattactgtatttgaatttgatgtaacaagggaatttgtttgcttactttaaaagaacaatacttcaaaaatgttaaagtcatgatgggatacagtggaccatacccatagaaagatgcaagggtattttcccacagggccagatagagcaagggagcactaatgaggtgagttctctgaattctaaagaatcagattactataataataataatatgctggaggctctgtcttttgaagctgaatagcaatattatttaaaattgatattagttcagtgttttggtgactgagtaggaaatgggtggggtgttttgcaggctgaattggccagtccactgaacgaggctgatgggcatcggggcataatcccagccaataccaggctccacaccacgctctcagtcagcctggggaatgagacccaaactgctcatacagaattacgcatttccacttctaatggtaagacagtactcacagctggtatttagaggcacctgtgccatcttggagtcattcttttttttttttttgagacagagtcttcctctgtcttggctcactgcaagctctgcctcccgggttcatgccattctcctgtctcagcctcccaagtagctgggactacaggcgcccaccaccacgcccagctaattttttgtatttttagtagagatagggtttcaccgtgttagccaagatggtctcgacctcctgacctcgtgatctgcccacctcagcttcccaaagttggagttgttcttaaactgtttttactcttccctgcagacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcaggtgaccctttgcaagtcacagttcatttcaggacagcacttagaggagggcaagatgtataaattttccatatgcccagtggattcttgggggcctgagaaaccatttaatggttctgtctacccaaagtttctcatgaccttttatttcctcagtttgaaacctgtaaaaagaaaatggaaaaactgatatgtaagtttaagatggttctttttttttttttttttttgagacagattctagctttgtcacccaggctggagtacagtggggcaatctcagttcactgcaacctctacctcctgggttcaagcaattcttctgcctcagcctcctgagtactgggaccacaggtgcccaccaccacgcccagctaatttttgtatttttagtagagacaggagttcaccatgttggccaggctggtcttgaactcctgacctcaggtgatccacccgccttggcttccgaaagtgctgggattacaggcatgagccaccacgcctggctaagatcattattttctgtttttagtcaggtgatctcataatcaaaaaatgtttaattgatgatttgtcaatttgtagttttggccactaaaactacaagagttaggatgcacctttatattacagtcatacataacctcagctagtgaagaaaaactgctctatttgtggaagataagatactttttacatcccctttatgatattttaaacccttagtgcatgcaggtatatatgtagactcatgctgtctttaaatcccaaacctaatatattactgtagtactttaaccctcaagtgttttgggggttccttcttaagtgaaacccttaaatatcaattgatgacccagaagtggctttattttctgggccttgcattttgaaagaacattctatacaaaacaattctcttgtgtttcattgattggccatagcacccagtttcatgtatttgaatcgacaagacagctccctcgattctccatgtatgcgctgaccagcctggaccctgccagtgagccaatcagttatgttaactttaccattgcagaacgggcacagagggtgagtatctcgcttttctctttcaatgcttttacacagtagaatcctttagatgttatttcatagaaagggaaaattacattaatgtgttatattggtagcagtaaatatgatatgaaagaattctctaacttgggggtggcttgtaacctgtaataaaaatattgctaaaataccttctctcactttgaaaaagcatctgagcaatcctcagttattggtgaattcttaccagtgtttaattcctctctttccgttatggtcttagtgtggttgtcctggtgtagtatttcaagaggaacctgcagcaagatgaaaagagagtgggacttggagctaagaacgtttttggctttaagtgctacgttaactcattaaattcttagtgatcttggggaagtcccctcaccagtgtgagcctcagttttcttatctaataagtaaggataatcttacccaccttattgcgggggcccgaggattacatgattggtgtaacagtagcaccttgtacatttgaaaggactaataccagtggactttaaccttggctgggctttggaattcttggtgggactttttaatcatgtagattctcaggcccctgcctggcctgtggaaccacagactctataggtgggcccttccagaaggcctcatgggtggttctcatgtggaacctgtgttgcaagccactgcatggtgttactgctattaacattaaaacttatattttccttattgtgtggatatatctgtggtgtttgcccatgtatacttcattttacatttcttaaagaatagaatggaatggttttaagcacgctacattgtccaggttatacccacagaagagctgttgtgtaacagaatcagcatcatacctgaatcatttgtacattgcatataagactatgtctaagtagaagatgctatgaaatcatgtctgctgtggggccaggcataattatgaatgttacttaagagcataggtgaggtgagaaaagggaatgtgactagtgttttagtattttcttggtgtgggatgaagtataattcttttttttttttctcaacaaagcagtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagaggtaatgtttaatatcacggggcatagatttcttttttgaatttatttattcaaacacttagaccatggaatgagaggggcatagatttctcatgtggtgtttaccattcagtccaaagtgaggtgggggacatcaatgtcaaggtcataaaaccacgttttgttttatttttttcacatggtttaacttagtctgttagtgttaccattttagacactggggtataatttggaatagctgttttctgcctccttcccttcatctcttccttgtctaatttggaaagaattgggaatacagaggtcaacaaaaacattttcaatgtttggatgattttgtcatttaatttctaaggccagaggatttaccttttagctagctgctggaaataatgcagtttgtaatttctttgagagctaaactttcctttttcaacactgcatatatatatatatgcacaataattttgttgagtatggggaaattcaggtactattttagctaagtttgtctaacatctgaggatgctaaacttgtctattttttctctgggtagatcactataaatactgatgatattgatttggctggtgatatcatccagtcaatggcatcattttttgctattgaagaccttcaagtagaagcggattttcctgtctattttgaggaattacgaaaggtgctagttaaggtgagggaatgcggtagatgcatttgtgagaatgtggtagtctaataatatttgaggagattaatggtactacaaatgtacttatgttatagtgatgttttcaagaatttttgcaattcttgaagtaaaaattgaactagtattggagagtttactacttaaggatttattttataaaaggaagtgtttagctcctgagcaccatgcttgctttgtttggtttaaagtgatgcatttaaatattaacattttcctttgttagctcttcatcttatttgtagtatctgctttggtcttcttcagtttgggtctttccaaaaacccaaattcaagataaaagagcaaaataaagatgattctgattggccccaaagtatacaatattcccactgcaaatccctaaaatattaatatgtgtgttgtgggggctcctggtgctaaagcatggggaagattcacatggagtgtcgtgttgaaattggaggcagcacagatgagttaacttgttgagacagagatgaaataacgggaagtagcttaattggtataagcgaacaggggaaagaagggggtctctgtatctggtaaatagtgtcttttcatttgtctgggttcaagaagtttgtgaggcctttttcattcctgagtgttcatggtctccaggtggatgaatatcattcagtgcatcagaagctcagtgctgatatggctgatcattctaatttgatccgaagtttgctggtcggagctgaggatgctcgtctgatgagggacatgtgagtatttgtcatggttagtacaggtgcagggttaaaaatgtgagcagtatggaatagcaactctcagatgttaccaatagaagtataaattgttacagtgactttggaaaataacttggcattatcagtaaagttgaaaatgcatgtcctctatgacccagcaattctattcctggtttatagcttagggaaagttacagcttagttatatgtatgcttataaaccaggatatttatataagaatatttgtaaaggcattgtttataaaaatctcaaaatggaaacaatccaaattagcatgaacagtgtagcgacagtggatgaattgtgatatattcatgcaatggaatactacacagcagtgagagcacatgaatctccatgacacataagagcaaggaaaaatctgataagcataatggacactgaaagaagacagacttaaaagactataaaatgtatccgtgtgtatagttagagaaaagagtaaactatagtttgggaaacatgcaataaataaaaatataaattcagggaagagattatcatataagatagtattttctcctagagaaggagggattatgttcagaaaaaacacattgggaaacttcctgtctgaagtcttgtttaacttcattaaatattctgaatttttctgaatatgtaacattttacaataaaaaagttaagtatgtacagtacaggtcttccttggtgcttgctaggatgccaaatttaccttgccaataaaatgtactgaaaaaaattcagtaaaatagttaacaaattatagatgaaatttatgtgtatatattaggggcaagagttcactcagagtgctgcttgtgttttttcctgagacgcctgaattattggcaaataattataatggttttgctcagaggtaaatggtttttaaaataattgtattgttgaaaatttcaaacacatacagaagtacttaaatataatgatttcatatataccacccacccaacttcaacagttatcaactaaagactgatcttttttcatctctacactcaccctctttccctcccaggcactagataattttgaggcaaattttggacattgtgtaattctagccacaactatttcagacaaagggcctttcaatatcatatatatatatatacatatatatacacacacacacacacacacacacatatatacacacgtctgtataaaaatcacaatgccatatcacacttagaaaaatttacaataattgcttaatattacaaatacctcatctgtttagatgttcccagttgtcttataaatgtggacatgtgtgttttaagttggcttgctcaaatcaaaatccagatcaaagtccatacattggatttggttggaaatcgtttaatcttttaatccacacttttgcttgcccactcagtctcttctctccttctcctgtggggtgccattttggattttgctggtggtatccttgtggtaatgtttagtattattcttctgtcccctgtatagaaagataatggtagatctggaggcttgattagattcaatttcaaattttggcaagaatacttcgtgagtagtgttgtttacttccatgaggaagcatgcaatttttgattgtttctttttatgatattatcagccattgatgatcattgcctagattcattatttcttttggggtttgcaaaatagtgatattctaattctgttattcttttcttcatatattagttgaaatacttctatgaaaaataatgttccctcatgaattaatgaattatttggttccctgaggtacagtttgtacaggaaagacagtttctttatcagctttaaaataatgtgttgatctccagcatgcactaggtgaccaatgagatttttaagtccttacatactcatgtatttgaacatatttaatgtgtttcaatttatatctgttattattaatttttatggctagtttttttttttttt

SEQ ID NO: 14956 - DNA, 4656 bp, Human
atgactttgacgagttgagagaagaaggcttcagacgatcaaactactccgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcagcagctgatgcgatcaactggaagaaagggtatcagtgatggaagatgaaatgaatgaaatgaagcaagaagggaagtttagagaaaaaagaataaaaagaaacaaacaaagcctccaagaaatatgggactatgtgaaaagatcaaatctacgtctgattggtgtacctgaaagtgactgggagaatggaaccaagttggaaaacactctgcaggatattatccaggagaacttcccccatctagcaaggcaggccaacattcagattcaggaaatacagagaacgccacaaagatactcctcgagaagagcaactccaagacacataactgtcagattcaccaaagttgaaatgaaggaaaaaatgttaagggcagccagagagaaatgtcaggttacccacaaagggaagcccatcagactaacagtggatctctcagcagaaactctacaagccggaagagagtgggggccaatattcaacattcttaaagaaaagaattttcaacccagaatttcatatccagccaagctaagcttcataactgaaggagaaagaaaatcctttacagacaagcaaatgctgagagattttgtcaccaccaggcctgccctaaaacagctcctgaaggaagtactaaacatggaaaggaacaaccggtaccagccactgcaaaatcataccaaattgtaaagaccatcaaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctattctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagtggacctaatagacatctaaagaactctccaccccaaatcaacagaatatacatttttttcagcaccacaccacacctattccaaaattgaccacatacttggaagtaaagctgtcctcagcaaatgtaaaagatcagaaattataacaaactatctctcagaccacagtgcaatccaactagaactcaggattcagaaactcactcaaaaccactcaactacatggaaactgaacaacctgctcctgaatgactactggatacataaggaaatgaaggcagaaataaagatgttctttgaaaccaatgagaacaaagacacaacagaccagaatctctgggacacattcaaagcagtgtgtagagggaaatttatagcactatatgcccacaagagaaagcaggaaagatccaaaattgacaccctaacatcacaattaaaagaactagaaaagcaagagcaaacacattcaaaagctagcagaaggcaagaaatacctaaaatcagctcttccggttctaggcacttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggagtcagctgcaagctcgatcgacatgcctacgttgcccaccccaagcttgggaagcgtgctcttgcccgtattgccaaggggctcaggctgtgccggccaaaggccaaggccaaggccaaggatcaaaccaaggcccaggctgcagctccagcttcagttccagctcaggctcccaaaggtacccaggcccctacaaaggcttcagagtagatatctctgccaacatgaggacagaaggactggtgcgaccccccacccccacccctgggctaccatctgcatggggctggggtcctcctgtgctatttgtacaaataaacctgaggcaggaaaaaaaaaaaaaagaaatacctaaaatcagagcagaactgaaggaaatagagacccaaaaaaacccttcagaaaattaatgaatccaggagctggttttttgaaaggatcaacaaaattgatagaccactagcaagactaataaagaagaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatataccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttacgaggccagcatcatcctgataccaaagcctggcagagatacaaccaaaaaagagaattttagaccaatatccttgatgaacattgatgcaaaaatcctcaataaaatactggcaaacggaatccagcagcacatcaaaaagcttatctaccatgatcaagggggcttcatccctgtgatgcaaggctggttcaatatatgcaaatcaataaatgtaatccagcatataaacagaaccaaagacaaaaccacatgattatctcaatagatgcagaaaaggcctttgacaaaattcaacaacgcttcatgctaaaagctctcaataaattaggcattgatgggacatatctcaaaataataagagctatctatgacaaacccacggccaatatcatactgaatgggcaaaaactggaagcattccctttgaaaactggcacaagacagggattccctctctcaccactcctattcaacatagtgttggaagttctgtccagggcaattaggtaggagaaggaaataaagggtattcgattaggaaaagaggaagtcaaattgtccctgtttgcagatgacatgatagtatatctagaaaaccccattgtctcagctcaaaatctccttaagctgataagcaacttcagctaagtctcaggatacaaaatcaatgtacaaaaatcacaagcattcttatacaccagtaacagacaaacagagagccaaatcatgagtgaactcccattcacaattgcttcaaagagaataaaatacctaggaatccaacttacaggggacatgaatgacctcttcaaggagaactacaaaccactgctcaatgaaataaaagaggatacaaacaaatggaagaacattccatgctcatcggtaggaagaatcaatattgtgaaaatggccatactgcccaaggtaatttatagattcaatgccatccccatcaagctaccaatgactttcttcacagaattggaaaaaactattttaaagttcatatggaaccaaaaaagagcctgcatcgccaagtcaatcctaagccaaaagaacaaagctggaggcatcacactacctgacttcaaactatacttcaaggctacagtaaccaaaacagcatggtacttgtttcaaaatagagatatagatcaatggaacagagcagagccctcagaaataacgccacatatctacaactatctgatctttgacaaacctgacaaaaacaagcaatggggaaaggattccccatttaataaatggtgctgggaaaactggctagccatatgtagaaagctgaaactggatcccttccttacaccttatacaaaaagtaattcaagatggattaaagacttaaacgtcagatctaaaaccataaaaatcctagaagaaaacccaggcattaccattcaggacataggcatgggcaaggacttcatgtctaaaacaccaaaagcaatggcaacaa

SEQ ID NO: 14957 - DNA, 325034 bp, Human
ggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccggtgtggcagggacagggtgtcggtgaggcaggtggctgaggaaatggtagctgcaggttttggccccagtcccagcagcgggactatggctgtggggagggaggaacccagggagggggcctgagcagggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtagccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccatccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaagccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggagtctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccctctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctctgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggagggggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatgtatatatatacgtatatatgtgtatatatgtatatatctatgtatatatatgtgtatgtatatgtatatatatgtgtatatatatgtgtatatatatgtgtgtatatatgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggtcttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctctttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagccccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgtttttggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccctacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcgggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcgcgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggaccgggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacgcttataatcccagcactttgggaggccgaagcaggcagatcacctaaggtcaggagttccagaccagcctggccaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgttttttgttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatgttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacgtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacaggcaggagtccgccggaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgagggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccaggagggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcgggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatgtccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcaggccctctggggaggacaccctgcagacgaggggctccggttcccccagggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgtgcgcctgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaaggtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgaagcagcagcagggtcctcctcagctgaagactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttttggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtaatacagttattgacttctgcaattaaacatcaatataatacttggacctaatttaatgcctatgttcccattttgtcagttgccatgacaatgtcctttgtggcattttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacaccttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacgcaccaccaagcccggctaatttttgtatttttagtagtgacggggtttcgccatgttagccaggctggtctcgaactcctgacctcaggtgatccgcccacctcggcctcctaacctgctgggaccacaggcgtgagccactgcacccggcccttgtgcttcattcttttatgaatgaataatcttccatcgtatgatatacaatgaataaacattttgtttatccatttatttgttgataagcattttagattgtttccacattttgactactatgaataatgcttctagaacatgtgggtttttgtgtggacatgtgttttcatatctcctgggcatgaaagagatatgaaaggctgggtgtgttggtggctcacacctgtaatcccaacagtttgggaggccaaggcaggtggatcacctgaggtcaggagttcgagaccagcctggccaacatggtgaaaccccatctctactaaaaatacaaaaattagctgggcatggtggcaggtgcctgtaattccagctactcgggaggctgaggcaagagaattgctttgaacccgggaggaagaggttgcagtgagccgagactgtgccactgcactccagcttaggcaacagagcaagactgtttcaaaaaaacaaaaagaaaggaagaaaagaaagagatatgaaaacacatgggagtggaaagctgagtcaaatgatcactatcttttttttgagatgaagtcttgctctgtcgccaggctggagtgcagtggcgcgatctgagctcactgcaacctctgcctcccaggttcaagcgattcctctgcctcagcctcccaagtagctgggattacaggcacatgccaccatgcccagctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacgttcttggcatccttgtcaaaaatcaattgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctgtatacaacattgatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaattttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttatttttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttcaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtgtgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaatgagatttgcatgccagaaattaattccacatagacatgatatataatctttttgatgtattgttaaatttagtctgccaatattttattaaggatttttgcatcagtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatccccaggtagtgagcatagtacccaataggtaggttttcagcccacctctccattcctcccccaagtagtccccagtgtctactgatcatctttatgtccatgtttactcagtgtttaggtcccacttgcaagtgggaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattttcctttgaatatatatccagtaatgggattgctgggtcagatggtagttctgtttttagttatttgagaaaactccaaactgcttagcacagtggctgaactaatttgtatttctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcttgggttcaagcaattctcctgcctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtaagttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgttgattttctgatagtgtaccattatgattctctattcgattgtctgtatgtgtgtatgtgtattttaaagactttatatttttagagcagttttagggttccagcaaaattgtgaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtatatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctttcacttaggctggaatgcagtggcatgatcatggcacactgcagcctcaacctagacctctgggcttaggctatcctcccaccttaacctcccacgtagctggtactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatatgtctgtccaagtcctttgccctttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactttgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggatgtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacattatgtcaagaacttattcatctgataactctatgtttgtacccttcaacatttcctatttcccctactccctgacccctagtaaccacccttctactctctgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccctcttaacaggttattaattgggttattaagtttttttgctagttatatgagttccttatatatattggatattaatagcttatcagatatatggttggaaatattttctcccactacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtgtcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacttccagtactgtgttgaatagaagtggtgagaatatctttttcttgttcctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtacgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccggttattttcttttcttatatcgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaaacccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctatctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccgtctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctttcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttggtgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatggggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagcgttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttcttttttcttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttatttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattctttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttcctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctagtctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccacatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttctccatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctaaggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctgtttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatccccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccatcgttccttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtcttttcactctttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatacttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttataaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttggatttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggggttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttctagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgcgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattatgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtatgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatgaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtgttttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaactcggctccagctgctcagggatgcagcgaagctcctgtgggcagcctggccccatggaccctgaactgggaagagaggcacatgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggatagggctgtttgtgtcctatttaagaaactttgactactccaaggtcataaagatattctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctccccactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacatgacgggcgagggaagaggaccatggtagcttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaaggtccccacattccatggcagtgcctagggagctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgctgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacactaggacctttcttcatcatgcagccgtagagctggaggccaaggacaccctctggaaatctgaattccattcgctcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaagctcactgggcaccttggctgcagggtctgaaaagtcctttgtgttagctccagctgcagagtttttccaggcctcgcttctggggctgactggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcctcagatagggtggagagcaccccttattagagggtggttgggctctctaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcctattgcatctttccagacgtattttatataaacaaatatacgtgtgtctgtgtgtgcatgtacttagtagatacggctcctttttatacaaatggtagcatactgtatgtatttttctacactttgcctttgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaagttgtctatctgtgtgtatattcatatcccattggcatttgttattgaaacttcattcaatttagattaactgatgaagaattgccttccccacctcaaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctatatcttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcctttctgagagcacagcaatgcctactcatcctgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatctgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaggccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacttctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccctgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcctgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcatcacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaacctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggagccccagggaggccgcgctgaggaggcccagggaggaccgcgcggaggagaaccatgctgaggagcccccggggagacagaaccgcggcgaagaacccccggggagaaccgcgccgaagaacccccggggacaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctggttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagccggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagagagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttattatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagttattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattctgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgaccttttctccccaagagaacaccaaatccatttccttgggacatggataaggctaagggcagcacccacaaggaccaggagcggggttctcaacagccacttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcccccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgagcggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggctgtttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtacgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgcctgggatgtggcttccgtggactgagcagcctggagcccctacttgcttggtgtcccgagccagccggacctgcatcccgctcctcctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattattcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggcaggagtggggcaggagggggctttgcagattacccagaccctttgttggccagtgtgggaatggggggaggccagggaggaccccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccgcatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacaaggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagaccacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaacaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttctggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctgtaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcccagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcacgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagacccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacttcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacacgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcaatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttctgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctaggacacgtgaagccctggctggccccgagtgcggtgtggttggcgcagatggcaacagggtcactctggctgcagagccaagaatggaccactgaggggctgggacagacctggcagaccaggagggaggccactgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccacctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagttggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgatgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggttctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcgctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacacacacacacacacacacactctctctctctctctctctctctctctctctctctctctctctctccccccccacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaagcttgtctagcactggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtggctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgaggccctgcccggtggagggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaggaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccaggtcccaggcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgcggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggcggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacttctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcggggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggacccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcagaggctggggttacctgacacttgtcatccttctgctgggcctcagcacccggcggaggcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcggctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccctatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggctaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaaaatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcggagcctgggtgcaggggcatcttgctggtgaagctggggagagacctgcgcaaccccacctgagtgaggcactgtgggcccagagtccaggtcagcgccaggggcagcaggggctggatctctggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggcggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatatgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatgttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgctcagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgacccggggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtatgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaaaaaaaaaaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaaaaaaaaaaaaaaaaaaaaaaaaaaaaccccacagctaacatcacatcacacttaatagtgaagaacagaatactttccccctaaaataaaaaagaaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactattggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaactgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcgggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcacgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacgggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatttttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccatttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacaaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatctttaaacagatttattttagagctgggtacgatggctcacacctgtaataccaactacttgggaggctgaagtgagaggatcacttgagcccaggagtttgaaaccagcctgggcaaaataacaagaccccatcttagaagaaaaaaaaaaaaaataagaaagaaagaaataaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaagacagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccgcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatctttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccggggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtgatgggtgatccagaaggcaaaaatcacaaagcagggaaggctggggggtgacttgcctgagtcccttggagcggagggcgtgtgacgtgcttgagtgagtgcgtgtctgccggagcagggcggggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcagtgtcccatcttccaaaagggaggatcagggctcaatatcccatcttacagaaaggagagtcaaggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagcatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccctccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccgggtcctgcccagcccggccccagctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacgttttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctccccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccggccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtggggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccgttacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccccgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcggcctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatatatgcggtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaagggttttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattttcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgtttaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaactcttttttcttagcacattaaaaatgttattgaactatcctttggcttccactgttaccgttgagaatgaagatgatgaattgttgctccttggaagacaatctgtcttttttctctggctgcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactttaaaattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactggctcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaagaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtggtgaatgtggatggcagggaccatacgggagagcacactccagtagttgccatctcatggccccagcgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagcttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacacccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtgggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaggagttcacgaccaccctgggcaacatagcgagaccctgtctctatgaaaataaaaataaaaaattagccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagagatcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcagctccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcgatgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcctggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctctccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccgggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaatggggcattgttcacggcctcacctgggctgtctccagcaccccaggatttacgaggactcggcccagagcctcgatgccggccgctccgggcagacctggagggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctaacggggccaggaggctgaagacaacctttccttgggctctcagcgatgccagctccagctgctgtgtcatcaaggtcgggcttggctggcctcttcctagcagaccttccaaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaattgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttctttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagagggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgccgtcagtgcttggagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagttggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggatggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggggaaatgatggataggtggatgggtagattgagaaatgatggataggtggatgggtagatggatggaaggagacaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctcaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctggccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcacacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaaagtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgctcttcccccaacccccaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtctctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccgcataagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttatttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatgtggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtccccttccccacgtggtaattctggactgttcacagtggcttccaaggcctttgggatgggccttgcgtgctgcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcagccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaaggccccaaggcaggaaggaataggcctggtctgtgggtctgagaggatggagagggctgaacacgggccaaaggagaaagttagggagggaaggtggagtccttggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggcgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgggagtggagctgggcatgcacactaaggcctggaggcttgatgcttatccatcatatagcaggcctgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggctacgcagaggccctgggaggagggaggctaggcccaggggtggaaagaagacagatacgagaggggatttggagacacaatccccagacttggggacgagctggatatggtggtgaaggaggggagtcttcaggaaagacccccaggttctggcttggccatatgttggaggctgaaacgattcatccagacaggagcagggaggaggacatgcagggcctgaaaggttctgaggtgtccacgtggaggtgtttgcccggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtccccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgacttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcagggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcaggttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggctggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacctcagcaggcagggactagcacccaagaagaaaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtgggtggggcaggagctctcgtgatgaaaacaacagggattcagtaaatgcattcaagctaaaaaggaagacctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggagggggaggaggatgagaaggaaggaggagggaggaggaaggaagagggaggaggaaggaggaggaaggaggaggaaggaggagggaggaggaaggaggagggaggagggaggaagagagagaaggaagagattggccaaggagctctgagaggggaaggtgggtgcatgccaccctggctgggaacagcaggtgtgtggtgaaggggaaagaccagcaggccctttacaccgtgggcacaggctcaggactggctgggtgctacgcaggagccctctgactagctggggctggggctgtgcaggataaggccagtgagagaagaggactcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccacttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccagcacccctgagggaaggcctggcccctcaggcacagtgggggttgcccggcatcttggcagatgggcagcgttagagaagccttggacctggccctgcaaacggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggagcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctcagggccccgccaggtgaaggaacaagcttggaagggtgtccttatgtctgagagttggggagacacccccaagccccagatgggcctcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagagcccccaggcctggcctccaacctggccccagcctcaggggagctgaattcagagaatcctgtcctaggagccagaagcgggggagggagggagggcggccctgtcctgggtgcaggcccgggggctgggggctgcccgcccgtctgggtcagccgcagctgcaaaccggccctggctgagtcatggggcctccatctccaggcctggcttgaggtgggaatagcagtgaggttggacatccaggcacctggagggtgggcagggctccctgcggctggggtggccagtggcacctggctgttgcccccctgcaccccagccctttggcccccaagtctctgccacctccctggggttctgctcccatattcctcacacccagcacagaacccagcatgtctcctgtagacacctgcatataaaccctgactcacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcagcgggctcagcctgcagtgtccaggagcgacgggaagcctcgtggggctgttgggagacagcaagacctgggtcagcagagcaccgtgtggggtaagcagatgacagggcagtgacagggtgatcgggcccggtcagtggtcccaggggtcggggacaggtgggaatcgaagtcataggaggcggggcaaaggccacggggaaagggacagagctgctcccaaggacgcaccaccatggggtgccccatggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcctgtggagccctcagcctccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcagccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgcccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactccccggcccctccctgctcgagaggtgaccaaggcccagggtctcccagcgagcaagaggccattgaactgttgttggctgtgcagtgccctgccctcggggaggcggcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtcatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaaggaggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgctggggtcctaggggctggtgcactcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttggctgaggcagcagagcgctcgctggctgcccgaacaaagtgttctgcctggtgtcccctggcctccgggcctctgcgggctcgccagagggggcagctcaggaggcagcggcagagaatcaaatgcaggtggggcctgtgcccaccgccagcacaaacacggctcctgggcccccagcctgcccgacgttcctgcccgcctggcccccaaacagaggccgatgggacgagccctgcccggggttgcactaggtgggcaggtgggcaggtgggcagctgcctcgggctcttggacagagccgcccctgcctggcgtctgccggcaggaagctcctgaggccgggctagggataggccagcccttgggggaggctcgagaccccatcccagcctggggcttccccaccccctcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcagcctctgcaggtctgtgaggctgtggatgtgacagctctggctctggcacaaacgtcagccccaacccagatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctctggtggctggagccagctgggggagggaaggcagcaggggctgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggagggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtctgcagcctctgagcggacacactcaccctcagtgcctgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagaggacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcaggcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcctagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttcccacaaggggggcagcagcatgatgcatcagactgtggacccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgctacgctctcgtaggtctctgggcctcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccggtccccctcccagaggccccgccccaccctgccctctgctttcgccggctccctacctgacacactgtgtccccccatatggcagctccgtggtctcgagatggagccttggggtgggagctgtggggacaggatgggagacatggcactttcagccagtgactctgaccctcttttcctgggcctcagtgtctgcatctgtgggatggagtgtgggcctctgtggctcgtccccaagtggctttgcagagcactgaagtgctggcgggtccttgggtgtgagagaccccggtggatggccctgggcccctgcccctgccaaaccacagaagtcctgcacccctttcctccatagtctgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcagcctctcacagcaccctgttggccgcctcttccttagcctgctcagcctccgtggtaggtgctgtgggtgacgaccacagcacccagcctttgaagctggcccgggtccacccagaccctagcaaactggttgctccctctctggccatcccggggcttgtgcccacgtcacccagcagcatcttccctggggttgtctcacccgcacagaacccagccctggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccctgagcctgaatgcctgtggacacatatagggactcccagcacgcacgggatggactccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttagcgacgtcgctcctgttctgggccctgggctggccctggccatgaagtgcagtcacagtgtggtcactgcctgtcttccagcagactctatgcccttgcggcagatgggctctgtctgggcctctctgtctgcccctcccaggccagggtggcccttcatcaaggacccacatgctccactctgggagcaggccccacccaggcccattccccaggatgccaagggctaaactctggaggggttgtggtgcaaggaaggcctggggcccctgaggctcccatatgctcacccctggcctcctccgggcctctatttccccattggtaacacgatgctcccttagcctgtccagttctctgagtgggacagaggggccaccaccctgctcgccctgaccctgttcctgcagctttctgtgaggcccgcctctcctaaggtggaaagagtgcctcactctcggcacagacacactcaaccggggcaggtgcatctgctgtgcccccacctcagctattggaccgtttctcagtccttcaggactgcagccgccttctgtcctctttccagagcccatcccgaagtctcaggatatgagggcttggggcatctgagatatcaaggatggggctgtcctgagtccactgggggcaggaggcggccagcagcaggtggcagggacaggggccccaggtttctgtgtggagtaggggtggaagcccttgttagagggaaaggccctgggtcccacctggtgccaagcccactgggcccgtgcccccaacccatgggtcttggcatctggcctggccagcactgaccgggatggacgaggtggaggggcagcacggggcttcccaggcttccctggcctgcacccctccgggaggagcgggagcagcagttactgaaaggcaggaactgttgtttccttgttgggtaaatatttgtggaaacccggggatgccggccggaaagcagggccctccacagcgcccaggccccccagccccggccgcccaccccgggaccctggcccacagggagctccgtggggccgcccatctgggccgggcgcggccccggcacccagcccgccttgttgtccatattatggactgcgcacaaagtgcccgaggactcctctcctggacgggccattgcagccctctcgggtgtgaaatgcaatttacctgaaataaagcccaattatggaattagctaattaaagccatggcggaggctgggcctggccggccgagtgctcaatgcccgccggtgcccgtggactgagggaacagatggcgcctcggcccgccgtgccggccgcattccttcactctgtcccccgataagtgacctagacagcacacgaccatctggtgtgtggcacgtcctgcgggccccggacaatggcccggcagacctctctgcgagagggccgtcgcccgggcaacggtggcatgtgcagccccgacccattcacggcccctcccgcagcccctttcttcgggccctttgtggcctcaccgcggctgcctggctgctctggctgaggatagccatgagtgtttgtccccagagccggcctttgtctccaaattgggctcccttattgaggtcctcggggtccaatgggtgccaggagcatctgctgggggtgactgggggaggggctgctcctgcttcctggggcacccacctcctctgccaggctctcctcccccgttgcctgcccccagatgtcccctcgtgggtgctgggcgtggccatggggaagcccgtctctagggctggcactggccaagcccgaggt

SEQ ID NO: 14958 - DNA, 23406 bp, Human
acatcttttgggagagacacaatgcaacccataacaacctgtaacccaatgtgctgtcccaaagaactacaacaccagggggatgctgaggttcagagagtgtccttgccctggtggtagggctgggacgcagcaggactggggaggcgggacccactgctgctagacactgcagcactcttagacacagctcggccacctgagcaggtgatcatttcccagttccgctctgcagaccctttttttttttcccagtagagatgaagtttcactatgttggccaggctggttttgcactcctgacctcaaatgacctggccgccttggtctcccaaagtgctgggattacaggcgtgagccacagtgcccggccccactttgcagatttaaaaacaagacatctggaagctcagagaagttaaactcaccccaggtcttacagccaaactctggcttgcctgacctgatgtcaggaggctttcttagtgcaagaaaggaagggcagggcaagccttagccgaatgtttatctctaagaggcttctgactctcctgggcgcctccggttccttctcccaggaaggcatgtggccgagctgggcttgggtgactcatggtcctagagtgatgagtgagaaacaggcactgtgagagtcatggtaggacctggccagaacttcgtcccctaagtcctggacttggtccctcctttgggattagttggggtctcacagagcctcccacatcctgggcaagttacagcacatgctacaggatctttgcagaaatgtaaacaaactctttcttcttttttttttccagccaccagtagaatttagaatttatttatttattattttatttatttatttatttatttatttgagacggagtctcactctgttgccagtctggagtgcaatggcgcaatctcggctcattgcaacctccacctccctggttcaagcgattctcctgcctcagcctcctgagtagctgggactacaggcaagcgccaccatgtccagctaatttttgcatttttagcagagacagggtttcaccatgttggccaggatggtctcgatctcttgccctcataatccgcccacctcggcctcccaaagtgctgggattacaggtgtgagccaccgtgcccggccttagaatttattatgaaattagacatgaggttccaaaaagtaactagaagattttttactttttattttttgagaaagggtctcactctgtcgcctaggctggaatgcagtggcacagtcgtagctcactgcagcttcaaactcctggactcaaatgatcctcctgccttgtcctttcaaggtgctgggattacaggcatgagccactaatcctggctaataatttttcttgacatattaaaattctgtttcttaaatagcatttcctctcattttggatgggtgcacgaaccttgggtgggatatccttgggaggtgacatcatgcacacagaaggcaggagccctaagggggttggggatggctccagaatggggtctgagaaggagatggagaagcctgttcacgcaacacttcatagtggcttgctttccgcagggtcattggcagggcggtccctaggcctggagcgctcttcccgcccatccccaggccctgctccaggtcggcctcctgggaaccatcccgtctcgccagcacaccctgtcccgaggccgcctctgacctccaggctgggcctggtccccacggcgcttagcgcaatcatgacttaaacacctattacaggacgctcagtctttagtgcttgtctccccgcggctgggctgactactcccagcacggccactgaacgcttggccgcgcgatgctccggagcgcgggtcgccattgggttgaactacagctcccagcatgctccgggccggcgacatccggagcccctggtagttgcctagcgaccgggcgtgtcccggaagacgggcccggcgtggggcgcgacttccggggcggcggttgcatcagattctaggaagtgtctgtagccgcagctgcgggtccgggattcccagccatggcagattcctccgggcagcagggtgagcggcgcggccgggccaggctgagggcggctgggggcctgactgggcgctgggtgctcggctcgaagggcagcgagtccttatgtctgaggggcccgggtgcatgggttctgaggggcagctgtgtccgtggtctgaggggcggcagtgcccgaggtctgaggggtgtcagtgcgcggggtctgagggacggcacgtccttgggtccgaggggcgggggtgctcggggtctgaggggtgtcagtgcccggggtctgagggacggcgggtcctgaggttcgaggggtggcacgtcctaggatccgaaggacaacgggtgcccggctccgagggacggccactgggacccctgggactcctgcgtgagggtctgccagacccgtggctggagcacagaccccgcggggacccgagcccgagcggggcgctgcccagaccacccagcctcagtttcctcacttggttcctgccgaggtccccttgcatcctcaccccgggaggtggccctacatcaaacagcctttccccagccggtgcctgggcgggccctcgctccctcttgccccagctggcctttagaggggagacaaaggcccaagggttgttttggttttctgcccagacctggcagcttccgggaggtgggcggagggcacctgaggttggtatttagggaaatggggcagaggacgccaggggtacgcgtacacacagtaaaagggcttggggctttacgaaggctttcatctccagttccgcaggcagtccactgcaagctgattgtcagagcattactgccccattttattgccaacccgggaggttccccagggacacagctgtgtcagctcccccagtcactcatgtcaccagcgggtagaccttgagagaccagtgggttcttctctcactgtccctccagcaagattttaggtgctggaaaggcaagagactgaatcagaaagcccagattcctaacagtctggagcagcctttccaaaggaaacattctcagtatctagtttttaattcttttggctggcaaaaattagatgcaagttcttgtaagacacctccagcccccaccctcagtttagatcgtaccaagatttccttagcatctggtggtgccctttgcccctgagggtttattgggttatagataggtagttatgacaacccgagtaatctggcggcatggggacacccagatgacagggctacactcttgtgccaagtggcaggaggtggtcaccttccaggcacgccgcctaccaccctacctgtgtgcctggattccagcaccatctccacccgtcccagagccaagcggccctcagaagtcacccagattcctgtaaaacagcatcatagttaacagccccaactctggaaccaccctggaagggccagggtcccaactctgcctcccgccccacagcaaaccatgcgtaatggctcctaccttggagcatggagtgtaaatgaattaatagatgggaaggacgtagaacagtgcctggcactcaattaagtgctgtgtctgtgctgaaagttagggcctgtttgttttcaaactaaaaatgtgtttttgttcatttgtgaacgtaaatgacgtattagtagtgttttgtatcttgtttttaaaaatagctttagaattttaggttttcagagccttgtaagaattgccttctttttggagcttgccatataggttgggattgccctctccgggctgtcagggcagcaggcagattgcccagtcctcagcctgcgcacagcatctccagccagtgttcttctgccccagggcatggcccacctgcctttactatcgcctcctcccatcacacacacactctcaaagatgagaacaggaaataaaatccaatcgtaggccaggcgcagtggctcacacctgtaatcccagcactttgggaggccgaggcaggcagatcacgaggtcaggagatcgagaccatggtgaaaccctgtctctactaaaaataaaaaaaaaattagccgggcgcggtggcgggcgcctgactactcggaggctgaggccggagaatgatgtgaacccaggaggcggagcttgcagtgagtcgagattgcgccactgcactccagcctgggcgacagagcgagactccgtctcaaaaaaaaaaaaatccaatcgtaaatgctttcagtgaccatcttcccagatttttcaaggaggccatcatttttgtaccatcttccctaagttgactcagaaggtctatttctctttcctgatttcactgggtgtacagcttttcctttgcagtcttgaaggtgcataggcttggtgcctgtccaagagcctgattatttcagaaggatgagtttcatttctgaggtttctggggtagatggagcctacctcagggcctttccgcacagacttgggataccacttggtcggctgctcatcaggtcagacttatagtttaatttttatacagtttaattcaagggtcttcataataacacagccagcattttttcagcatgagtctgtgccgggcactgctctaaatgctttgcatctgttatctcctgccacccttgggggaacccctttgaggaagatcctgccggcatcttgtacagatgagaatcctgaggttcagagaagtcaagcaatctgtccaccatcacgactagccagaggcacagccaggctcccaacctgggcagcctgactcaatagggaccttaactgctgtgctgtgctgcctttgatgattctcttcagactcacaatagctcaacccagtgagttaaggcagacgagaataaagctgatgcccttcgatgttttccccagagccacatgaaatgtttgctcctctatgaactcaggtaccatgtttccgggtatttgaagagccttaggcagtacccttggggtggagattaagccatttccagtgtgggtgctctgggtggcaatattgctgtctgatcaccccacaggctcattgtgagggatgttggatgcccctaataatgaataacctccctcccagtaaggaggaagatggagatgctgttcttgggggtgagagaggatgcctgggggccacctttgtgaacgagttgcagctggacctccggggctggtgatcaggacggggagtgggaggggaagccctcacctgtgggaggaggcgctggtctctgggagtgggtagtgttggctcctagttggtgagagcaggggtgcatgcccctctctcctccccacgattcatgtctgggggctttttccggtcccctttctgaacacttcttgggcagggagtggatcactgggaaggacccaagaggagcagctgtagagggtgggaccaggggaacatttgcagaaagggagtaacctgcagggtgagatgttgcctggacacccacaagatgaggaccctggtgggacctttgaagtagcagggtcagagggcaaagggtcagggtgagtgaggggtgcagacccccaccaaaccggggcacttattaggagctcagacctgctgtaaaggggtctgcattttagcaagctttccacccatggggaagctggtttaaacctcacttgctgggcccaccccagagattctgatttggcaggtctctggtgagcccaagaatgtgacttctctggatcccccaggttctgctgctgaaggcacaccagggccatgcctggagtggacctgggagagcctcaagggaacgcaggaagagaaacagggcagccgggagaggtttaaatgcttacaggaggccaggcatggtggctcacgtctgtaatcccagcactttgggaggccgaggtgggtggatcacctgaggtcaggagttctagaccagcctggccaatatgtagaaaccccgtctctactaaaaatacaaaaattagctgggcatggtggcgggcacctgtaatcccagctactcgggaggctgaggcaggagaatcgcttgaacccgggaggcagagtttgcagtgagccgagatcatgccactgcactccagcctgggtgacgagcgagactccgtctcaaaaaataaaataaaataaaataaaataaaaataaataaaaaataaatgctgataggaaagagccagagagagggagaggtcgcactgccacagttgtttgacgtgtcagggttgttgttcatttggtgtggctttgttttggtatctgtgctgagcaattgcttggtacttgcatgtgatttcaataaatgttctgtagagactccacctttgtagccggtgacaaccaccatccacctttgggacattcccatgtccctcaatgtgttgatgaactgaactgcaaggtcatccggtggtggacattccttctcatgggggcagagcaggagtttcggcacggagcgtgcaggctctacgatgagggccagtgtcgaggaacaggtccctgggaggttttcagtctgctcagaagtgttctcatctgatctcagcatcagactgatccacagcctggctcaaacccatgaccacttgaaagctgacctatttttatttgtttcctcgagacacacttaaatgcagctaccacgattacccaaatgactgtctgcgtccatctcatggaagcctgtcattctcctgtgcttccctgggcaccagcacctttctgctctgagaagatccttcccaagcatggacttggttcccttttgatgagccgtctagcctgctctagacggtacatttaagaattatgtgatccaagatcaaggcagatttggtaataaacttttaaaataataaaattaattaaataaaaatgggtgtgtgagccctaggaaaactccaggaaattctctgtgtgtagcatgcggctattacaataacattaataataccagagcgattatgataataatgatggcaaatggggcccctggctctgtgccaggcagcttttaaacattttacaagtgtcatttgacttaatggcctgcagctttacagggctgatgttatgagcgtgttttaccgtgaggaaatgccgccgtgtgtgtgagtgtaggtactcagccctggagggcgtcggggccgcccctcaggtctccagagagcggatacacagcggcttcagttcccagactgcttcctcagcactcaaaagccactgcagccgccgttaggacatttgatgtttttctcattttaaaaatagcagatgcttactgcagaaaatgtgagcaatgaagaaaaagagggaattaaaatcacctgtcaccccctctcatcaaccatcgtcactgtcagtgttcgggctgttgctggtggtctctccatcagaatccattctgagtgtgagaggcacgtgactgtcagctcgctgtctcagctggaagccgatgctgtgtcactgtttctcagggtgctgctgttgtctcttcttccctcttgctgtcgtggagtccaacccaggcatgagcagttgcagaagaccaaggctcagggaggggacaggggagaggaatgtggagggtcagcattggggaacagctttcgaactgtggcctgatctgtgaggggacaaggctcaccttccagctctgtccatccctctggcaagttctctaatctttagtgaacttcattttctttatcatgaaatgggacccctgctggcagctgcagagctgttggagggaaatatccagctaaactagaagtctcctggctggaagttgctctgcaaaagagtttgtaggagtctgatatttatttagagttagttttccaggacctcgctttggggtgcttggagctgcctctgtgggtctgcctccgcctccgtcctccctgatctcatctccagttgggaggagagcgcatctccatgtaagcagcctcctccttctcagagggaagccccggcagtgtcagtgctgacactgggcctgtaactgtggggatggggcaggtgagaggccctcaagagctcccggcaccccccaggcgccttcagtggggccagagtccacccctgtctttctctttccttggactgttggaagagctgaagtgaaaagtgacttgttcttgtgtctctggtatctttgggcagcagggctcctgctaagcaagcccctgggggctcaaagcagcagaggctgtggccggttcccagcactggtctttgtgcaggtgtctttctgagaagggtgcatgaggcccagtgccacaggggaacgccagcccaccactggtggcatgcactctgtggtgccattctgctgtccactcatctgtgccctaggcaactttagctgatatctggaatgtcacacgctcagttgtagatgctgaagatcgagcagtgaataaggtagatggagcggtggggcagatggtgaaggaaagaaatgcgggcacgtgttagacaggggtgctgcggagagaaagagcagccaggctcagggtctagaggcgggcgccatatggacagggagtccttgaagacctggtggggaagccggcacctagcagagctgtgaaggattaaggggcctgctggtatctggggagcatgccccctaaaaaaagagcagcaggtggaggggccatgtgactagggtattgtgagtcaggtgggggcccatggccagcatgaggacaggcttgtgctgctggcgaggtgggtgttgggggcagtaatgtgaacgtgcgcttttcagcagggccgctggaggcctgtggctgtgaggggagagccatgctggctacaggtggcggtgtctggcttgcaggaatccaggtgacaagggctggctctcaagtccaaagcttcttttgagttagaggccccggatcctcccgtgggttggctatgggtgctcctaaggataacttgtaaaggggtgtgattccagttttggctagggagtgtgcccagagctttgcttctgggtgcctgtggctgcttggagtgggtggccatcttattggggtcagatgggacagtggctccgtgcagtgggaaggaagcagggcaagttagagggacgctgcactcgtcatcccaccagcgagagtcatcccaggaagccattttaagccctgcatccatgttgagacttcaggaaggctctcccacagagtgcccacccctttactgcagagaagaggtggcttcaggacatcttctccggcagccacggaggctgggccttggggcatcacgtggctccgtaggctccctggcgggtgaagagctcggcccagtggggcattcttgctgctgcagctgtgcactccattctgactcatctttgctgacaccacagcgttccgggaagtgccagttattggcctgacacgaagggctttccccacactaagcaaagcagagaaaggcattcgtgtgcagttacccccgcaacacactctgctctctgttttcagaagctgtgtgggtttggttggggtgactctggctctgtgccaggagtaaacacggagatgggggacaaaagggaatgggagaaggcagagagggggactgtgatgtgcagggcatccacgccccatggctgtgatgtcgggcagcctgtgcccaggaagggcagctggcacagcaaggggtggccagacatgtgcattcctaccctgagtgaactctggggtgagagggtatctgtctggaaggagcaagcatcggtccttttcccacagtcctctcagcaaacacaatcactggttcaaggtttggatgcacctgtgctcatgggctcagggaccagactccctcctctggccagaagcctggcaccatctgcctggtctgcccccactttagggacgtgggctgtggacacagcacctggtccacaactcccgtgtcagaggtaattgcagggagatattccttagaatggtgagacagattttattccctaattcctgacagtaggggaaggagctgtgttccctgccagttcagcagaggtgacttttggatttaaagggagtatgattagctgggcctggtggcatgtgcctgtagtcccagctactcaggaggcttaggctggagggtcacttgagcccagcattttgaggctgtgatgagccttgattgcaccactgcactccagcctgggcagtagagtcagacgctgtctctaaaaaataaaaataaataaataaataaataaataaaaataaaaaagggagaatggaggaggagaaggagggtgagcaggggctcaaatgaaaaaagccatggagctggtcagcgtgcatgtgtcaaggcggccttgtctacagctggcagtggtgaaagttagggttctgctcctcctcccaatggtgacatgcggaacagtggctcttgggtccttgagtgacacacctgagtggtggaggtgcacgcttactgctttgaaggctctaaggagggaggctggggcctggggccaggggccaggggccaggtgaggctggctggagcagccacattttcctggcagccctgtgctttcttgggctggtcctttgagggggcccagtcctcctgaggctgtggccttgacctgcagaagccatgctagagtccagctgtctcttggtgcaggggtgtaaatggcacacattgtcaatgtggggttctcctacccctcatcccccagcacccagagggagagggtgccgctgcggcaaagaggcttgaagttggtttggtttgggggatttctgttgtgagtttttaaaaattgaggttaaattctcgtaacatacttagctgacaggagggataccatgatcatgtaggtagctttcccaaggcgaggcttatccgttatactccagatgtgctgacccctatgatttccccaaatgtcagaaactgaactgtgtaatttgtgatggtgtggaactgtgttcctgctttccctgatagaaaacataaattaaaaatgtaaaaactaagtaatttatatgacataaagtgaaaagtacacaattctgtggtatttggcgcatgatgttgtcatgcagccttcatttctgtctagttccaaagcattttcatcacccaagagggaacccatccatacctgtcaggcagtcactccctcgcccccagtcgaagcgctgcccctgtgcctttgcctgttctggatgtttggcgtccagggaagggcttgaacacctttttccttggttctgtgccatcccctagtccctgtctttctggcggcctctgggctgcccgcctgcctgcctgacaccatgtgccctctgtctttgcagctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagtgagtaacagagtgggttccctggccattagaacctctctcccaaggtcaagggctttctccatcaccctggtgcttacctggcgtctgcggataccccagagggagcctcgcccaagtgtgtctcgagcaagtggcctggatgggcagatgcagcgcttgctggatggaggttgggataaaatcacgccctatggagttggttattcaggagcagtatgttcacatcactggtgtggcaggattgcctgaggtggtggggtgcagagccgctgcggctctggggttccacgtagcatgcccaggccacgggccctagccttgtgatttttagctaaggctgtgcctggctctggttgactcagttctttctctttatttcttccataagattgtagcgtgtctatcctccagctttagaattgttgaatcctaaagtattaattggcattgaacttttttttttttttttttttgagatggagtctcgctctatcgcccaggctggagtgcagtggtgcgatctccactcactgcaagctccacctcccgggttcatgccattctcctgcctcagcctcccgagtagctgggactgtaggcgcccaccaccatgcctggctaattttttgtatttttagtagagacggggtttcaccgtgttagccaggatggtctcgatctcccgacctcgtgatccacccgcctcggcctcccaaagtgctgggattacaagtgtgaaccaccgcgcccggccggcattgaactttttaaaaatcagaaataagtcattttttctctttgagatgatgtctgtcccgtagctccagcctgttggtgctggttgtgtctgtggaacgtgcctgtggttatttgcgggagatactcctgggatgcctgcatggctttgtcactctgtggcaaatctgagggggctccatgccatcatcactgaagtatgcctttgggtggcccagctcctcctgtggctgtgggcactcctccaccttcatgtgggggcaggtttagtgctgttttctggtggtcctggctgtagctggcagccttctgggggcttctccagactccgttggggcctgggattgggaacatgcccccccgcctctgccgtgggtcaggcctctgctagatcactgttttaaccaggctggaggtggggatgtcacatctcctgtgggtcgtgttttctggataactctgcagcagacactccttccccagcgtagggcagaggccgttgctgtgcaggtcacgtccttccccatgtagccgttcctgcctgagcctccagcgcggtcacccaagtgacacctgtgctgtgaggtgccttctctccaagggctcgggtgtcaggttgttccccctgccatgtgccattccaagacacagccagaggggggcaggattagggagggtgaagcgggcctggtacgtccagctcagcagtggcctgtccaggcttccctcatagggacttgttgaaagagcggcacagacgcaagcctccatccacactgtgagaggaaggaagggttttgctcttgcaaacactttttaacctacagagaggaagcagagccacgttgctgtgtaacagaatggaccatggatagcactaatggagttgctgtgccctccccaggttccaaatcccctcatcacccaggctgcgcaagaggctgccagggtctgcttgtgccaggaatgatgggcattatgtcaggcgaccctcactcaagcttgctgtacactgagcaggggctgaagggggaggtgggagctggagtctgggactgctagagcatccagtgacctcgagtgggtccaaggcgccatggagtccagtgtagtgtcctcgcccatgtccctgggatgacagtagctgtggatctccctccatgtagctgtgacaatcagagctgcttcccccactgagtgggaacgccctctctttccatggctcatactccccaagcatgcaccttccttgctggcacagtgggccatgtgcccctcctcctgctcgcccttccacctctgttggacatcccagcagcatcagatgtgcctgtgtctggccctcagtgtgcccgcctgttaccagctcctcccatgtgccttctgtgtcctgtctccaagatcctctcagacatggaaagactctgcttggcccggcgcggtggctcactcctgtaatcccagcactttgggaggccaaggcgggcggatcacgaggtcaggagattgagaccatgctcgctaagtcggtgacaacctgtctctactaaaaatacaaaaaattagccgggcgtgatggcgggtgcctatagtcccagctactcgggaggctgaggcaggagaatggcctgaacctgggaggtggagcttgcagtgagccgagatcgtgccactgtactccagcctaggtgacagagcgagactccgtctcggggtggggggttggagataatggaaaggctctgcttaacccccaggtccctactcctgtgaagccagaccccttcctggtggatcccttccctggatcaccagcctccagcacggaggtccactggatatcaggacgttgaacttgttgagcacttctcacccgcagtggaggctcagcccttccagcccgccggcctctccctaccccccgggaaggagtgtcagctatacccttcactgaggagggtgtgggtctgtcagacgccgaggccatagtttcaggaacatgaaggtttggtgttgctctcacccctccgatggaggacccttaacttcctgatgaaggatttctctccatgaaccccttgcttgggtcctatctgcatctggtgtgttgtaggcagactgcttgccacttcctggcttccctctccatcattttatcttcagcctcccacatccctgtttcaaagccatgtctctcatgagcggttcatagttggtctgttgttggatcactcaggtcagggtgggactctggaatcaacgaatgtgtgttcattttttccaaagaaacaaaagcacaggccaggcgcggtggctcacacctgtaatcccagcactttaggaggccaaggcaggcagatcacaaggtcaggagtttgagaccagcctggccaatatggtgaaaccccatccctactaaagatacaaaaattggtggggcgtggtggcaggtgcctgtagtcctagctacttgggaggctgaggcaggataatcgcttgaactcaggaggcggaggttgcagtgagttgagattgcgccagtgcacttcagccagattttatctaaaaaaaaaaaaggggggcaagggtccttatgtgatatctctcagttcttcccttttgcaaatctgaatttgtatatctgggcctggtaacccgttttcctggggagcccatcgccagctgtgtggagatagcagccttaggggagcaggaatgctggctgtggccaggcttcttggacaagctttcagtcctgtgaaccctgggccgtttcctcatagcagggtgagtgtgatgatcccgtggcctcatggctgtgtttctgggcagcgtctccagctgtctgagatggcagcagtgtcctattgaaggagctccagggtctttgtgagggaggagagtgatgggatcctagagtggcgggttgaatgcctccaggcattgagtgagattctccttcaagggcttgtgaggcatttaaagtacactgaggccgagctgcacttggcctcaataagcacatgatgtttgattaagattggagattgcctacgctttagaatctgaccacctgtgaccactggaactcacctagagtgggggctcctgctgagcactggccctctctccgtctcctgccccatctcccacctgcccacagtacccccactgcccagacacagtgcagccgccctccttcctccccttggcctgttagtcatcagcgtctgccgtcctggctcgtgtggcctgagctagagccgggaggccaagagatggctggtgcccaggaccaacttccccgtgatcagtgtgtggcaatttgctggccatgctgccagaccctctggcacagaaaccagggacaggaggaggcaggatgcgagcaccctggtgagctgccaggcggcctgctggggtgggcacaggtcagtgctaggagtatccatctcgtaggccttcctggtgccactcagcagagacatgtgaagcccttcccagggccaggcaccagctggggtcagaggtgcccagcagagcataacgcagaacctggacctgtgggcgacgactgtggagaaaagtggggatctgctgagggggcagggcaggcaggagccggctgagggcaacgggaaagtcaccaggtaccgtcctccacacctagctttgccagattgacgtttcagagggtgaataatcaccctgtggctgcccctggccccagggacagagctctgccccttcagggatctcagatgcaggttgtgtaaggacagccttgtgccaggttggaagccaggcctggaagcagtgtgctcagagcagcccaggcggcccacaggcgagtggaggggaacaactagggaagtctggccaggaggaggtgactgcactgaggggctggctggcaggggtctctgcctggaggctgagaggagctcaggttatttatgaaggcagtatagacctatgtggagcttgaagcccagtgtctggatcagagtctgctgggctgtgggcccagagctgggagccagccactcacttctgcagtgtccgaagtgatgaggaggggctgggctggagccagtcttgcctgctggccgtggccacagggggtcctttctgctctgactcctggcttctgctgccagggcttggaggcttggaggtggcctctgtcccaacaagagtcctcaaaatcctcagtttgtccaggtgagggatcctgggtgggggaggttcccagggctgcggcagcacagaccataccttgtcagtgtcaagccctgactgacccaggagtgccaggtggtggtgtgctcactgccagaaaggggccagtatttgaagagcagtggaatgtgctgggcacgctgtgcaggcattcctcagccctcctggggctctaagggtgttattggggtatgctgccatacagaatattagaaagcaaaagaaagacgcggttgtcgggaggcagagcttgcagtgagccgagatcacaccactgcactctggcctgggcgacagagcgagactccgtctaaaaaaaaaaaaagacgcagttgtctttgacctgcgtaatgttgaccgagattcgtgtggtttcacattgtttaaatttcatggaaaactatggtcccgttgtaaaaaccaagtctccaggtgaagaggcgacttgcacttcctggtgctgcccctggaccctgatcctgctctctctgcctcccaggcaaaggccggcgtgtgcagccccagtggtcccctcctgctgggacccagccatgcagactccacctttacaacagcctcaccaggaacaaggtaaggagaacacagatgccgtggcacacgcacacaatggggaggcaggaggcaggacagcccatgtgccttgtcgcacaacagacttctctgttccttgtgttgggatctggagttccataaatccaggtttaagatccttcagtcacttccatgttatagtctctgtggcccagaggcagagctgtcctctgaaacccagacacgtgaagtatcatgcctcatgtggaagcctgcccatgacttctgggcatggatcaccctggcttgtctctcggactctgcccaaccatgagtactggaggtcatccacagccacgcctttcaggaggacgcgtggttgcagcaggtggcactgtatgagccaagcaggatggacaaaacggcaaactggctggatgttgttgggagcacagcaggttttgagaagaaggcaggattggttcctaacagaatggggtttgcatggtttgcttggctcagggcatggccagtgactccagtgatttcagaccaggctctgggcggggctgcttggatttccatcagggagcatgtttggcagacagagagtcaggtgtgagggagttcatggccttccttgggaaactggttgaggatgatgcccccagagaggtctgagggtgctgggatgttggggagtggtgccagagcagcaccacgattcaggggtcctggcctccaagccgcgctcccccaacagggactgaccctggccaagtgttgtctgcctcagtttcttcatccgtaaaaagaaaatgacataacctacgtcctagagtgtactgcatattgaatatttagctcagggcctggcacatggtaggtactcagtaaatattagctgtgttattgttaaataagcagcatttcaacaatcaataaaatcattgattccctttatcgtctccctccatagatgagtagaaccccagggaggaagaggccccacccacccagggctcagttggtgggaggtgccgtacatctcactgggctcccactgagactgtgacttttcacagtaaaacaaaatggtctctgttgaattgtttacactaaacacaaaccacactgtgatgtttgttgctgtttttggtaatcctgtgcagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtaggtccaccgcggggtgtccctgcagcttctgcagttgcacgcagaagtcagagccattgggatccacagcagcgatcttaggtccacaaagatcttagatctgctacagagacctgagatttgaggaatcgagactgaatttcttctcttatttttaagatgaaaattttaattccataagtaatctatattcactgcagaaagactacagatcaccaaaaagaaaatgtccatagccccactgctaacatgctggactcgacctgggcactttttctcacataccttaaagttttctctcatccctcaagctctcgtggggtccccagatgctgagttcccatgacactcagacctgacaggcctgacgctgggttggctgtgaccgccccccgaccactggatggtcatggctgtagctcctgacgagtagctggctgttggggtaaatgccacagagtccttttatgtgttcatgttttagttgcagtgccaaggtcatgtatagtcaacccttgaacaacctggagggtagagggtgtgaccctctgcacagttgaaaatccacacataacttttgattccccaaaaacttcaccactaaaatagcctcctgttgaccaatagcatgccagtcaatgaacacatattttgtatatacattacatactgtattcctaatgataaaggaagccagagaaaagaaaatattatgaagaaaatcataagggagaggcaatatatttactattcattaggtggaagtggatcattataaaggtcatcatccttgccatcttcacgttgagtagactgaggaggagaagggggggtcttgctgtttcagggatggcagagaaaatcatatataaatgcactcatgcagttcaaacacgtgttgttggaggttaagctatacatatcgtctggtgtggaaatgtttgttttttcattgctttaggtcctacatctcttttgatatcttgagaagagtgttgaaggattacttcaaatttgatgtcttttattgcatgaacattacggatattgatgacaaggtaaagggaatttgtaagattaaattttaaatgcaattggatggtgtaaaagaagatagaactttcgcataagtaaataatgtaggcttgagctagcttgtgttttcacctgataaacatcattttaatcccctcagtgagttaatattaccacttctgctactgatatgatcatttctatgatgttcagacacggttagaaacctgcatgttgctcaggggtcggtagccctgggtgttttgcagaaggaaggcctcccacagcacgcacttcgacatgtggcttgcaggggaagctggggcccccagggctcatttcattaagcgtcagaaagatcacgttaggccttgggcactacttggcaggtgggagatggagggtggtgtttctatttgatgatggtgtgcacgtccggggcccacagttgtctcccaccaccctcaccctcacttagagttggccaagggagagagtggcctgctgcagagggatgcatgtgggatccaagcatcactccccaatgtctgccttccctccccagatcatcaagagggcccggcagaaccacctgttcgagcagtatcgggagaagaggcctgaagcggcacagctcttggaggatgttcaggccgccctgaaggtgggcctcttgctgtctgctctagaaaccgagccctttgctttctgttctcggtcctttgtaggctactgtccctagggtagtgtcagtctcacaggctttcacaaagtgtatgttactcaagccagttccgtcaggggcgctgaagtctccataggtaaggtcccctggcctgtgacaaagtcaccagcaaagatgtactggagtggagtggagagtaggtgacattcctgccacttacaggaaaacaactgaattcatcacagtgccactaattacacttataaaaatgcttaccaatattgctgtctaattttcaatgccaaggttacaactaaatcagaaacttctgcccaagatacaaaagctatactaagctttttaatttggtaatactgtaaattttcagaatcttttgaagaaattagttctctctagtattttcattctgaataaccatcgttatatacttatttttattacaatagtaagaataggtcattttactctctactaattatccttagtaattacagtaatcattatggatatgcttatggcattttatctctggaattaaaaacaggaataaaattagagctgagcaatcttttaggtcagtgaggcctgagtaccttcctgatggatgtgtctgcagcacacctcagaacacactgggtggcctacttttcctcatccccagaacagccctagaaatactgctctcacacccaatttgcattggagaaactgaggcacagagaggttaggtgccctgtccagggtcacacgtgagagggcagaaccaggagctcctgagccgggagcttcagtctctcttagttccttactgcctggccacttgggttgcacacttctctatctctatggggccatgggaaaaaccgttctgttttctacctggaatcacctttatgaatttaggttttgctgagcagtatctaatagatttgacgtctctttatggttgcagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgaggcttcacacatctcccagacagcccgttcgggtcaaatgtcgggccgtgcatagactgatctgtgtgcacggattgattccacagattgtcttagtggaagacactctgtgtctccagtagctccactgtggcaggcggccctgttctgcggtggctgagtcagtgcccctcccctcccacacccctttgccccatttcctgggtgcagagcctgtgccactggaaggagactcgggatccacaccctcccaccacttccatcagataggcaggaggtgcacttggaacgtggggaggcagccttctgtcgaagtgttccaagattctccagcggactctccccacaccagctggagaaggaggagcagggattaacattgaattgagcattgaggcctgtgggtacctactgagcttggggccttcacgttgaccagctctcctgcccctgccaatatctccttcagacacagggcagagacctgggtgcagaggggaccctgccctcttcctcaggcctttccctgtggctggcgccctggacacagtcaggaaggccttctcctttgtgccagcgccgcctgctggtcaccctttaagaactcgatggaaaagagaagagacggctgcagctgtgtgtagaaaaagaggccccactgaggccgcagccctgccttccctcaccactgccctggccccacctcagtgatggggcagggagtctgtgtctgcccttcgccagcatgtttctttctagtttggtctcttctgtgtcctgactcagcagatcgcttcgttgcgcctgtttccaaacttcacggaaacacgccacgtgtatgtagtcgtcagtgtgctttcacccaagctgtgcttctgggacgacccacatgtggtcactgtcactgcctcagtgcctgcctgggagccgagctgtttgtctgttctcctgggacgggcagttaggtttccttcttaccaacaatgctgctgtaatttttttcccagttgttccactaatattctttttttttttttaattgtggtaaaacacacatcataagaaatttaccatcttagccatttttaaaaactttttttttgtagagacagggtctttttgtgtctggtttattttgcccagcatagtgtgcccatggttgacccatgctgtagtgcatgtcagactctgcttccttcctatggctgaatgatactctgttgtgtatagatgggccacattttgctcatcctttcacctgcccgtggacacgtgggttgtttccaccttttggagatgcaagtaatgctgctataaacctgggtgtacaaatatctgtttgggttcctgctttcacttcttttggggatatacacggaagtggaattgctgggtcatgtgatgattctatttttgatattctgcgtaaccaccgtattgtttctgcagtggctgcactattacacattcccacccatagtgcatggggttctgttttctccacatccttgccaaagcttgttattcttcatttttttcatcccagtaggtgtgaggtggtatactgtggttttggtttgcatttccttaatggctagtgatgtggagtgtcttttgctgaactgtgagttgttttgtgttgtctctaggtggacatttgcaagtttctttaggccatatacctgcaagtggaatcgctgggttgtgtaggatatatgtgagtgactgtcgggggttcccaacactgcccacacattctggggccctagaaggactcatgagactcggcatcgagttatcatcttgtctaaggtttgtagcagtgacacagcgaggagcagaagctcaggcggagtcttcaatcatccatgggcaggctgctgaagcttcctccctgcctcccatgaggggacacagcacactctcccccaccaggaaaaaaatgcagccacatgtgtgaaatgtccctccctagggaagcccatcacataggcaccctctgcct

SEQ ID NO: 14959 - DNA, 12423 bp, Human
cctaggtttgaactaaattgaatttctcggtttggtggcattgtgggggtggggagatggaagtgggtgtagcagagtaggaggcaatggtgcaaggtgttgtagccataggaatatgaatttccatgtcagcatttggtttaatttggcaccgagtgttattcaaacaaagcagcgttgtgagtggtagaggaagggagaggaggaaagtcaacacattcttggaaataagatgtggcttttgctttgctattttgttttttcttcagctacagacatatttctttgctcttgggctcacactgtaaatccctttcagtacatatctaagtttcagagaaacttctctttaagatgacaagaagttatcaagacttcccttgatccttgtttttagtataagaacccttcagttggggtcatttagcctagggagaaatctttgcatatacttagacacccccctccaccatgttgaatatttggtatttcctaacgactttacctcaaagtgtttgaaggtgtatgtagatgtatcgtttatccattctctccatgtatttgtgtattaggcctttcaaattttagtaaaaattttagtataaagcctggcaatgcaataattaattttccaacagttgctgccttgcacctcagacgtctggcaagatgttataggaactggtcctaggtcaatattcgaagcacagggaagctctgtgtgaccaagtcaatggaactttcctgtgttctggtcctgaggtgtatgtttaaagcaacgtttcaagcagaaaagtttgagtattcatctctcctccacaaatgcaggtctttttgcaatggcaatagagtaaatagccacttgtgatattaagcttgtgtcaatgatgaagggttggattgcatagggaactgatacagccttctaaccccgttcctctagagataacacaaactcacttaacactcagtctctgccttcaaagagctgacgctttagttgagaaatcagaccttaacgcacctcctgtgttgtaacaacatagaccaatatattcacaatatataacattaggttttaatctctctgtaatcagctgggttttgatgggaaaaaccaggtggctggaatgtacagtgcctttctgttttaacatttaagaggaggtcacactcaccagggatttttccattgcactctctctttttaaaagtttacagcgaatagctgaacttacatttcactattatgtaaaaatactttccctcaactttccaattacttaggggataaaaaaggagaggaatactggggttttgcaaagtcctgcaggtaaattctaaagtcattattatctttaatacctagcttagaaattctttcaacaagtggtgattattttcctccattcacatctccccttcctaacccataaaacaatgttcacaaattgaaaagcacacaagtgagaaaaaaatcagcctaattccaccagaggtaaatttcactgttcctttcagtttttgtctaagcacacgtgactgtatgtattgctttgcaatccgctttctttttgcaaatatatttcttgtgggtattttcccatgtattttcttaggtcgcttttaacctcttcattcttttccttctctctagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagattgtactccacagagagatgcagacaaagtaaacaatgaagtaaggtgccttttaaaattttctatttggcaatatttgaagacttaactgaatgcaaaattgacccagtttttaattttttttttgagatagagtcttgctctgtcgcccaggctggagtgcagtggcgcgttctcggctcactgcaagctccgccttccaggttcacgccattctcctgcctcagcctctcgagtagctggaactacaggtgcccaccaccacgcctggctaattttttgtattttttagtagagacggggtttcactgtgttagccaggatggtctcaatctcctgaccttgtgatccacctgacttggcctcccaaagtgctgggattacaggcgtgagccactgcacctggccagtttttaatttttaaatataagctgaaatagatagggcgggtaagaattgagttcagacggccagcaagtaacacttttttgtttatttattatttagtatttttttttaaagacagtgtctctctctgtcacccagtctgaagtacagtgttgtgatcatagctcactggagccttgaactcctgggttcaagtgaagtaacacttttaaatatataatccagaaggtggaaataattgggaataattatttgttctgttgagaacatatggaagagaatagatttcaataaaatgacaatcaaaggctatgatacatacatctttctgcagaggtatatgatcaaagtatttattaccataaatatatctttctgcagagttatatgatcgaagtatttattaccataaagaaaagcacaggctgcttgtgctgtatttaatctttgtttttttcctcccattagggttgttttataaaggtgatgaccattatagagtcagaaatgggagtcgttgcaggaatttcctttggagttgcttgcttccaagtaagtttttgtagttacttaggaaatatttcatccctcttgtaggtgtaagctagaagattttcacttttttttttttgagatggagtcttgctcggttgccaggctggaatgcagtggcgtcatctcagctccctgcaacctccacttcctgggttcaagcgattctcccacctcagcctcctgagtagctagaattacaggtgtgcgccaccatgcctggctaatttttttgtatttttagtagagttggggtttcaccatgttggccaggctgatcttgaacacctgacctcaagtgatccgccctcctcggcctcccaaagtgctgggattacaggcgtgagccactgcatgcagcgagattttcacttttaaggcttataagtttttgcttcaggggactggatagtgaggacatttttagggaagtcgcattttcacaaaactctcagttactggtcacagtataaaaatactttatttaggagaaatacctaatgtagatgatgggttgatgggtgcagcaaaccaccatggcacgtgtatacctatgtaacctgcacgttctgcacatgtatcccagaacttaaagtataattaaaaaaaagaagaaaaaaagtaagatttagaattaacttgtagcagtgcatatcttttgaaagcagttaactgtggaaagactcagtgccctcttagttatggcaactttccagtatcatagctcatgaaacaaaacattagataggaaccttggttctctctgcggtcagtcaagattctaaaatgttattaggatcttttctgggctgcaactgcctgatgagttgtatacaagttccaacctattaaaatttagatgatgccacccccacattccttatgcaccagttgtttggggttgattccacgttgtagatcaaattgtgtttcccaagttgtgtttcccactgtagcatgaagtttgttttgtggctctgaacgtttttttttatattaaacactagaaataagactaattcaagtttcgtcttaatatatttttaaagtagtaagcaaagctatatctaaatctatgctaatgcagtagccactagccacctttgaattgttataaattattaaataaaattaaaacctcagtttgctggagatttgaaatacttagtagccatgtggctgctgcctactatatcggacagtacagggattctagaacattttcattattgtagcattgctgtggatctttccagggaaatctctgccctcgttgatggagatttcacttgttaagatacttattgaaaaccatgtatttgttttttctgggaaatgagagtaagaaaagtttcttcaaaactcgtgactgaattttccttgagtgagtttgctggattttcctttggtgagagttgtgaaattctgggtcacagtggcaataaaacttcacttagattctttgaatgtgatctagatgctgcagagtattaaacataactctagaaaaactcaaggacgaaaattataagcgaattacaagtgagaggagaatatagtctgaggtgttcaagttcttttgtgtatgtatttaattttgttcctattttatttctagctgattggaatctttctcgcctactgcctctctcgtgccataacaaataaccagtatgagatagtgtaacccaatgtatctgtgggcctattcctctctacctttaaggtgcgttcattttggtcctcagctctgttagtgttgatatttattctagcctgtgtatgtgatgcatggactaagtttgccaagaacgtcttgtctagtaatatatttaaatctagctggtgctatgtaaaccctgtgtaggcaggttaggtctctatacacagggcatggtcagaaagtaatgacttagctacagcttatctatgcatgctctctacagttatgcaacagaagactccccgtgtgggtttatatatttacatacacatgtcagcctaaagatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagttgaagtcagggaattatttctttggttttgagtctctttatacatccattagtagaacctgtctagtctgattgccacagtccttgaattgatggtaagggggagtcagttacagttagaaaaaaacctgggcaaaaactactagttaaatgatcatgaattttgagtatgtgttttaaaatgcttggagttattgcagaaaaatgatattctccattagaacatttgatgtgtgacttttgacataggataaggtgataagaaaattaagttgaaaaatagtgactcaagtacagcaaatcagatttttggctactgagattaaagaagcaaatatttaaaggattatcagcaattttcaaatacatatttttcactgcagtggttttgaagaatgttttaaggttatatttagagtttttaaaaaagttttccctcagccagccatggtggctcacatctgtaatcccagcactttgagaggctgaggcgggcggatcacctgaggtcaggagttctagaccagcctggccaacatggtaaaacaccgtctctaataaaaatgcaaaaattagctgggtgtggtggcaagcacctgtaatcccagctacttgggagactgaggcaggagaatcacttgaatccaggagtcagaggttgcagtgagccgagatcacaccactgcactccagcctgggcgataagagtgaacctgcatctcagaaaaaaaaaaaaagttttccctcattattaaaaaggaaaaattatagaaaattaaaatatagaatgtagaaagaggaaaaacaccacacatcactcgtcaggtggattggtttgtttatttttaagatgggtttattttggatagccagttagaaaacgcccttatagctgatgtgtgcttgtgcatactgaattgtatacttaattctgaaagtaatgaggaaacatttcacctaatgataactggtacaaaggaaagttcacgtgtctttaatagtttgctaattagactagctggttagaaagagggatcactagattggagagagagatccagtttccactggaggcagtaggtctgctcatttccatggtgacaatcctaatggcagagggagtgagtttcccttagtggcacaggctgggggttttgagcttttaagttttgttttatagaaatctggagaattttacattttacttcactatatatctatgtttaaaataattcatttttgatgtcccaaaattgatgtgggttgccttatttccaggcaccaggttgctcactgcaaggtgacattttgagaagcagaaatctctaggtatatcttaagtgtgaaaagcttgttagatttccatggcctattccaggtgggttgttgggtttatgttgtaagcatcaaacttttgtggaaataaatacctaatacaaggtataaataccatttctggttttcctcagagctcacaaaagaatctttgagacttgatgttttcaacctcctgtcagaatccaagttggtgatgcacccaaacaaacctgttaaaatatgagacacagagccgggcgcggtggctcacacctgtaatcccagcactttgggaggctgaggcaggtggatcacgaggtcaggagatcgagaccatcctggctaatacggtgaaaccccgtctctactaaaaatacaaaaaaattagccaggtatggtggcgggcgcctgtagtcccagctactcaggaggctgaggcaggagaatggcgtgaacccgggaggcggagtttgcagtgagccgagatcgcgccactgcactcccgcctgggtgacagagcaagactccgtctcaaaaaaataaaataaaataaaataaaaaagagacacaaagcaatatatgcattttctcatgaaacagtaaactttggttcctttggactattctgtgagggtttttgtttgtgtttgcaggaaaaaaaattaacctaagatattaatgccatttctacttttcctcacagcatatataagataatttgagatttgatttttttttaagtttgctacttttctaggttgaaactttgtgatgcggcaaaccaaaccttactaatttaaaaaggaaaacaaaaggctaatgtgtcagaaatgaatatataaactgaaacagctatagggaaataagactttcatttttaagtcatcgctttaaa

SEQ ID NO: 14960 - DNA, 11111 bp, Human
cggctgcgtgggctcctaagaagtctaagaactgctcagaaatccagcgccgccatccccactccaccgccgccaggggcgcacagcagcgggtatgcggccggagggaaggggcggggcgggaggaaggggcggggcgtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtgagtccggctgtcctcggcttttcgggccgtgctcagtccccgcgtgcgagagaggtttggggagagtgctaggcttcgcggggcggggccgccggcggtacgcggaggggcggggccctcgcccggcttgctgggagttgtagtctcttaactgctctgagccagtggcttgcagggctacaggactacaactcccaggatgcgccgggcgtgggggcggtacccagtctggagggagctgttgtcaggggcgttctggctgctcactcgtgtcaacccgccgaactgggagtgagtccagggagggattcgaggttcagggccgggaccagggagttaggctgcggggcagccacgtgcacctcgctttttccccaaatcagggcgggtctcgcgcctcctccccaccactgcctcctccccagcttgaatccctctcccacctgcgtacctgtggatctcaccagagcatcctgcctaggctcggcccaggaagcgactgattttcttttttttttttttttttttttttgagacggagtttcgctctgtcgcccaggctggagtgcagtggcgcgatctcggctcactgcaggctccgcctcccgggttcacgccattctcctgcctcagcctcccgtgtagctgggtctacaggcgcccgccaccacgcccggctaatttttgtatttttagtagagacgaggtttcaccgtgttagccaggatggtctcgatctcctgacctcgtgatccgcccgtctcggcctcccaaagtgctgggattacaggcgtgagccaccgcgcccggccgaagcgactgattttctaaattggttgttggaactaatttgatatctgagagacttcaagaaactaaccttatcatgggggattaaacattttacactttaaatggatcagcttaataacgcaggtttgactgagcagtgtttcagagatgttaagtggtgacctgatcagtcagaacaggctggtgtttgagccttgggacagtgatgacttttacaatgtggcaacatttgaagcctgccctgtttttaacacctattttggatgtcaagctcatcacagcagtcagggatgtatactttaactcgcctgttgcatttttctgtctcgaaaatgaaaacatacaggagcaccattgcttgcacatagattcttagtaattggatgtccataaattaattccttatgccccgacagatagtttgtttcattccaggataacaccagggtaaacaaatcaagggatattcaattatactatatttccttgaaaataaaatagtgaaaggaacaggacataaaatatacagcattgctaatttgcaaaagattaaatgcaagcacgagttttccattaaaagtattctgttcaatccccttcctgtactgtacgtttgaatgcagaaatgaaaaacttaagtagtcagatttctctttgcctgagataggtaagttaacataagaggttttgttgcccgtgtttttatgttccagtgaaactcgtggagaaataacaactttcatgattttgtttcattcctaaaaacctgggtgttcatcttcatggaagtaagaccttgtttgtattacacattccaataggtttcatttctcattcctgaatgtgggatactatcggaagaactgaaaaacctggtcatgaacactggaccctattactttgtgaagaatttacctcttcatgaattaattacacctgaattcatcagtacctttataaagaaaggtaagaaaaacctgaaatggctgtgaacaaggctggatgaggaagggtagggagaccacatcacgatgctagggctgttgttttgtttcaaacagggcctgtggtatagtctgtgtggtcaggtgcacacgcgttctcccccgcattctcatcctgttctttcttgtaccctctttaggtggtggtttccgattgcaattggccacaagtgttggatggggatgttgtaacatgacagtatccgtccccttaaaatgaggattaatggagaggagagacttgcaatctgtgttcagatgcactgctgttgaagatgtggctgcaaagacactatgctgtcagcagtcccacagcagctgtctcagagggttggtctcccgatacagccacagctactgttcacagagcaaagtgcttgttggggtccagtgtcttctgcttagattttgtagccataacccctcctctactcaccccatttccacccatatctgctgggttggactggtttgtttcagttgattcctgggagccatttgtttgaaactatttcagagggcctttagggattccacccacactacataagtcacctgtacagtggccacatgcttatcttgtggtagcccccatgtgtgtcctctccagtgaagatatgaagaactctagttaccagtagctcctctcattctgacactgctggggcgacttatgagctgggcatcttgtccggtctcatcaccgttattcctttcatgtatttcaaggcctgacaccactctgtgaattacgtggacaatggctgtagcaggcactgttaaatgtcttaccaaatttaacccttgcaacaactttatgaagcaagcctatgatcctcatttaacagtgaggaaactgaggcttggagaggttgggtagcttttgaatcttaacctggaactctgtctctgagaggtgtatgtttatctagaattctactttggacccctctccgcgcatccccaaaggtcacgttccgttctgagtcagttttttgcttgatgatagtaaacttgcacaaataggctgttggtcagggagtgaactagctggagcttggtcttctgcaagcttggtcttctgcatgcttggtcttctgcatgcttggtcttctgcatgcttgttcttctgcatgcttggtcttctgcatgcttggtcttctgcatgcttggtcttctgcatgcttggtcttctgcaagcttggtcttctgcatgcttggtcttctgcatgcttggtcttctgcatgcttggtcttctgcatgctgcagcttacccttagcagatgtttggtttattgagtgagctggagcaggggtagaaactgacctttaatgacccggaagactggttatcttgtaaaaataatccactaacatcttgcaggtgtaatttcttgttttaaatttttcctctgtactttctcttccaggttcttgctatgcactaacatacaatacacatattgatgaagataatactgttgccctgctaccaaatggtaacactttattttttcatctttctttaattgttaaaaaaaaatgcatactgtaaaaaaaaaaaaaaaaaaaagtcggctgggcacggtggctcacgcctgtaatccctgcactttgggaggccaaagcaggtgtatcacctgaggtcaggagttcgagaccagcctggccaacatggtgaaaccctgcctctactaaaaatacaaaaattagccggcgtggtggctcatgcctgtagtcccagctccttgggaggctgaggcaggagaatcgctttgaacctgggaggcggaggttgcagtgagccaagattgcgccactgcgctccagcctgggagacagaatgagattgtctgaaaaaaaaaaagaagatattcaaaagaatgagtataccatgacttatttatttcatctttagtagaaattcagattattttaaatttcactgttataaataatatccttggatgtataatgtataaataatatctgttacaagacatgtatacacataaataatattcttgtgatataaataagatccttgtatgcagtttgttacattgatatctaactgctcaatttgccttgctttcttttagtcagacaacgtaagttctagttttggtatcttatgggagttattatttgatttatagggaaattaattttgtcactggataaagacacttatgaagaaactggacttcagggtcatccatctcagttttctggcagaaaaattatgaaatttagtaagtatcatgtgtgttccatctgtttctaatcttcttgtggcaatttaaatttaaatgtttgaattgcctctaatctctttgttcaaaaaaatgtggccttttaaaaaaaatctgtcaaacttctgactcgagcttcacagaggataggatgatgcttttaagttcatttcttttcagctgtagatgcatttaataaagattgtagacttggactggtcaattaaatatatatgtttcgggttaaaccttggcaggccaaggcgggcggatcatgaggtcaagagattgagaccattgtgaccaacatggcgaaaccccatctctgctaaaaatgcaaaaattagctgggcgtggtggcgcatgcctgtagtcccagctactcaggaggctgaggcaggagaattgcttgaacccgggagggggagtttgcagtgagccaagatcgcaccactgcacttcagcctggcgacagagtgagagtccatctcaaaaaaaaaaaaaaaaaaaaaaaattccaagtactgaacccaagataggagtctacaacttattcttaataaagaatttcctttggtttccccaagtctttatgattactagtagaaattcacccatgagtgaagagatgttttgctgacagcgtctggctgaacatcaatagctaaggccgccacatccataagtagattaaacctgacctctcaaggtcctctgcccttggtctttgacctaggaaacatataaattgaaaatgtctgtttttattagctctcaaggttagaagtgcccaccaaagggatcttatttatttggcaaaccaaagggagtggaagaagaataaaacaattttactatccataaaatttcccaaaattctagtttttaaaaatgtaacactttttccatggtagaagctgtacgtatatgaatgaaatatatgttctttttttcatttttaaagttgtttccattgatttgatggaattatccttaaacttggattctaagaagtatgaaagaatatcttggtctttcaaagaaaagaagccattgaaatttgattttcttttggcttggcataaaacaggtatgaggaataaattatgtaatgatacagtgattttgaaagtaattgttaattaaagaggagtaatggaggattgaatggtgattcactctttagtcaaggaatattctatacgtatatataaaaatattattaaggaaactagcccttctgacatctctgaaaaccatagttcaggatcatgtaggcacgcaggcctttctgcctgcgtctctttgggttatatgtagatccagagatcttgagagtggcttcagagcagctaaattttatctatttctcccctttcctctctccagcttaccttgaacagccttgactataatatttttaagtagcaccaattatatacacaatctgcttatttattatcacagggtactgactcaggcctaccattaaatgtcagatgaatttattctaacttttaattgattaggacactaaatttagttcaaagtttgctattcaccacacagcgtaatctgcctaaaacggccatgtatgttgctccttttagaagtgtatctttggcccagataataatggatcaagtcatcaggaattatggtgtagtactctcttttggaggataggaagcatggtggtctgttttagaaatagccccatctgtctgctcctcatgggaagtgtctggtcactgggtgctccaagttgctcccatgagtcctaggtctggccttcggtgcctctccttccatatatggtagatagaaaagagggcaaaaaggcttattgaagtttcagttgcgtgaagtcttctatgcagatcatccagacgttggattctggatagctccctattcctaaagctcctaactgttttaaggatttgtcaggactgtgaaagttctgagatttcctcatacttgcaggctaactaggtagcctgctacagtctcagggatgctggcagaagacacataagccctgggtcagagacacaggacttaattcctcagaggaatggtagtagccaaaatgtattagtcagggttctccagagagaaaggaccaataggatggatggatggatggatggatggatgagaggagatttattagggaaattgatcatgcagttatggaggctgaggagtcccacgacaggctgtctgcaagtgggagacccagggatgctggtagcctggctcagtccaaatatgaaggcctgagaatcaggaaagaagatggtataattctcagtccaaggccaaagcctgacaacctgtggatctgctggtgcaagccccagagtccaaaggctagagaacctggagttctgctgtccaagggcaggggaagaagggagtcccagctccaagggacagcgaattcactgttcctctgacgttttgttctacctggggccctagccgggtagatggtgccacccacagtgagggcagatcttcccactcagtttacccactcacctgccagtctcctccagaaacaccctcacagacacacctagaaataatgctttaccagccatctagatgacccttcatccagtcaggttgacacctaaaattaaccatcacaccgaatatcaccatttgcaccagttcaccaagtcccatttccagagtgacaccaagcgatgctggcacatgcagtaggttgcattacaggagaggaacctggagtttaagaactccagtcctttgtaagggacagtaagcctgctgatatctgcccggagagagggagggtgacattatttctattatactggacagtaagcaagcctgccctttgccgtggagggagtactatctctgtcttccaaggccgttggctacacaaacatccctgaaaagatacgctggattttattgggttttcaaagtcaagctgggatgaggttcaatcaccattcagtttctcttctttttctttaatagaggttgtgcagataagctccttctctctggagttcactaatattattcatacatcaggaatgcttttggttttaagtgtgaagttgaaatttttttattagcacaaacagtgaaactagtttgggtctgatcagaaactgttgtgcttttccaggaaaagtgtgaaaaacgatgaacgtttacagaacttgagcaaaaggagctgaaagcagctttaaatgattttaatttgaatgcagctctgcacagcttccatcttactcaatcttaccgctcagatgggaatgggtgggttcaggtattcactaaacttgcttacgatggtcagatggattcaaatggccttgtgtggtgtgtttttaaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctgtgggtatctgaactccctgtgtcttccagggctctggcctgctgcttgtttttaataggagtttaatactttggaagtgatcatgtgatggatatacatgtgttatctctctctcttttatttttttggtgacagaaataatgagcctaataatttcatatcaacctattgctgtcctgagccaagcacagtggtggcaaaagcttatttgtgtacaatcactggcttcatacttccagagaagatctgtctcctattggaacatctctggtgagaactctttaccttttatatcgctcatcagtgctctatagaacagtatgtcgaatagtatagattttttcattttgggaggtggtatataaataaaatgtacattgaaaggaactcaaatcgcctattgcaaagaccgtacattgagtataatcctatttagtaagcatatcttctcagtcttcccttttgaaatgtcagatttaagtcttgaaggttttcctttttaagcccaacatcctttttcacatttattggtttagtactttgactttcttcgataggaaggctggatatgaaaaatctggtgaattatcctgcaacgtttcagttaactgagactctgagaacagtactcttaataggagggaaacgatccttaaacgcctgtggggttttttgttttgggttctttttgtcttaaagacctcccagaatgagggtgggaacagctgaggtttgtttcgtgtgttgtatattagttaatccttatggagttcacagtgtgacatcaggaacttatcacacacctcttgattttcaaaaattaaagctaagatctaagctttattagaatatcagaaatactacttatcctgaataaattttttaaaatgcagacattcctaactctcttttaaaactctgtttaacaactacctttttttcagtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttacttacatttacgcttgctttcagatttcttaatggtaaaaggtctgtgtgtccactcaggcttgtgtgatggtgacatttctcagatcagcatttgctggcatcctgccctgcacctgagacccatctgtgatggcagcaaggcctgctgtccagtgaatagctcatagttgatttctctctgtcaacataagcacagggttgtgggttactacgtggtacactgggccaggatgtccagggaccggggatattggtccccatctcaccccattggttgagatatattttgttcattacaactttttcagataataaaaagaaatctcatccttaccagggccagtccctgttgtaagtgctgtttatatattaccatgttagaatctcacaccaaccctttgaggaaactgaggcacagtgtgtaaatacactaccgaagttatagtggcagtggacctgagacttgatctcaggccagcctagttcctaagtgtgttctcacgctaatgcctctggatcagagagggatcagtggatactgtaaatcgttacagaacaggttgaaagaattttatttccagcagtaaggctgataaggaccagttgaaaacaactaaaactttagaatacatatgaagaaccattttttttttattatactttaagttttagggtacatgtgcacaacgtgcaggttagttacatatgtatacatgtgccatgttggtgtgctgcatccattaactcatcatttaacattaggtatatctcctaatgctctccctcccccctccccccaccccacaacaggccccggtgtgtgatgttccccttcctgtgtccatgtgttctcattgttcaattcccacctatgagtgaaaacatgcggtgtttggttttttgtctgaagaaccatttttttaatgtaaaaaacaagagctgcaaaataagagttcttaaagggaaaaaaaaatttttttttttgtaaatggaagcagaaacccaaagaagtaagtggagtactgacgccacttttccgccttagtgcatctgccaaatgccaaattgaagttttcttctcatagcctggggtgggaaggggctgcagaacagcacacaaagctcagggcctgcccaagggaggaaaactaacaggagacctcataaagtgagactccaaaaggatagatgcaatgtaggggtaaactaggaataaatccatctgcttcacccatccccccaacccctgtgaacagcaaggaagatttctgtcctgggggaaaacatcttacttgagagcctatatataaccacaggatttatatataacagcagtttttagggtggcttgtttgcaccacctggatagtcttaaaaaatctcaagagggaaatttcaagtgataacaggattttactgccttacaggtaactggcagaagcaaaacagattgtctttggaggaactcggagagtttcaaggaatgtaagttcatagaaaaaaatcacaagtgtaaaatagacaagaaccagcagaaacaaggggcagaagcaggccgttaagtctcagaaagacttaagatgttaaagttagcaagcacatccataaagtatgctttatgcttacagaaataaggagggttaaatggcatgagtataagaacaacgaagcagattgtaaaaagtgccaaacaaatctaggaatgaaaaatataattgaaattgcaaattccactggttggtttaacagcagactagacgccactgaaaatagaataatggatatgaagaaattaagatcttttcaaatttgcaaaagctgaaagactgtcacccacaggtctgcactgcaagaaaagttaaaggatgtcctttgggcagaaggaaaatgcctgccttctgaaggaaataagcactggaaatagtaacaacatgggtaaatgtagcatttattatttaaacctctttaaaaga

SEQ ID NO: 14961 - DNA, 7387 bp, Human
taagggcatttgccacagggtcaccttcaggcatggagggtggggttgagagaacaacgagagcagctgtctgttcagagcctccttccaccctccccactcctggagacacattccagcccaggcccacagcatcccaagctgggggctttgtcagcccacaggacacccaactgaccacatcctctcagtctgtggagaaggagaactcacagtcttggcaatgaagcaactcaggtgccgctggaaagccacactgagcaaaggatgaagacacatcagggctcgctctgcaggactccattcctgggaagctcaaggacaggcgacaaaggtgtctacagggccggatgggggctgccagggtggggcgggcacgagggtggctggagaggcaggaggataccgtctggggcaaggcagatgtcacaggtctggacaaagtggtaacacaagtgtatgcatttatgaaatcccccagattgggcacatactattaggcattttattgtatgtaaattctacctcatttaaggcaatttttaaaatgccacgtgagtcttccaaggagtgcacagaggaaaggagcctgaagcatggctgcctaggagagaagcaagagaggcctgtgggttcccacattcatcccgtggctgctgctccctctcctgacacccccactgcctcacaggggtctccgtgcaccttccaccggtcctcacccacagttaccgtgagactccaggtggtttcctcccttgctcacatcccctccaggagcttcctcttcctggagcaggcatgtcccaaccccacctcagggcctttgcactggctgttccccgctgcctggggctgctcaacctctccagtctcatagagaccaccctgaccagggtccagtggtctctctctagcccctgttctatttcacttccaacagagtgagtataactccctgatcctaattgttgatcgtaacctaccatcctctacacacactgtgtaggaatttactgtgcagttccacagccaccagccacatgtgccacaggacacttgaaatggggccagtccaaaatgattcctgggctaagtgtaaaaaatacacagggaatttcaaagatttacaaaaccaaaaaaaaaaaacacacataaacgatctcattaataattgttcccgttagctgaaataatattgtggctatattaggttaaataaatattttaaacattactttcacccatttattctcatcttttaaaatgcatctactagaaattttcaaatgcttgtgggttcatgtcacatctctgtgggcagcagctctgcaatgtcacctctatggctcatcatccaggttccgtcttcaagccctagacctcctggcatgggcagtaactggtgataggtttgtttattgaataatgagttatgaaaacagaagccagtgaccttttccaaaaaggttaattcccttaaatttggcaaagaaattctccatattagggtgtggacagggtcttctggaaccttctgaaataacctctctgttccagagattcagagaccgtgaccaagtgctcctggaagcctctgatatctgaagaccccgggaggccaagccctgtatttttcccctttctgagcaaacaggaagtcacattgctttcacagtcaaaggaccagtgtcacctctgtggagacctgggtgactcaagcttgggagcactggggaagagaggcatggctcagggaggctgcagtgaggactggagtggggaggagggggagatggaggaggaggcctgggaggggcagggggaacttaggcagggagggagcttgtagtggtgggggagtgaaaagagagatggagaaagaggggatgggcagaaagaggaggaggagtcaggggcagggcatggaggtgggtggggctgggctgccaaagcaggataaatgcacacctgcctgctggtctgggctccctgcctcgggctctcaccctcctctcctgcagctccagctttgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcaggtgggtgctgcctccacccgaggggtcctgagccctagcctggtttgttgccggacccccaagagcattccaaccaaatcaacactgacacattcatgatctaatgctcagattcattcagctttctctgactctccgctgatgcccttcatgcctaagcatgctcccggtccatgcactgcagacagttaaaggaagtgctgcagcttcctttaacctgcagcagctgctgtgtctgtaccatgaccgtggcatttcccagcgtccagcaggtgtggatggagactgtgctgactctgggtgggcttgatgctgctcaggatgagatccaggcggtgaggctcattctcctccctgagtcctctcctcaggggccacatgggaacctggctccctgttctgcagagcccttcttccttccccaagtcatgcccttgggcacagccccttagggctagtggccttcaccctcaggcaggctgacccacccctgcaggccaggatggctgagtccctgctggggtggagcacgcctggccctgcctctacgagctgatgcagagttagacctcagccagatgaggacagcagtcacccagcagagcagaggaggggttaggtccagagtgagcttcagcagggcaactgggcccagcttgacctgcatcccatggcagagcagcaaatagtgacacagcctttagagctcctccaccttctagaaattcaaaggaatccagaccagtcccgtttctcctcctacagctgtcagctggagccctcaccctgcacaggaggtgcactccctggtgccatggtccccgctggcctgcatctccctcttaagcatgacagtaacttggagtgaagcacagggcattgcagaccatcagacctggaagcctattttatacatgggtaaactgatactcgagggatctcagcagttcctcctggttccaaagagtccctcatcccaggtttctccacagctctgccacgtagtgtctgggagaggccctgtgcagggaaagggttcaattataatctgcaattgtaagacactcaggtgtgctgctgacttgagaaacgtatcttgaacctcacacttgaaatggtggcatctgggcggccccattgacccaaaatatctgtgtgtgtgaagcatctcatttcctactctaagtgaagtaataaatctaggttaaatggagggaataagattttcgtgagttagctgaaattttgtcatcagacagccttcctagaaaagagtcagtgttccctcacccctgagccacaggtagcagaattcaatgaatcctcttacccagcacagagaaaacgatgtttaagagcgggcatgaggctcagcaccctgccagctgacaggaagagggggcttgtgtgccttgtgttgacatgtgggcagctcacgaagcccccaagcaagtccagtgactcagccacagtgaagtgcctgtgagtgcatgaactgatgggggcgctgtccgtgcttcctgttttctcctgtgtgcagacctttgggggggtgaattacttcttcgacgtagaggtgggccgcaccatatgtaccaagtcccagcccaacttggacacctgtgccttccatgaacagccagaactgcagaaggtacgttcctgatgcgggtcccgggccagtcatgcactgcagaggggtgcgtatgtgtcagcctctgtcctacccatgtttggacggtgtgtgtgtgcaggtgggtatgtggggagccgtgtatgcatggatgtgtacgtgttcatgtacttatgggggggtgtgcatgtaggtgtgcatgtggaaaggtgcacgtgtgtacacacatgtgccagtgtgtgcgggtaggtgtatggaagcatgtgtgcctgtgtgtgggtgtgtggcggaagtatgggggtttgtacatagatccatggggatgaggggtccaagtgagtttacgtagttgcctatgtgtgtgcagatggggtggtgagggagggggtgatgtgtttgatttgctaggaaggctttagcttgggaatggttactagaaggtcaactgcctgctttggggtgttgcctgttggacaggaagaatcacctgcggggctgggtgctgggcagggagaaggggatctgtctaatcccagcctcaggcacctgcatgcagccaaagccacaatcagattagtgggacctagaggcctgttagctgggaagccctggacctgcccggctcacccaacaccagcctctccaagaacctgctggttcttgtgaggtctccactcaggggagagcggcactccccttgttgcccttgacccatgccccagctctttgagggggagttgccctgccctgggttcttccctctggcccctcttagtgctggcctgggtgctggaggtggaaggagctgggggaactgagccacctccccatgccctgcacccttggggctcccgaggccttgcccaggctactcctcacagggctgtgctgggacaggacactgcaggctggggtggggtcccaatgccacctggtgacttggagccttgggaggggcaatggaacagtcactattcattctagttcagcactctgggactcagtaggggtgggtgagggcccagtgtctcacctccatcctcctcacccaggctctgacatctcatgcctgggcatcttcccctttaactgtaacccacactgattggccctctctcttccctttcacagaaacagttgtgctctttcgagatctacgaagttccctgggagaacagaaggtccctggtgaaatccaggtgtcaagaatcctaggggtctgtgccaggccagtcacaccgaccaccacccactcccacccactgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagccctggtacatggtacacacacccccacctcctgcaattaaacagtagcatcgcctccctctgagttcttggctgtctggggatgtgcacacaggcagagtttctgcagttcctttatgaagcctccttgtcctgctggtgtggagatcacaggagtacctgggagctgatgcggccacagcaaggccatcaggggagctgctgccacttttggagacctcagcttcagaacagggagagagcagccaggggctggaaacccaagccttcagctgcagcagcccctggcgagggggtcagggagaggagggggcccaggcagctgccccagaagctgggctggtgctttggtctgaggtcctggtcagaccaggaggagggggctggttgtgtccacaggcaggggccaggcctcggtggagctcgccaggacgtagattccatctgtgcttgcagagtggagcagactccagggactgagctgctctcatcagatcccctagacactaaatagacagcgattgacgtgtagttctttccacaggagactttaggacccaacatggaaacaaagtccaaaagtgtgtgtgtgtgtgtgtgtgtgtgtgtgtgtgtgtaactgattgggaaaaatgccacccaaaccaaagatgggcaggatcacccagagaaagcagagcctgctgtcatccatcctgggagggtgtgccccaggctgggaggttgtctcctacgctaggaagctgtgccctagaagggttttacacattctcatccagccgccctttctctagacttggatttaaaaccagcactcaggtcaggtttcttggtagggatggagaagctaaaacacaaatggaagtgacatgcagtggacactcgatttttttcacaaaggatgttttaattaataaataacatcaccttagtgtcaaaaccattctgtagaatagtgggtagttgcactccaaagaagaggctacagtcctaagacccagcccaccctgcatggcctttcccattgccatttcagggcagaggggtgcagccctcagggcaggtgcctgtgggaagggctctcaactatcttccatgccaagagctgtgttgaccaagagtggctgccatgaacaccgagggggaaatgacaaaggggaaactgcccaaacagccctgaggccagcaccccatgtgccgcacatagaaagccaggaggagaatgatctggtagggatagtggggagcacctccttcatttcccctccacccccacgggatttaaccaaggttttgggttgaaaaaagtgaagcagcgcccaggaggccatgagctgaggagaattgagtctgggtctcacccggtgtaggggggtcggggggtgcacacactgattcaggcttctgttggaaaagaggggctgagagcagaacagcatgtgcccaggaatcgtggttaggggcaaagtcttccctgcatggagatcctcatggttctctacctggtggagggtctgtcttgacataagcaaccaccatccaaggacacaaggaaaaggtgattttctgtaaaccagtaacttttctgacttctctcttcctggggaagtggaggggaaagtctggctctgtagagggctccctccaccatctccctgtgtgtctgttccctaggtggggagcaggggacagcgaagcttgaaggtgagcatgtgggtctttgtcttctgcaccaagctgaggatctgggctctctctggaagctaccgggttttgggagtaaaaaagtctcctaagggtcatgttttggaaatattgcaccccttctaagagttcctttagcaaaaataatgtcacatattcttgctaaaagtgtaaaaccacagaggttagaaattccaccttcagcatagacaaatcactctggaaggagagataaatccaatggaggcctgggaagcaggaacaagtgcggtcattccttgggcaggtggattctcagcactatgaccacagacaacccaggttccgtgaggtctgaggcttacataattca

SEQ ID NO: 14962 - DNA, 4732 bp, Human
catttcatggagatgcaataggagaaaagccagagaggagtagtctagaaatggaagcttcattaaaagagagagagcaatacagaatgaggagttctaggactcacatatcaggcaccttcttccatgatcatgtgagttacatgaatcagtggatccccacattgcttcggatgtaagaactccgtagaaagcagtgagaacagtgaccgtgatgctgataactgtatcataagctttttgggacagagaccacatcatatagtgtttgcattctctgtggtccacgaagcctcttctgtaagagcactcatcctgttcatgaggactccacctttatgacctaatcacctttgggaggtgcaagataaatagaaatttatcacctccacacctacaatacaatcacattagggattaggtgtcaacatgtgaattttatttattttttttttttagacacagtcttgctctgttgtccaggctagagtgcagtggcactatctctgctcactgcaaccttcatctcccggagtcaagtgattctcctgcctcagcctcccgagtagctgggattacaggcgtgcaccaccacgctgggcgaatttttgtattttcagtagagccagggtttcaccatgttggccaggctggttttgaactcctgacctcagatgatctgcctgccttggcctcccaaagtgctgggattacaggtgtgagccactgtgcccagcttcgacatgtgaattttgaggggacttaaacattcaatctacagaagaaactaaatatccccactcctctgagggcaagaggaagaaaggctttggtctgcctcctgctctgtccacaagcctgggtccaggcggctgggaaaggaaccctgaggactttcctaactagtcacttgaagtccacttcatcaataacgatgccccagctaccttgggagaaatggcctctcgcccagcagggatgcagaatgagaactttcacaagaatgttgactgaaggaggtaatcaatactcttgcagttatttcaaacacaaaagcctatgaaggcaactcaattactctcacgcctccttttctgacttactttcagaaccttgtcaaaggctagtagtgttgggtgcctttttttttttttattcatttacttacactattcaagcatgctcttttcctggtagaattttttctgctttctggataaagacacccagtgtccaaaaagtgaacagcatgggaatatggagacttatcagatggaactttgacctccaaagaggctttgctgcatcttttcttccttccttgtctgttttgtcatttcctattttttttttttttttttttagacagagtcttgctctgtcacccaggctggagtgcagtggcaagatcttggctcacggcaacctccacctcctgggttcaagtgattctcctccctctgtctacagagtagctgggattacaggtgcccaccaccacgcccagctaatttttttttttttttttaaagtagagacggggtttcaccatgttggccaggctggtctacaactcctggcttccagtgatccacccacctcggcatcccaaagtgctgagattacaggcatgagccaccatgcctggcctattttgtcatttcttattttcatttatttggttctttttatctggcagtgttgtaggagttattaagaaattattgactgggtgcggtggctcacagcctataatccctgctctttgggaggccgaggcaggtggatcactggaggtcaggagttccagaccagcctgaccaacaaggtgaaaccccatctctactgaaaaatacaaaattagctgagcatggtggcaggcacctttagtcacagctattcgggaggctgagacagcagaattgcttgaacccgagaggtggaggttgcagtgagccgagattgtgccactgcactccagccttggtgatggagccagacagacgctgctgccgaggaaaaccttgtattattaggcatggtcaaccccaccgtgttcttcgacattgccatcgacggcgagcccttgggccgcgtctccttttagctgtttgcagacaagttcccaaagacagcagaaaattttcgtgctctgagcactggagagaaaggatttagttataagggttcctgctttcacagaattattctagggtttatgtatcagggtcgtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattatggaggccatggagcgctttgggtccaggaatggcaagaccagcaagaagatcaccattgctgactgtggacaactcgaataagtttgacttgtgttttatcttaaccaccagaccattccttctgtagttcaggagaacacccttccaccccatttgctcgcagtatcctagaatctttgtgctcttgctgcagttccatgttttccttgttccctcccatgcctagctggattgcagagttaagtttatgattatgaaataaaaaccaaataacaaaaaaacaagaaaagaaattattttagtcagatagagacaaaaggggtcctttggaagttttcgttttttaaagcatctctggaaaagtttcttgtaaagccccagctcttagagccaggctggcaacctttgataagcaaatgatggccattagaaactgggtccacccaaacatggccattcctgcagccttcttgcccttgccccacatgttcctggcaatatggccgcccccgcatatccccacatgtgtagaacatcatggcaccctgtatttgcatattaaaaagctagggtgggagagccagctttttcacgggctacgtgaatgacatgcctggccaaaccaatcccctgagccctatgtaaatcagacaccacctcctccagcctctgtatatatacctggctggtatccgtggcaggtggggtttcctcttttggctttagaggcccccctccctctgtctctgtatgggggtcttccttctgtcttctcccttccttcttgcctattaaactctccagtcattaaaactactccacgtgtgtccctgccgttttttctaattcaacttgagacgaagaacctggtgttccttcactcattggagctgtatcagcagctccacttaacttaaatctcagagctaaaaatgttgccttaaagaaatttttttaaagaacaggtttagagaaattagtggtctcaaaactggagtagggacttaatttttgtcaagttagggttgtaggagaaaccaggaaaagtattactgttctctctacagctaagacagagatttaggggggtatgctgaggcacaccacttccctaaatttagtaacttgctagagagctccaagactcaataggaaattatactcatggctcagatttattacagccaatgatacagaataaaagcaagcaggaaatagacatgcaatggaggagtccagagaggtctcacacaggcttcggatgtccttccctgtccgagaccacaggagtgctttctttttctggcagcaaaactacactacaggaacgtgtgtggaatatctctatccagggaaacccactggagtatcagggtgcaaggtttactgggagaggatggtcacatacgcatattctcttagcaaccagccatggcaaccaaaattgagaacccaacacagaatctaggtgcccatcctcaatcttgattttttttttttttttttttgagacagagtctcactccgtcacccaggctaaagtgcagtggtgtgatctcggctcactgcaacctctgcctcctgggttcaagtgcttctcctgcctcagcctcccgagtagctgagattacaggcgcatgacacaccaggctaatttttgtatttttcttagtagagatggggtttcaccatgttggccatgctggtctctatccctgacctcaagtgatcctccagcctcagcctctgcctcccaaagtgctgggatcacaggtgtgaatcgccacgcccggccactcatttctgatgtttgtgtgaagaaatttcaccatctgatctggcacagtccattgctcctggtgtgtatgagaaaatcaccaatcactaactatcacaaagaacattccaagggccacattcccagagttggccaatggtcaatcatggtaccctgatatatgcaaggagtaggctaccagatctgcttgttaactctttcctcccaggagggcactagtaactccaactggtggcaccaggaagtcaggagctgaaaatatacaactatgacccaggttggtcaattaggttctcctataaaattgactgtccatcaactatcaacagaaatactaattcatcactaatttaaattcattaacagatatgacattccaaacaaaattaaaagaaggaaatatatttacgcacaataaagtatcgtcctcatcctagaggaaatataaatgaaaggcatttgaaaatgataagcattag

SEQ ID NO: 14963 - DNA, 6141 bp, Human
attcaccctcaatttaaacaatagagaaaccacattcataaatgtaggggaaaatacaaataacaagctcactgcaacctctgcctcctgggttcaagcgattctcctgcctctgcctcccgagtagctgggattacaggtgcctgccaccacacccagctaatttttgtatttttagtagagacgcagttttgccatgttggccaggctggttctcgaactcctgacctcaggtgatccacctgcctcggcatctcaaagtcctgggattacaggtgtgagccaccacgcctgaccaattagtgatattttaatcagtttctactatcttctaggccccttccttctattcttattaaattctcacaataataataatgtcactagactagtgttatgagaatgttgatagattattctgctgccactactagtttatatgatacttaatagcattgcttcccttctatttctatttaggaggtgaagaatctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagaatcttttaagaaagtggaaagctgctatatttaaatttgtattgcaaaacatttgtgatacagtatttgtaaaattgaggtaaaaaaatttctcaaagtctattttttcatctcgttcttttaataaaggaactatagctgaaaaaaaaaggaataagataaattccctgaagtggaaattgtgggacagaataaatttttgtccagttttgttttgatggaaggtgcatttggaaacagactacattcatttttttaagacaatacaaaaggctgacaaagactcagagcaacttaactgtcatacattgccctggcagggattcaaatggcaaaatgaccttggaaaacaatttggcagtttttataaacaacataaagatagcacttaacccacaatcccactcctaggtattttacctaagagatttgaagacttcataagtttgcataaaaatgtgtacatgaatgttcatagtatcattgttcataatagacaaaagtagaaaaagcccaaatgtctatcaattgatgaatggataaatatatggtattgtaagccatacaatgaaatattaatattattcagccttaagaaggaattaagtgactgatgtatgatacaatgcagatgaacctaaaaaatattaagctaagtgaaagaaaccagaaaaaaacaaaggaatatttcctatgtaattccacttttataacattgtggaaaatataaaactatagagataaaaaatcagattagaggttgccagagactggcgggagggagaaggggattgactacaagagcacaactgggctctaccagtgatagaaatgtttatgcctctgtgatggtcatggttgccaattgtattcatttttcagttatcgaactgaacacctaaaaacaatcagactgacagtaggtaaagtatatcccagtaaccaaagttgagggggcagaaatggaccacatttaagaccagatctgagttgaagaggctgctgaaacactgagagaataccatcagaaacaacaggaaacacttaaaaatagctaagagagcaactgttcacatttggctatttcccttgccctctgtgcaaactttctggttttaaaaataaaataagtaggttcagcggacgcgcgcggcctcgatctctggactcgtcacctgcccctccccctcccgccgccgtcacccaggaaaccggccgcaatcgccggccgacctgaagctggtttcgtggcagcctcaaagaaggcagttttggggccattggtgggggcggtggaccagggcaccagttcgacgagctttttggttttcaattcaaaaacagctgaactacttagtcatcatcaagtagaaataaaacaagagtccccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacacagtctaccgttgagagtcttagtaaaagaattccaggaaataataactttgtcaagtccaagacaggccttccacttagcacttacttcagtgcagtgaaacttcgctggctccttgacaatgtgagaaaagttcaaaaggccgttgaagaaaaacgagctctttttgggactattgattcatggcttatttggagtttgacaggaggcgtcaatggaggtgtccactgtacagatgtaacaaatgcaagtaggactatgcttttcaacattcattctttggaatgggataaacaactctgtgaattttttggaattccaatggaaattcttccacatgttcggagttcttctgagatctatggcctaatgaaagctggggccttggaaggtgtgccaatatctgggtgtttaggggaccagtctgctgcactggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccggtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggttgatggaggaatgaccagcaacaaaattcttatgcagctacaagcagacattctgtatattccagtagtgaagcccttgatgcccgaaaccactgcactgggtgctgctatggcggcaggggctgcagaaggagtcggcgtatggagtcttgaacccgaggatttgtccgccgtcacgatggagcggtttgaacctcagattaatgctgaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaaatcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtgttttttttttttttaaacatccacagttaaggttgggccagctacctttggggctgaccccctccattgccataacatcctgctccattccctctaagatgtaggaagaattcggatccttaccattggaatcttccatcgaacatactcaaacactattggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaggatactttcttttttcttccatctttcctttttatattttttactttgtatgtataacatatatgcctatatattttatacactgagggtagcccatttataaattaagagcacattatattcagaaggttctaacagggctggtcttaagtgaaccactatgtatataaatatgttggaaaacagctgtatacatttttgggcaatggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattgtagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattatctctgcttagtgtcttattataactgaaagaaggtttatcattacaaatgccttccaatgaaaccaagaatttctcaaaatatttaatgtcacatattataagaagttacctaatcctgcttcttaacgtcaatttttaaaaatatcttaaaattactttgttttgcagtaaacagtgaagaaaagattgcctcctaattatttttttcaacaagtgctgaataggaaaacatttatatcttactataaaaggttctgttttgtttggaattaatggtagctttattgactgttctgattgtgctgtttctgaattattgaatctgctaggttttattcatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaactgcaagatttataaatgtttgaaattgtacacattgatatttaatgacaaatttacttaaaataaattgaccccttgttcttaaaaaataaataaataaaaataaaaaaataaaataaaataaaataagtatattgtaaaaaaatcttaatgataatgactaaaagaatagtaacttaatgtataatttgctgaagagtagaattaaaccaaggatttgagaggagaaaaaagcctgaaagaatttgaaaactgccagaaaaacagaaaaaaagtagggcatagaaaaggtagaaaaatagaaagcacaaaataaaatggtaaaagtaaatccaaatgtataggaaatcatattaagtataaactaactcagtcagtttttaaaaagacaatatctgattgatttttttaagttcagttatacgcaatttacaagagacaccactaaaatgaaatgacacagaaggggaaaacaattctagatacactgagttaacaagatttatagctaaaatatgacagcatagaaattttgaaagtaaagggacagcaaaagacataccagcaaaatactgaacaaaagaaacttagcgtagctatattactatcaggaaaaaaacagtctttaaggcaaaaagcattattaa

SEQ ID NO: 14964 - DNA, 24221 bp, Human
  misc_feature (1)...(24221): n = A,T,C or G
ccagcctggccaacatggtgaaaccctgtctctactaaatatacaaaaaaaaaatttagccgggtgtggtggcaggtacctgtaatgccagctactcaggaggctgagataggagaatcacttgaacccgggcagcagaggttgcagtgagctgagatgcgtgccattgcactccagcctggggtcaacaagagcaaaactctgtctcaaaacaaaacaaaacaaaagtgtgggccctaatacccaaaatgcagggctctacaaatacatcccaaatacatggaaaataagattagaaataaagtcttggttcattgtaagaacataaaattgaaaaacaaataatgaaaacaataaaaaataataaaataaaaacttgggatccagcaatcccacgtctagatgtatatcctaaaaacttgagatcagtgtgtcaaagagatatccgcacacacatgttcactgcagcattacaatagctaagttatgaaatcaatctaggtatccaacaagtgaatggataaatatgtggtatgtgtacccagctgaatactattcagcctttaaaaagaaggaaattctgtcatttgcaacaacgtggatgaatctggaggatattatattaagtgaaataagccaggcagaaaaagacaaaaatcacatattctcacttatatgtggaatctaaaataattgaactcatagaagcagagagtagtgttggttattacaggctggagtagcgggaggggcattgaggagatgttgatcaaagaacagaaaatttcagttaggctggtccaatagtagtgggatattatcacaacttattaacattaatgccactaaagttggtatacaatctcccacttccaaatttggcttttaaaattaaaaaaaatgaaagttgcagttagggggaataactgataagtatttaaggtgatggatgtgctcattagattgattcagtcatttcacactatatcataacatcattgtgtaccccataattatatatgattataatttgtcaaaaaaagattaacttggaagaaagtattcacttcaccaaaggtatatatatatattttaaataaaaagatccatcttaggagttcttttaaatagcttttgggggcattcgaagtaagtggtgattgtgaggattatatgaaatgatagacctaatgcactcaatgtagtactgggcatacagaatgcacacaataaagggtagtaatgaatgaaagggtagtaacgaataaatcaaatcagattttatgttctccataaaactccatctcaaaaagaaaaaaaaaagagactccgtctcaaaaaaaaaaaaaagaactggattccatgctgggcgcggtggctcaggcctgtaatcccagcactttgggaggctgaggtgggcggatcacttggggtcaggagcttaagaccagcctagccgacatggtgaaatcctgtctctactaaaaaatacaaaaattagccaggtgtggtggtgcatgcctgtagtcccaactacttgggagactgaggcaggagaatggcttgaacctgggaggcggaggttgcagtgagccgagatcgcaccactgcactccagcctgggcgacagagcgagactctgtcttgaaaaaaaaaaaaaagaactggactcctaacttttccccagggtagctcaaagctgttgttgctggctctagagtcataaaaaactgcctggtctcccatggactgcttaatttctactaatccattaatgtaggtgaaatattgaaaatcaagcccttgtttacttcaaatcatcacagaacatttatgcaagtggtttctaggcgaatttcagcttttggtttgcattcttccctacagaggttagtttgcttaggtagccaccaacgtgttgttgaattgtagtcttttacctgagagtctaagaatatgattaagaagacgaaatcatgtttcataacagctcttatttcatttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggtaagaacttgtatctcagaacaaatatcttcataattatagtttaattataattatagttctacttggattctgacatttctatttcaggtaggctataaaaactcagaacatttgtttcccaggaatcatgttctgttaagcagtcctatcatagcgtgtacttttttggcagcattttttcctcctgtacaataccacctatcatgcaggttgatttcctggcaaaacagctgtgacaatgatggacccattcacttaccaccaatactaacagcctgttccctggacagccaagatacggctcctctgaaatcctttctgtcacctcaaaaggggcagtgagaagggccagcattattcaccaccatgcaagacttttaaagctcatctcaacaagtatttggctctcttcccccacactgatacctgtattcaagcaattacttagtctaggcagctatattaaggatggggttcagaaacctatttccctaattagggttacttaatataccaagcaaactgcaactaggtaagcctttctttagcaactacaacagaagggtagcagtgagaggcaggattgtagagctaggagaaagcattaactgtagctactaagagacaattatgagtttagagtcagcttcatcctaacttgacttatacagtgcacagtatctcatggtacatggtcttgttagtaacatttgggaggtgtaaagttttatttaagggagggctttctttgatatatctattctgttagctgccaagtagatgtttagttcttctgatttttcaatttacctcctttttaggaacatgcttgtactgtcaggaacctagcacgttctcaaagtgtcaagatgaaggataaactaaaaattgacttattgcgtaagtagttaatatccattcactatacattgaacaataatttattaagggattgctatgtgccatacactgtacttggtactaaggatgtgaaaaatgatagaatatggtctctgacttgatggactcatgctttagagaggcttaagtcctcttcttttaagaggaaaggaagtaggaatattgcaccttgagttgagtgattatcatagtgtgtttaaggaaacttgggggtcaactgtggggtttttatactgctggtagcctcccatatataaactttatgatttctgaacatccaagggaatgacaaatggatatgccattctttgtttataaaggtgacatgtatttctttctttctttctttctttctttctttttttttttttttgagatggagtctcgctctgtcgcccaggctggagtgcagtggcgcaatcttggttcactgcaacctctacctcctgggttcaagtgattcttctgcctcagcctcccaagtagctgggattacaggcacatgccaccatgcccggctaagttttgtatttttagtagagacgtggtttcaccatgttggtcaggctagtctcaaactcctgaccttgtgatccgcctgccttggcctcccaaagtgctgggattacaggcgtgagccaccgtgcctggccagtgacatatatttttcttttaaataatatttgttatattggcaaattgtacatccaataaagtggttaatatccaaatatataaggaactcaaacaactcaatagcaagaaaacaaataacctgattttaaaatgggcaaaggatctgaacagatatttctcaaaagaagacatacaagtagccaaaaggttcatgaaaaaatgctcagcatcactaatcattaggggaatgcaaattaaaacaacagcgagatatcacctcatacctgttagaatggcttttattaaaaaaaaaaaaagaacaataacaactgttaatgaggatgaggagaaaagggaaactttgtaccctattggtggtaatgtaaattaatacagccttttttttttttttttttttttgagatggagtcttgctgtgtcacccaggctggagtgcagtggcgcgatcttggctcactggaacctccacctcctgggttcaagcaattctcctgcctcagccttccgagtagctgggactacaggcatgcgccaccacacctggctaatttttttgtatttttggtagagatggggtttcaccatgttgaccaggctggtcttgaactcctgacctcgagtgatccacccacctcagcctcccaaagtgctgggattacaggcgtgagctactgtgcctggcctacagccattattttttttaaatggtatggaggttcctcagaaaactaaaaatagaacaaccatgtgatccagcaaccccacttctgtgaatatattcacagaaggaattgatatcaacatgttgaaggcatatctctctgcactcccatattcattgtagcattattcacaatagccaagatatggaatcaacctaagtgtaaatgtgatacgtatacacaatgctatactactcagccttttaaaaagaacaaaattctgtcatttgggacaccatggatgaatctagaggccatttgcaccaagagcatgtgtaaataaataagtaaataagtaaataaataaataaatgtttccacacaagtttatctgcctaaaaaacacacaaccaaaaataaataaattttgctagtttttttttttaatacagagaagcatataaaggagaaaacaaaaagtggctcataatctcaccagttagttaacacttactgacattttttaaaaaagataatataagttcatagttagaaaattcaaataaaacaggctgggtgtgatggctcatgcctgtaatcccagctctttgggaggctgaggcgggcggatcacttgaggtcaggagttccagaccagcctggccaacatggcgaaaccccgtctctactaaaaatgcaaaaattagccgggcatggtggtgcacacctgtaatcctagctatttgggaggctgaggcatgataattgcttgaacccagggggcggagattgcagtgagcagagattatgccactgcactccagcctgggtgacagagtgagactccttctcaaagaaaaataaaaaaatcaaatgaaaaagaaaagttcgaaaggagaaataaaactcttcttccttatggtgccccaacctcaataccacagataactgatactgtttcttgttacttccttattgacaaaactcttatgcataatactagaattgaagcaatctctctatttttagagttaattcacacaaaatgataaacattgttttgtatctttcttttttcacataatactagaagattatacctgaatcctcttgtgtcaaaagacatttatgtttgggacatctgagcagcaatattcagagtttagtatatggctgttgtatagaattttatctttatgaagctaattagagatttaacttgagatttattagcaccattctagggtcagtcaacccttccctcacccagccctttgaaaacacacatgtacaatgacacgattgaatgcttctaaaaaaaaaaaaaaaggaattggttttaatgaatggaatttgcttttcaggatgagaatgaaacatttattacttcacctatatttagttcacatccattaacaagaaacttagctacttttgcacaagtgacgtaaactaggaaaaaagagctccatatactttccatttcttttctttaggaagctattaattgtgtacacaattctagcattatgagagatagtaggtttcttggaaagactaatctgtcccacataagtcttcattattcaaaccttaggaagtttaagagttcactgggaagatatcaactttaatctttacttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaaggttagttacatgctatttgtgtgtctgccgggccgattagaagaggatcatgggccagaagaaaagagaaaaagtcagttgggaattaatttttaattcatttatatgttcaataaacatttattgaatgtgaactaaatgccaggcactgtatgctagcagtagggaatatagcagtgaataaaaagacctgatccttgaggttataggctagtcatttggggtctggaagaatcatacatttgaaacttctgttaatgctttcagttttctattgcaagatctagttttaaagtgaacccatccagaacctgaaaattgggaattgtggttatattcctaatgttatttcaggcttgtagaatcttgggcaaactacaggagtattgtggcttggcttcttcttttgtttaaaattaaacatgttattttgaaataattgtaaattcatatacagttgtaagaaataaaagagagatatcgtgtaccctttcgccattttccccattttgcaaaactatagtacaataccacaaacaggtaattgacatgattagaattctgcaatcttattccaatttctccagttttacttgtactcgtgtatttttgtgcatgtgtttagttctatgcagttttatcccatgtgtaagttcatgtatctgtctacacagtcaaaatacaaaacagtttcatcacaaggatccctcattttgcttttatataaccatgcccacttcccttccacctcacaccccagtctctgacacttggtaatcactaatctgatctctatctctgtaattttgtcatttcaaaaatttaatattaatggaattatatagtatataacatcagagactagcttattttttcattcagcataattcacttaagatccatataagtttttgtagcatcaatagtttattttttattgctgagtagtattccatggtatgaatgtaccacattacataactgttctccctttgaaggacatctgggttgtttacaggttttgactattataaataaagctgtgaacaggtttttgtgtgaatataagtattcatttctttggaataaatgtccaggagtataattgctgggtcatatggtagtcacatgtttagttttgtaagaaatgacctgttttccagagtgactgtaccattttatattcctgccaataatgtatgaatgatccagtttctccacctcctcaccagcattaggtgttgtcactatttttcattttagccattctgataggtgcatagtgatcccattgtagtattaatttacatttccctgatggttaacggggttgagcatctcatgtgccatctattccacttcagcgaaatgtctgctcatgccttttgcctattttctaaattgattttttattattgaattttgagagttctttttatattttaaatactaccagtgttttatcagatatgtagtttgcaaatatattctcccagtctgtagcttgtctttccatcctcttcgtagggtctttcagagagcaaaagtttttagttttgatgaagtacaatatattgatttttttgaaaacgatcttgctttttatagtaaatctaagaactctttgcctagcccagatcctgaagattttctcctgctttttttttttttttacatctttttaagcctgatgcccattttcgacttaatttttgtaaaagctatgaggtttagttcaaggttttttttttgttgttgttgttgttttgtttttgtttgtttgtttgtttttgcttttcttgccaaaggatgtctaattgctctcgcactatttgttgaaaaggctattcttcctctgttgtattgcttttgcacctttgtgaaatatcagttgggcttggttttatgggtctgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacgatctctgctcactgcagtctctgcctcccgggttcaagcgactctcatgcctcagcctcccaagtagccaggattacaggcatgggccaccatgcccggctaatttttgtatttttagtagagacgggtttcaccatgttggccaggctggtctcgaactcctgacctcacgtgatccgcccgccttggcctcccaaagtgctgagattacaggcatgagccaccacgcctggccaaaagcctgtatcttttaatataaattttagaataagcttgtctatagctatagaaaaccttgctagaattttggcaggaattacattaaacttgtagatcaatttggggagaactgacatttttactatattgagtcttccaatccatgaacacagttgccttggcttttatactctgtaaatcaacatttattgagtgcctactaaatgtaaaactaagttaaggatagttgtagagctctttaagctttactgaaatataggtatcataatataacttgtttattgtgttttatttcataggtccctgatgtcaaagaaatggaaaaaagcagctttactgaggtagagcaatcataatataacttcatttttacccttaatgtgttttatttaatagctcattagtttcaaatgaatcaaataaaccacagaagctacttttgagccttccttctcacctctaaccctcatcctaaacacatacactgggtttgattcactaaaaaatgaattcattgtttgatgtttgataactgctagaggaaaagatacaatttggccagtgaccccgtgtattctaatctgctctttttattctgatatttatttcaaaagccattccttgggagccagagctcacttttaacagcagttgtttgcaattgcttattccccatcaaaatcctaatttctatttgtggcacaacaaattggttgctgtggagataattatgtaaaactggattcaagggagaacatgcagctaagatccagtttttataggaacgtctctaataataaagatgtggggaagtgaaatctgggaatttggatctttaaaccaaattatttctaaataactaataaggaattatagttctttgccaatataaatcaggagaaataatttataactgagacctaagggttgcacctctgagagagggctttaccatagagctgcagattgaaaagattaaatgtctcaagtaatttgtttaattaggaaaaaagtaagtttactgtacaaaattctagaccctggctaaagattcctttataaatagcactacttaaagtagaaatttggttggatcagaatttaaagaggcctaacatttgaattcgttggtacgtaggagggcactcctgcaacacacagggtgttaaatgacagtattggtatccccctctaatccccaactttgcttcagtacattgaatctccagacgtggaaaatgaagtaaagagactgctgcgttcggatgctgaagccgtaagtacccgtatcctttatacaaatattttctgcatagtctgttctgccccatttgtacatgctgacgaagcctcacctctggtgtttgtgtgccagtcttgatgtgtggaacttaagattctttgaaatgttctagctaggaacagtaaattcatgtaatagaaaattatttattgtgtaattcaatatgaggcacttctccaaactaggaattccaatacaaatggcctaaagttggactaaattaaatagcactgttagccaaagagccccttccctttcagctgtgcctttttgtttccttctgtgttttccttgactacccactcctttcaggttgggaagtcattgctgaagatggaaccaaggaaatagaaagtcaaggctccatcccaggatttttgatatcctcgggaatgagcagccacaagcagggtcatacctcgtcaggtactttagtaaaggcaaagcaggagtttcagatagggcaggtattgactgggtatcagatcattttccataaattcataggccaatccaaaaaaaaaaaaacccagaaaaaaaggatggtttcgtccttccctctttttttttttttttttttgagatggagtcttgctctgtcgcccaggctggagtgcagtggcgtgatctcggctcactacaacctctgcctcatgagttcaagtgattctcctgcctcggcctcccaggtagctgggattacaggtgttcaccaccatgcccagctaattttttactagcgtcggggtttcaccatgttggccaggctggtcttgaattccagacctcaagtgatctgcctgcctcggcctcccaaagtgcttgaattacaggcatgagccactgtgcctggcctttttttttttttttttttttttttgagacagagtctcgctctgtcgcccaaactggagtgtagtggtgcgatctcggctcactgcaacctctgcctcccaggttcaagtagttcttgtgcctcagcctcccaagtagctgggattacaggcatgtaccaccacaccaagctaatttttcttttttcttttcttttttttttttttgtaagtagagatggggttttgccatgttggccaggctggtctccaactcctggcttcaagtgttctgcccgcgttggcctcccaaagtgctgggattacaggcatgagccaccacacccagcccttcttccctcttattggtctcttggcagtttaggggttttagattagtgttctaatctcccatccacccctggtattttaacttcctatgacccttagagtctctaaatatcttgatcattcactacatgaatgaatgttacagtgttttgcatttgctgtccttgttttataaagggaataatcttcctgcatgaaaaaatgatttataaaattcactggttgcctggggaatgtgaaaggagtataattatatctggagtatgagtcatttgcagagttttagatagttcaccttcttcttgcttaaaactagtagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaataggtaagtcagaaaaaacaaagggatgggaccagggtgggtggcagtgctaacagttgactctaagcatacattagactcaaagctaagctcaagaagttatcgcttcgatgtgtagtagagttttacttgatttggatcttggtccattcatttaggctatatttaatatataaagttctatgtttctctattagtcatggaaattcagaagcagattgagaaaaaggagaaaaagctccataagattcagaataaagcacaaagacagaaggatctcatcatgaaagtggaaaacctgacactcaaggtaaattcttggctggcataaagaaatcctgatatcttactttcagtatcttgcctttgtgtttccacttatgttatctctgtgcagggttcttgttcattcatgaacctaaacagcctcttagaaactcctaataaaagataaccctgtttccttttacctgagtaattttgatcatctaatataagcattttggggaagggactaggtgatatgagataaaaattgccaatattgagcatttgctatgtaaaaggcacataaagggctaagaattgtgtacacatattatcacattttatcctcacatccttgaaacgtaaatactgtcaccactcccattttatagataaagaatggaaactcaaagaggttaagtaacttgccagggatcacagtaaatgatccctgagtaagggatcttttagtagagatgaaacctcatctctactaaaaatacaaaaattaaccaggcctggtggcatgctcctgtaatcccagctacccaggaggctgagacatgagaatcacttgagcctgggaggcggaggttgcatgagccaagattgcgccactgcactccagcctgggtgacagaggaagattccgcctcaaaaacaaaaacaaaaacaattatttgccaaactccttgcctcccttggtttttttttttttctttgagactcagtgttcatcatttatacaatttatttttcagaatcattttcagtctgtgctggagcagcttgagttacaggaaaaacaaaaaaatgagaaggtaagaagtatgttttcaaattaaccagaaaacatttgatacagagaatcccccacttcaattccaatatcattgctggctgttcctctcataggaatagtggtagccaaatcttctaaatgaaggtagcagggtggaacaaggtctttgtgaaaattcactcattcaacagatattgaatgcctatgaagtgaaaagcactggatgtacggtgttgaataagacaaatgcaatacagtaaatcctcagtgtcattgataggttcttggaaactgtaactttaagcaaaataatgtatatataatgaaaccaattttactataggctaattgatataaagaagaattaagttcctatagcatatttctggtcacaaaaacatcaccaaacttctaaataaaaaccaaaacgcttctaataattaaacgttgaaataaatgtgagctatacatacatttgagaaagactgataaaaacaagtaagacaattatgtacccagtgattccagttcagggtctcagatggccagagcctatcccagcagctcagggcacaaggtaggaaccagccttggataggatggcatcccattgcagggcacactcacacccacactcacacccacactcactcagactgggacaattcagacaaaccaattcacctaatgtgtacagggaagtgattttatttttctcatcaacattataatgaggccaggagtggtggctcatgcatgtaaccccagtattttgggaggccgacgcgagaggattgctttagctcaggagtttgagaccaatctgagcaacatggtgaaacgctgactgtacaaaaaattagccggttgtggtggcataagcctgtagtctcagctactcaggacgctaaggtgggaggattgcttgagcccaggaggttgaggctgcagtgagccatgatcacaccactgcactccagcttgggcaacaaagtgagcccctgtctcaaaaaaaaaaaaaattataatgaaatgacattgaactaacaatgttatttggagaccttttgcatgtcattttgcttaaagttgcagtttctaagaacctattgatgacattaagtgaggacttactgtaacaaaacgacattggacaaaacgatgttattcaaggacctgctgtacttatcctcgtggagctgtctagcaggggagattgacaataaacaaattatacaaatataaagttacaaattgtgaagaagtgctatgaaggaaaaaagtcagtggtgctattagaataaagggtcttgaattaattgggggatcatgatagacctctcctaggaggtgctattgaagctgagaccggaaggattaagtccaggcaaagagtgggatgaggagcctcttaggtggagcgtatgcaaggtctcatgctcagaaagaacttggcttctttgaggacctttggagtatttaaagccaggaagagaatggcttaagataaggttggagaagtaggcagagaccatagtgtatggttccttgaaggccatgataaggaggatgggtttggccttaagtgtaatgtgaagtccttgaagaattgtagataggaaaatcacatctaatttaaacttttttttttttaaatggagtcttgctctgtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgccaaaggatgtctaattgctctcgcactatttgttgaaaaggctattcttcctctgttgtattgcttttgcacctttgtgaaatatcagttgggcttggttttatgggtctgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacaatctaggctcactgcaacatccgcctctcgggttcaagagattgtcctccctcagcctcccaagtaactgggactacaggcacgtgccaccatgcccggctaattttttgtatttttagtagagacagggtttcaccgtgttagcgaggatggtcttgatctcctgacctcgtgatccacctgccttggcctcccaaagtgctgggattacaggcgtgagccaccacgtctggcctaatttaaacttttaaaaggttactctgattattatctggagaatgggttggaagaaggtgagagtagaagcaaagaggctggttggggggctttgtggtactctaataacagaggatggtaacttggactaagttagtagcaatggagattgaaagaatatagatttttaaactgcaataaaaatgtttttataacagatgtaattcataaaccatacaatatcacccatttaggctgggtgcggtggtgcgtgcctgtaatcctagcgctttgggaggccaaagtgggcagatggcttcagcccaggagttcgagaccagcctgggcaacatggtgaaaccccgtctctccaaaaattagccaggcatggtggtgtatgcctgtagtcccagctgctcgggaggctgaggtgggaggattgcttgagcctgggaggcagaggttgcagtgagcagagatcccaccactgcactccagcctgggtgacagagtgagactgcctcaaaccccgtcctccccacccccgacaagtcacccatttaaactatacaattcagtggcttttagcatattcagagttgtacaaccaccactgcagtcaattttagaatagtttcatcactccaaaaagaaaccctgtatccattagtagtcactccccacttctccagaacctctcccctgcccagcactaggcaaccactcatctagtttctactaatctactgcctattctagttatttcatacaagtgaaatcatataatacatggtgttttgagtcgggctcctctcatttagcatattttcagggttcatccatgttatggcatgtatcagtacttttttccatttaaaactgactaatactccattggatcaatataccacattttgtttattcattcatctgctgatggacatttgggttgctttcacttttggctattatgaataatgctgcaatgaatattgatatattagagaatatactttaaaggtagaattgacaggagttgggtcaattactgggtgttgaaggagaaggaatcattaaggatgtatgtatttctaacttgaacgacaactgtatttttcaaagccacaagagagtgtacagggcgaagagagaagaaggcaatataggctaaatgagggtcaagcagctgtatagaaaatgtgtgctgactctaaccttatactgttgagggttacaattttaaagagactggagttggtattatgaggatgggcttagcatggtgctcttgaagtacaggcactactccccacccccatccccacaaggctagcggaatttttatgttctatatattcccttcctctcagcaaatcacttatccaagtactgcttaatactgctttaaaacaatcagatgaacagttaatgccaggattgttttagtacccaccaaacatctttgttttcatcaatgtaagtacagttgtatgctgcataacaacattttggccaatgacagactgcatatatgatggtagtcccataagattataatggagctaagaaattcctgtcacctggtgacactgtggccatcataacatagcagcagaattacttaatttttaaattattttactatagcctaagtatatagtgtttatatagtcttcagtagtgcatagtaatgtcctaggccttcacattcactcaccactcactcactgactcacccacagcaacttctagtcctgcaagctctattcatagtaagtgccctatataagtgtaccatttttaattttttatattgtatttttagtttaccttttctatgtttagatacacaaatacttaacattgtgctacaattgcctacagtattcagtacagtaatatgctgtacaggtttgtaacctaggaacgatagactatactatgtagcctaggtgtgtagtaagctatactatctaggttggtgtaagtatgttctatcatgttcgcgtcatgacaaaattgcctaaggatgcatttcttagaacatatccccattgttaagtaacacatgactatatttagtattgaggagcagcatagaaatgtagctgtaaactttatttactcagagtcccttatgttagttcatttatccaaattagatttagtaggtgtctactttaagctaggctctacagggagctatgatatgcttatgatgtagtctctgtcttcatttggggagaaattggcaagaggggtagggacttaaaggaatgacagattgtccatggatattaaagaagacttcatggagaagatggtgtttgactggggccttaaaatataggtagggttttaataaggagatagggaaaggagtgcattccatgagaaagcagcatgcacactggctcagaggtggtgatgccagggtgaacagtttagatttttggtgtaggtcataatgaaccttcaaagcctttttacctggggaataactcaggaagatttttctgccagaagtatataggagaaattggagtggggacagcctggagcttcaaaggtgcaagtggtagaagcaaacagagcttaacaattgattggatttacagggcaaaaaggggaacaaagatgagtccaaagcctgggaaactgggaaatgatgtgccattaactgaaaataggataacaaaaagtggatttggaggggtatgtggagaagtgcttttgaaaatgggaaattggagagaggcccatacacagaaatgatcattgaagctgtggggctagttgagttagcctggttgattgttcagcaagaagtctgaacctaaggaaaaacctatctatagggggtggtgggaagagaaagagcctgcaaaggagaaagaactggatcagtcagtggttgtaatcatggtcaatcaggggtcactcagcaactgagtgagaagagcctctaagttactgcggacagcaattattgtggcttggtaggtgatgtgcagcataggattgttttataatgttcctttcatttcacagactaaaaattcattctggtatggagtgtcctgaaatgaataatattcaaaaacaacctttgttgtaaagatggcatacatctctgaatgttattggtcactttaccatttcaagttaaaaaaaagtaaatcctataccacaaaatgttcagggcttctaacttagaaagcattaagtagaacatcatcaggctcctgattggtcagggctctggctcagtttctaagtatctcctaatgtggtaagaagcagctggtaagactcagtctaagacccattgtgttcattgggacaagagagtgtcccaactgttttatcatctgactcttagaatatggctacagagatcccatctcctttgcccctacagtgagctgtgacctctgtatattcttcacagaagcacaaattcttaacagcaaaaatattgtttttttttaaagcctattcaattttaaagcttgatatggtttgtctgtgtccccacccaaatctcatctttaattcccacgtgttgtgggaggcacctggtgggaggtaattgaatcatgggggcaggtctttcccatgctgttctcgtgatagtgaataagtctcacgagatctgatggttttaaaaaggggagtttccctgcataagttctcctctctttgcctgctgccatccatgtaagatatgacttgctcctccttgccttccaccatgattgtgaggcctccagctatgtggaactgtaagtccattaaacctctttttcttcccaaactcaggtatatctttatcagcagtgtgaaaactgactaatacaaagcttctcttcataaattgggcataataaaggacatcatcatggccacagcagtatgcatgcattcttgactgtggccagtattctctggaacattgcaagactaagataaccttataaatgccaaataacagtagttctttttggttcatttaagtaaattctagatcaagtaatgggacctcaaatttcaaatgaatttttcatgtctttctacctctccctacagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatggattgttgtcaatttattaaaccatcccccatgatgagtgtactcatatccaaacagaaacaagaagaaaagcaataagctctatatcttagttcatttgggctgctgtaacaaaaataccatagactgggtaaatataaacaacagaaatttattgcttatagctctggaggcttggaagtctaagatcaaggtgccagcagctttggcatctggtgaggggtttgtctgcttcctagcgtcttcggggtgcatcctcacatgaccgcagggcaaacaaactccctcgggcctcttttaaaagggcgctaattccattcataagggtggagccctcattacctaatcacctcccaaaagccctacctcttaatactaacacattactgattatatcttaacatatgaattttgggggacacattcggaccatagcactctgattagaaaatggcagaagatgctatcagccttggggcatccttccagagttcttagggtaactcctaataaactaagcaaataaaatcccaatgctgtattgttaaggtgagaagatttgctccaaatcccaatgctatatggttaatatgagatggagcgggtggtggggggtggttagagaagtgatacaaatggcggctccaatatttgggttgaattaccatgctgtagtggaactcacacaaggatggaacttgccttgggcaagcccctatggttctttttttgttttgagatggagtcttgctctgtcgcccaggctggagtgcagtggtgcgattttggctcactgtaacctccgcctcccgggttcaggtgattctcctgcctcagcctcccaagtagcaaggattacaggcagctgccaccatgcctggctaatttttgtatttttaggagagacggggtttcactatgttggccaggctggtctcgaactcctgacctcaggtgatccacctgccttggcctcccaaagtgccgggattacaggcgtgagccatcatgcctgcccacccctacgcttcttagagcctctattttctcattgtaaatcatgggtgataatgcttaccaccaagaggcatctgggggttttctggaagtagcccagctagccccgggtctgatcccaattgacaaagtcagtgctgctttaagaaatataatcctcagttctccgtgccacttttagtgctcctactccaagtcaaagttaagccatgggcaaaggagaggtcatgtatgagcagggcctgtgaagttgggatggagacggcaggaatgctgagggaaatgcaagggaaaaagtaggactaagggagataggcatgttaaaggcaaacaaaatggagcccagattaggagagaagttcgaggattgcttgaaaaccaagatgatattttaaaaagattgtttttttcagaaacccgtaacttaaaagatgagaataaggagaaagaatgagggaaagaagttgagtgtcagaggtagaaggtggggaaagaagcagagtttgaaaagaagataggcctttccagataaaggcagtcaggggactgatagaaagtaccctggggtcatgctggagagacaggccagtgagtgtggcacatgtgccacagcgggcatccaggagtggaagaggtagaagagccctcatacagcctctgtctgatactgcagcctgagaacagtcagagctctgctgagaggcggggtggtagggaagacaacacaacaggaaggggcaagggcaagctagtgtgtttgcgatgcccctccatctcctctgctaccacttctcaatgtaacccaggggggctacttcaccactgccctccagtcacccaaagctattgccgttctgactttccaccccaccccaacatacacatgcacacattcactctgacacctcagaaagttttcctttgctatagctcagtgattttgacttctgtatgctacagacttgtgctgtccaatatggtatccact

SEQ ID NO: 14965 - DNA, 47858 bp, Human
  misc_feature (1)...(47858): n = A,T,C or G
catcacgaacatgtcacagtgctgcagagattttgtctatggccagttttggccattctcctgaggcaggagaatggtgtgaacccaggaggcggagcttgcagtgagcccaaatcgcgccactgcactccagtctgggtaacagagtgagactccatctcaaaaaaaatttttttttactattctgctacccaatatccttaaataattattgagtgccttaatcaaaataaaaaattcccagcttgccctttaaaattcttgtcaatctgtttcctcttatacctagtcagccttgttttccattccaacactaagtcttagacaaaaagtctttatctgtccaaaaaatctctaagtcttttttttttttcttttttcgagacagagtcttgctctgttgcccaggctggagtgcagttgcctgatcttggctcactgtaacctctgcctcctgggctcaagtgattctcgtgcctcagcctcccaagaagttggcattacaggcttgcgccaccatgcctggctaatttttgtatttttagtagagacggtttttcgccatgttagccagtctggtcttgaactcctggcctcaagcagtctgcccgccttggcctcccaaagtgctgggattacatgcgtgagccaccatgcccggcctcccaatttatcttgaacatccctaggttcaacgttctatgaaaaacagccccttctgcacgattccttctcatttgtgccccgaactttataaaatgcaaccacctttctgaatgtgtatgagctctctatagcatcaggtctttatactagagtttgtaaaatggttttgattaatctattatttaaaatgttggagtaattctcaacatttaaacatcattgaaaaattgcaaactctagtaggacccacatttcaataaatggctgcaatttaccagtagttgacatctttagatacgcactgttcagttagaaagttacagcttcattcgaaaagcattgagcgtctattacttgggacactgttttagacgctggggatatagtagtgaccaaaacttatcagggagtttataatctaatgaggaggagagagacaggcaacataatcattactacagttttctaagaggaacagagaatatgtgggtgggaagggtgcttgggcttttgcattcatttaaatacctggctggatgctgttggaatttgagtttatgactcgtactaccatccgaatcgtcatacaccatcatgtacgttatgcactgcccctataaaactctcaacaagtctaaggcagggagtgtgcctccttcgcctttggattccgggggcccagcagtgtttttatggaggggacacgatggaaagcgaaaagttaggcgtagttacttcgaccaccgctgtcccgggtggttattctgacggggtttggactgggcgcctgggagggtgcaacacaataagtgttgaagagcagtcaggtctttcgcagaatctcaaagccacctccgcgccggcagctccgtttctagggaaacaggactgtaacgcgtacgcgtcgtgggtcctcgttctctagctacgagtcctgccgctctgaaacaaactaaattcgtgacaagaacttggccctcagagcccgtcgtccaacgcgaaaaactacgggtaaccgcgccccctgccgcgccgccgctggcactgcagcttccggggtcgtccagttccaggcgggactacttccggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcaggcaagagccgggcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtgggtgagtgctgtgcccggtcctggactgctgtgtgcctggccctggactgctgtttgtccggctagaaagtgggcggtagcgactccggggactaggaagcaaagcgaagggaggggaggggcggtgccgcccgctccttcgacgttgggatttttctggggcaacctcggcgcgtcgctagcggtctggggagtgcttcctgccgcctgagtttggggaccctcaaagggccgttctccttgccaagcgtaggatttgggaagagcctagggctcgctggagactggactgattaagtagttgtggagttggtgattaaaaacttcctgctcgttcgacagctggttacctccgtctttgccccatcgttttctgaagatgatgcagcagtggagaccctgctgtctagagaagcccaacactagacacttgacacctagacaaccgcattgaataggaagaacttacttccccattatttatattactcatgcattcaatccctgatagggtagctttaagatttattacaattgtaaaggtgttgctcttcatccccggattgcaaagattgcgcgggtgctaggagatgttcggttttagagtatgaaaaggaaatctccagtctcaaaacactccagaacaacaagtattttacatgttgcagtcataaagcgctggtctctcagtgactatagaatgagaaaaacatggataagatatatacgaaattatttaggaaatttgagtaacactaaaacaaactgagaaatatatgtatgtattctcgaaagtctgggtctcactatgttgcccaggtgcgactagaattcctcccacctcagcctccacctccgtttccccttcccgagtagctgggactacaggtttgttttttgtttgtttttgtagcagtagttaacagaaccctaggtaaatttttagaacttggaaatggggttggggcggggagactcagaagaatactgcacatctcagcagtaattcccctgtttcatagttaacatttggttattaggagactgtagaaagtgccctattctgatacgttgtgtaatcccctaagccattttaaaaaacatgtttgagtcaaataatatatgtaaatagttcaaatatgtatgttccttacttcattaaactttttttttggtggatgaatacaggtgactggcgtaaatctgggaaacatcactcttaaggctcactgtttccttttggaacgcttcattgcagtattcttttgtttgaatcatacaacctttgtgcaacctgtacttttaaaaaattgctattatgaacactttgattctgttctaatgaaataaaacagaaggcgcaaaatagaattagacaaatgattttaaaacttaaaaaccgtgaattcttttcttcaatataaatttttcttgaaagttcattgttttctgatggaaaaattctctggtacaagtaggcagagttgctctgtctgttctgttctaaacctttccctgcctggctcccgaggccccagcattggtttagtggatcacagtttagtcctacagttgtaaaggaggcactgctgttgagattaaaaaaacaaacaaacaaaaaaactgtgtctagattattttatggccagtgccataagccagagcttcaagtagttacatattagcttaagcatgactgaattcagaaccccaaaggcattttaagggtgaaagaatgaatttgaggccctcctgtaacttctggacaagagaatggaattagaaaaagtagaatgaaatactaaagagctcaaattggacttgcacgtatatcatagaagaaaaattatatattacgtttttaatatcttaaaacttttcatttcaaatcgttaatacaaagcaagggtcaggcgcagcggctcacgcctgtaatcccagcactttgggaggacgaggcgggtaaatcactggaggtcgggagtttgagaccagcctgaccaacatggtgaaaccccgtttctaccgaaaatacgaaaaaagttagccaggcatggtgcgcgtgcctgtagtccctgctactggggaggctgaggcagaagaatcacttgaacccgggaggcggaggttgcagtgagccaatatctcgccactgccctccagcctggcgacagagcaagactccgtctcgaaaaaaaaaatatatatatatgtatacatatatatatatatgtatatatatgtatacatatatatatatgtatatatatgtgtgtatatacgcccacagacacacacgcatacacaaagcaagtcattatttgacttgagatgtctacaggaaatgttactttacattgtcattgtctttttcacttgttctctttgattcagtcagatttttgttacccttttttttttttggtcattcctttgttcactcttcattcagcaggcatacattgaataattactgtgtgtcaagcattgtgttaatctatggacacaaaatgagtaaatagactgtgagttcctgccttcaaggaactctcaatctaatggaggaaacagagagacataagacctgtaatttagtacgataagtatagtgctacaaatatacaagaagctttaatcctcttttatttaaaatagtcatagtccctgaagaaaagacaaggaccttcagataggagctttctctgtaaaggtgttgacactatcctctccttcccaccttttcttttttctttttctttttttttttttttgagacgaatctgtctctcaggctggaatgaagtggcctgatcttggcttactgcaaccccgcctcccgggttcaagtgattttcctgcctcagcctcccgagtagctaggactacaggtgcgcaccaccacacctggctaattttttgtatttttaatagagatggaggtttcaccatgttggccaggctggtcttgaactcctgccctcaagtgatctgcccgcctcggcctcccaaagtgttgagattacaggcgtgagccactgtgcccagcctcctcccccccttctctgatagcactttcccaacaggaagtaaccaccttttgctaatgtatgatatggtcattttatgattaaaggcctttaaagattaatctcttttggtaggtgaagagtcttgcaggagggtgagcagtctttctgacagtcatatgaggaaggaatccttttctcaggggctgagaaaaggatgggtcaagatgtcttaggaaggcactcatgaattgatgatgatatgtgacttgtcaaatggaagcaggccaaaggctaggaagtagggaactctggcaaattcctgtcttttcttggcatcagaacctacaagccctgaaggatatactagatttggtagtgttagaactctttaaacattttatctagattcatttttttgttttgtttaataagatttctttgatgtgttctgaggggaaaaaagaaaatatccttaggtcccacctcttctccccagctgggcctcaagtgttagaggggtacagggatcttgaggtagagcctggttggagtagccattcttgtagaattccaaggggaaagtgaaacatgggggacggggccacagtggttagtgttaacagagaagatgtcatttccttattcattgatttccaagtcatgacttgtctgttctaagccttaactccggttcttgtttgcatatcttttttccctttactcaagccaggcaatctttcttgccagttttctgcctctgtgctatttaccattcattgctaaatgtttgctcttttcaaccttggtatttcctttaaagatacgcttgtgtcccacaaagctgagctcaaattctacctctacaaaactctgtggacgcagtggtttgaattgttagcttttaagagaatacatttccaagtgacattttaatgtgtgtattgctgtgtttctgacttttgctgtgttagaagaagttgaccaggaagtagcttgggactttctccagtgaaatgcagtcatgcagtccttttctccagtgaaattttataagaaatcccaatataaaaatagatattgatagcataagaataatataaattcataacatacacacaaatttataacatttacttaactaggccactctttgtacaataagttaaaatctttgtaaaaaagtaaaaatttttttaaaaagttttttggttttgaataagaatagtagacttaacagccagttttttttctaatatattttgtagctttttaaactatgaaatattttcagcataaaatagaaaatatgaactcccattcctgccaggcaattatgtcaagtgctaatattttgatatacttgattctttttttttaagaaaggaacattcaagatgcagtgaaatactttagtatttttagcagctacctgatcccattcttcctcctttctccgagttaaacactctataaatagatagaaattctctttaatagtataatactacacttacaaatatactatatattgtttggatgtttttaaacttcttaaaaatggtgtctttttgtcattctgcaacttttgtcatccagcatttcttcttttttgagacggagtcttgctctgtcgcccaggctggagtgcagtggtgtaatctcagctcactgcaacctctgcttcccaggttcaagcaattcttgtgcctcagcctcccgagtagctggggttacaggtgcgcaccaccatgctcggctaattttgcattttttagcagagatgggatttcgccatgttggccatgccagtttcgaactcctgaccttaggtgatctgcctgccttggcctcccaaagtgctgggattacaggcgtgagccaccgtgcctggcccattcagcatttcttcgtgagagttattcatgttgatgtttgtagctctaggttataaattttaatggctgcgtgatactatactactatatgaatatgcattatctgttgtcctattgacgaacatgactttgttttcaatttcttgcacctacagacagctctgtattgaaagtttttatctatgttttcttgtgtttatgggtgcaagattctttttttttttttttgagacggagtcttgccctgtcacccaggctggagtgcaatggcgcgatctcagctcgctgcaacctccatctcccaggttcaaatgattttcctgcctcagcctcccaagtagctgggattacagacgcctgctaccatgcccaggtaatttttttttgtatttttagtagagacggggtttcacatgttggccaggctggtctcgaactcctgacctcgtgatccgcccgtcttggcctcccaaagtgctgggattacagatatgagccactgtgcccagtggagtgcaagattcttaaaggttgtcgtcttgaaggggaattcttcagtagaagtgtagctcttggcctggtgtggtgctcatgcctgtaatcccagcactttgggaggctgaggtggacaaatcttctgaggtcaggagtttgagaccagcctggccaacatgatgaaacgtgtctctactgaaaatacaaaacttagctgagtgtggtggtgaatgcctgtcatctcagctactcgggaggctgaggtagaagaatcacttgaacctgggaggcggagattgtgccactgcactccagctggggcaacagagtgagactccatctcaaaaaaaaaaaaaaagtgtagctcttgcaaagttgcccttccaagtgtttgttgatttccctcctgtcagcagtgaaattcctgttgttccacatcctcactaatgctgagcattgtcagattttctaatttatgcctatctgatgaatatgaagtaagacattgttttcatttcattttctatttctacttcattgccagtgaagatgagcattttttcatatgtttcttcatcattctgttttctttttctataaattgcctgctcattacttttattattctgttgggttactttttaaaaattgatggcagggtgcagtgactcacacctgcaatccaaacacttggtggattgcttgatctcaggagttcgagatcagtcagggcaacatgatgaaaccccatctctacaaaaaatacaaaaattagctgagcatggtggcgcgcacctgtagtccgagctactcgggagatggaggtgggaggatggcttgagctagggaggttgaggctgcagtgagccatgattgcgtcactgcactccagcctgggtgacagagccagatcctgtctcccgaacaaaacaaaaaaacgaaaccaaaaaccaacaccaaaaaataaaacaaaattgatttttagagttccagatacatttcttactaatctttagttgggtatgtatgttacaaatctgtattctagttctgtttgtttctggtgtcttttattgtaaagaaaatgtgggttttcacttagtgatatttgtcattctcccttaattttatttttcttaagaaaggcttcggggctgagtgtggtggctcacacctgtagtaaagaaaagaaacccttctccaccctgaggttatacagatattttcatattttcttctgcaagttttactaaacttttgattttcacatttaggtctttgatccaccaggaattaatttttgtataaggtctgcggaggaattgaattggataaccagttgacaatagacaataatcaattgtctaatcactgtggattgaattgtctgttttttccccactgttttataattgtcttagctattttgggcatttcaaatggattatatgacagattggttaaaatcattatacaagggaatttcttgtaggtttttaggatgtaagagaaaagacattataattttatttttgtttcacatcagctgatattgatggtttaaaatatatttttattccttaataacatttaatgataagcttatgtataatttgtaagtaagtcaagaagagaatgattttctgccagtgaatatacaacataatactatagcagtgtagttaggtggatgtgtctctagcatggcttttgtttaaagaaaggacctcagaggtgttgcgtgtcatcggccttgtggctgggcgcggtgctcatgcctataatcccgagcagctttgggaggtcgaggtgggcggattacaaggtcatggagttcgagaccagcctgaccaacatgtgacaccccatctttactaaaaatacaaaaattagccggacatgtggtgcatgccggtagtcccagcgactcgggaggctgaggcaggagaatcacttgaacccgggaggcagaggttgcagtgagccaagatcgcgccactgcactccagcccggacgacagagcgagactccatctcaaaagaaaaaaaaaataggccttgtatataagtatgtagggtaggatatcaaactctggttacttgacaagtgatggttctaaccacctattacccaggtatcaaaatgaaacttaaggatatatcatttctttatctcttgttatttttttcctccttggttgtctattgtcctttaatctgaccacttttcttctcccccttccttgatttttcattttgtcttaagttaaaaagcttttattttattttattttttcttcttttttgagacacagcctcactcagtcgcccaggctgaagtgcagtggtacaatctcagctcactgcagcctctgtctcctgggttcaagcaattctcctacctcagcctcctgagtagctgggattacaggcacccaccaccatgcctggctaatttttaattatttatttatttattttttttctagaaatgaggtttcaccatgttgtccaggctggtcttggactcctgacctcaagtgattcacctgcctcggcctcccaaagtgctgggattataggagtgagccaccatgcctggcctaagttacaaagtttttaaaagtgtttttgcttacagtctttttcctgttataaaaatatcagctaattggcaatatttgtccaacaccatgggtgagaaggatattagttcctgaggcattttggtattgttgaaacattcttttccctcatcctttgttttttaggattaagtttcacattgacttattggcatctgctatcttttttggtgtagtaagtgttgctcccagcttttagacttcctttagcgttattttcttaatgggtctgtggctgctatgcttaaaggacaagcacctctctgtccctatagcaccttgtggaacatttacagttcttcaccatggagacctgttatggcgatctctgttgcattcagggaggcctttctttagtttcctccagttaagaaatgttgaaaatgaagtgtcttgtgaagtagttccagttcttactgacttttaatgcaagctcagaactgtgtttaatctcatatttaaaaaaagcatgaagggaaatgatgaaggatttaaaaaattttattatgtacagtctccctcatatttagtgtaatttttaaatgatagcagttggatgaaaaatctgttattcagtgaaattgttattgtatctgaaaactcgcaaactattttcttggtcggtaaacgtacccttagtaagcacttgcttattttcatttgcaatatgagaattgtagtgactcagaattttacttctcatttgtactaaaagttttttttattcttatctggagcagcagcttttactttcatttgtcatgggatgaattatcttaaccttctcttctaaaaaaagatctgcttaaagaaatctagcatgtgcagtgttttggtttgtccccagcagtactaagtccttgaggtggagggttgaaggggaagaactttttttttttcaaacattaataccttattaggttctgttaagttacctgataatgaataaacctttatatttaatggagagattgaacctaagaaggtcattgtggcagatatctgggaatggccattgtcccctgaaaattattgacattctgaagtggccacctgcttataggtgttaagaataggctgtgtatatatgtatgtagggtaggatatcaaactctggttacttgacaactatcagttctaaccatctatcacccagatatcaaaataaaacttaaggatatatcatttctttatctcttgttatttttttcctccttggttgttttttgtctctgaatctgaccactcctcttcttcccctgccttgatttttcattttgtcatattactccagttttatgtcagaaatttgtcactacatgatgatgtagtcttaaaatttttagctattctagtgggtatgtcattgtgggctttgtcgttgttgttgttgtttttgagacagagccttgctctgccccccagcctggaatgcagtggcgtgatctgggctcactgcaccctccacctcccaggttcaatctgggactacagatgtgcaccaccatgcctggctagtttttgtattttcagtagagacagagtttcgctgtgttggccaggctggtctgcaactcctggccttatgtaatccgcccgccttgacctcccgcagtgctggagttacaggcataagccactgtgcccggccttcattgtagttttaatgtgcatttacttgataactcttgattttgggcacgtttaaatatatttatttgctaaatgaatgttctctttttcaaagtactacttgtttaaatattttgtccatttttcttttcacttaattttcacaactcttttaagcacggcagctattttaatctccatttgacaaatgagaacatggatttgggtttgagtcagaatggaggtgaactactccaaagcttataagctagtaagaaagcttcagagatggatgtaggcaaggcaggtcctcgttgttttattggtgatgtgtatcccgcgccacccccctgaagcctgacagtactccacaggtgcatacggagtgtgcataatggttttctcagtctgcagaggtaatgtaatcatctgcctggcctgtttgcttttgattctctatctgtaactttttggcatgttagtggctgccttggagactttttttttttgagacagagtctcgttctgttgcccaggctggagtgcagtggcgctatctcggctcactgcaacctctgcctcctgggttcaagcaattctcctgccacagcctcctgaggagttgggactacaggtgcatgccaccatgcccagataattttttgtatttttttttttaatagagacgaggtttcgctgtgttagccaggctcgtcttgatctcctgacctcatgatctgcccgcctcggcctcccaaagtgctgggattgcaggcatgagccaccgcgcccgaccgactcatttttcctttatcccagccactagaaaatgtctagcacattatgcttcctaataggcctattacaatggaaattataacatgtatgcttctgccctgtctcctgagtaagggtgtgtgtaaatgagtgtgctcgttttgtggagttagggggacgtggttctcacctaacaggattacagagggtattttggaaatatcagccaagaagaaagtgaacttgtaggaaaataaaggctggccccaggatttttgcctttttaatagatggtttaaaatattaaaggacagtaaaaggtaatttttatgtgtttttcccccttcttttcgtcctggctccccttatgctcaattctctcaactcctcctagtcgccccagaaatgttggtggtgacatgagaaatgaatagaatggcaatgactgatctgtattccatcagaggaagcagctcttaaatatattgtattattatatggtttagtaaatggagttaatcagctgggcgcagtggctcacgcttttaatcccagcagtttgggaggccaaggtgggcagatcacctgaggtcgggaatttgagaccagcctgaccaacatggaaaaaccctgtccctactaaaaatacaaaattagcccggcgtggtggcgcatgcctgtaatcccggctactcaagaggctgaggcaggagagtcgtttgaactcgggaggcagaggtttgcattgagccaagatcgtgccattgcactccagcctgggcaacaagagtgaaactgcatctcaaaaaaaaaaaaaaaaagttaatcatggcattctgcctgattctttgcttgtaaacgagagttgaatttgcatgtttcctattcagtgtgtttaagatatgtattatcggggaacccacctccaatatttcaacataggttctatttttcctaagtgtcggccagtctgagaaatagagagaaagagtacaaagagaagaattttacagctgggccaccaggtcattacgggccgtaggtccgtaatgccccaccagagccgcaaaatcagcaagtttttattaaggatttcaaaaggggagggggtgtacgaacagggagtaggtcataaagatcacatgcttctgaggccaataaagatcacaaggcaaagggcagaattagaattactgatgagggtctgtgttcagctgtgcacatattgtcttgataaacatcttaacagaaaacagagttcaagagcagagaaccagtctgaccaaaatttaccaggctggagtttcccaatcctagtaagcctgagggtactgcaggagaccagggcgtatttcagtccttatctcaaccgcataagacacacactcccagagcggccgtttatagacctcttcccaggaatgcaattcttttcctagggtcttaatatttagtattccttgctagaagaagaatttagcaatatctctcctacttgcacatctgtttatagactctctgcaagaagaaaaatatggctctttttgccctaccccgcaggcagtcagaccttatggttatcttctcttgttccctaaaatcactgttattctgttcttttttaaggtgcaccaatttcatattgttcaaacacacgtgttttacaatcagatttcttattattcaaacacacgtcttttacaatcaatttgtacagttaatgcaatcatcacagggtcttgagttgacatacattctcagcttacgaagataacaggattaagaaattaaagacaggcataagaaattataagagtattatttgggaactgataaatgtccatgaaatcttcataatttatgttcagagattgcagtaaagacagtcataagaaatgataaaagtattaattttgggagctgataaatatccatgaaatcttcacaatttatgttcctctgctacggctccagccagtccctccattcgttctgggtccctgacttcttgcaacaatgtatatacatagggaaacagaaaaactatgttaatttggcaattttgaacaaaaattcctctcaagaggcagtttaatatagtgatttgaacctggagcacacaccctgagccagatggcacaaattgaaatctattttattgcttactagctgtataaccttgtgctagttatttaataattttctggaccaggcacagtggctcatgcctgtaatcccagcactttgggaggctgaggcgggcagatcacctgaggtcaggaggagttcgaaaccagtgtgaccaacatggtgaaaccttgtctctactaaaaatacaaaaattaaaaaaaaaaaaaaattacccaggcatggtggcgtgcgcctatatcccagctacttgggatgctgaggcgggagaatcacttgaaccagggaggcgtaggttgcagtgagccaagatcgcgccactatactccaacctgggcaacagagtgagactgtatctcaaattataataataagaataattttctgtgtctcagcttccccatttatatagtttttatttttatttatttattttatatgcaaagttgtaaaataacccagcccaggctggagtacagtggcacaatcatagctcactgtaacctcaaactcctgggctcatgtattctcctgcctcagccttctgagtacctagaactacaggtgcgcatcaccgtaccagactactatttcaatttttttttttaagaggtgagggatctcactatgttgcccaggctggtcttgaactcctggactctcaagtgatcctcctgccttggcctcccaaagtgctaggattacagctgtgagccaccgggcccagtccccacttatggggatccttcatttgattgaggagcaagtgatttagcttatgtaaaatgctcaggagttattgcttaattgctattattgtttttaattaaattgctatctgtcattcagtactcagagctgtaagtaggttttcattttagaaggcatgcagattgggctgggcacagtggttcacacctgtaatcccagcactttgggaggccaagatgagtggatcacctgagatcaggagttctacccccagcctggccaacatggtgaaaccccatctctactaagaatacagaattaaccgggtgtggtggcacatgcctgtaatcccagcaactccagaggctgaggcaggaaaatcgtttgaacccaggaggcagaggttgcagtgagccaagatcgtgccatttcactccagcctgggcagctaagagtgaaactccatctcaaaaaaaaaagaaaaaaaaatggtatgcagaatgtatttttaagaactatgtgtattgctgctttccccagggtaaagatttgcatcgataaacattaacccaaacagaacattaaatggggtggaaaattaagtgagaaaatttatggtaaacctaagtttaactataaaatgctaaatagagtcattgtcatttaagggagagaaggagtagaattatttacagtctatcaggttgaggtattgggcatttaaatattttaatctaaatttcactacacaagaattgtgtagtctagaaacctagtaagtatatataatgtttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaagcatctgtttaacaaagcacatcttgcactgcccttaatccattcaaccctgagtggacacagcacatgtttcagagagcacagggttgggggtaaggtcacagatcaacaggatcccaaggcagaagaatttttcttagtacagaacaaaatgtaaagtctcccatgtctacctctttctacacagacacggcaaccatccgatttctcaatcttttccccacctttcccccccttctattccacaaaaccgccaccgtcatcatggcccactctcaatgagctgttgggtacacctcccaaacgggggtggtggccgggcagaggggctcctcacttcccaataggggcggccgggcagaggcgcccctcacctcccggatggggcggctggccaggcggggggctgacccccccacctccctcccggacggggcggctggccgggtggggggctgacccccccaccaccttcccggacggggcggctgtccgggcagaggggctcctcacttcccggtaggggcggccgggcagaggcgcccctcacctcccggatggggcagctggccaggcggggggctgacccccccacctccctcccggacggggtggctggccgggcggggggctgacccccaccgccctcccggacggggcggctggcctgggtggggctgaccccccacctccctcctggacggagcggctggcctggcgggggctgacccccacctccctcccggacgcggtggctgccgggcggaggggctcctcacttctcagacggggcggctgccgggcggaggggctcctcacttctcagacggggcggttgccaggcagagggtctcctcacttctgagatggggcggccgggcagagacgctcctcacatcccagacggggtggcagggcagaggcgctccccacatctcagacgatgggcggccaggcagagacgctcctcacttcctagatgggatggcggccgggaagaggcgctcctcacttcctagatgggatggcggccgggcagagacgctcctcactttccagactgggcagccaggcggaggggctcctcacatcccagatgatgggcggccaggcagagacgctcctcacttccccgacggggtggcggccgggcagaggctgcaatcttggcactttgggaggccaaggcaggcggctgggaggtggaggttgtagcaagccgagatcacgccactgcactccagcctgggcaccattgagcactgagtgaacgagactccgtctgcaatcccggcacctcgggaggccgaggctggcggatcactcgcggttaggagctggagaccagcccggccaacacagcggaaactccatctccaccaaaaagatacgaaaaccagtcaggcgtggcggcgcgcgcctgcaatcgcaggcactcggcaggctgaggcaggagaatcaggcagggaggttgcagtgagccgagatggcagcagtacagttccagcttcggctcggcgtcagagggagaccatgaaagagcagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatactgcaattttaaggtgtagaagcaattgaggttttttttcctcctattaatagataaaaggcaattttttttcctaagattgctatggtcagaatgtatcccccaaaatttacgagttggagacagtccccaatgcaacagtattgggggatggggacttttgggaagtgtttacgtcatgagagtacctccttcgtgaatggattaatgctgcaataaaaagggcttacaggggtgggttcactctcccttgtccttctaccttctgccatgtaaggacacagtaagaaggccctgaccagatgccagtgctttgatcttcgattttccagcctccagaactgtgagaaataaatttctgttctttacgaactacccagtttcaggtattctgttcaatagcagtgtaaaacagactaagacaaagttctaaattgctttagtcatgtccaaaggtattaatatgtaatatcttaatcataatacatttttatgttgccttctgtttactctaaattatccacatgtcctgattgttaagtttccacgtgatcgggtattacaattattattattttttttttgagatggaatcttgctctgtcgcccaggttggagtgtagtgatgtaatcttggctcactgcaacctccgcttcctaggttcaagtgattctcctgcctcagcctcctgagtagctgggactatagacgcccaccaccacacccagctaattttttgtatttttagtggaaacggggcttcaccatgttggccagatggtctcggatctcttgacctcgtgatccaccccccttggcttcccaaagtgctgggattacaggtataagccaccacacccagcccatttaatgactttttaaattgagatattgtacttttcagttcagacattccatttttatagttttcatttctctgctgagcattcaccaatgtttgcattcttgaaaatataataatgtctctaaagttctttcttgccaaatctaacatttgggttatgctgacatctatttttattgactaatcttgattttgggacacttgtttgcttatttagtaattttttatattatggtggacattgtgattattctttgtagggaggctaaattacattgtcttcctttaaatggtgttgagttttgttctgtcaggttgtaatattattggggggatcttttacgttttgacaggcttggttttattctttgtgagggaggcctattttggttttgaactaaattctagagggcttttcctcctaaggtgtgccctttttggattttcaactaaatgcatgaagtgttctcttgctttgtttggacagtgttaatgagcctgcttgggctgccataacaataccatagactaggtagcttatgcaacagaaatttattttctcacagttctggggcctgcaagtccaagatcaaagtgccagcagaggtgctgtctggttagagctcaccccttgggttatatacagcccccttattgctgtgccctcatatggcttttccttgctgtgtgtacacaaagagagtgctagctctctggtgtatcttcttaaaaggacactaatcctattggatcagggtcccatccttttgtcctcatttaacaacaattacttccttagaggcctcatctgcaaatacagccacactggggattacggcttcaacataagaattttgggaggaacacaaacattccatgcataatagggaggatgactcccagtgctgcttgacctttcagccccatagcaggtaatctctgctagaccccatagagactcatctcaagtgtgtttgtgtagcccagcctttggccaagggcctctggttaatcactgtgcttagaaacctggtcgccatctctcgctcttcttgggctagtccttctctacttgggctagtcctcttctacttgggctagtcctccttgtgctggatgggaaagtattccaaggcagaaagctgaggccatcgtgaggctcactacatatttcccttccctcaaagatctgggacctgctctgcctgctattcattccctgaaaacagttgcctcattgattttggcctgttttatcattgtttttggtaggatcgcaagtctggtaccagatattctatcatgtttggaagcagaagactagtcatgaatttttatttgcaaacataataggaggagctttaaagttttcttgcagcattcttattttatgtagttaagttttttattactgatagagcctattttattaaaagttttatgggtagagctagattctttttaaagctgtactttgaacataatgactgtaagggggggagcctttttgttccttgtaggtagatattgatggaattattctttatcatattgttagaatctttctaagctatttcacattgtatttgaggctctttttatacagtaatcaaagcctggtgatgaaatgttatgacttacacccaccaaatgccggcgatttagcatttaggccccaggagggctcttttaattttctacctctctatgcgtttgacacagaataatgtgatatagggccccaacactgggcaaagtgacatgctataaaagaatggtttcttaattataatatttaaaattttccaggggtttaaaatactcctaagtgcataatttaaatgttatttagctcccttgaaaaacaaagtcctttttggcaggccattatgaagtcttcagattttatatttttaaaaagagtaattgtgagtcttatatttgtagagactaaactatgcttgatagagtattcaaatcaggaatttcccattttctatggaaattaaataaacaatagtctaattagatattttaaaaattgttgggcggctttagaaggcatgagataggcttcatatttaatgtattacatgaccagaattggaaaaatatcatgaaaagttgagttctagctggactaggtaggttattagatggtctaaaatcagattcacgtgattatgtgtgtgtctttgtactcatacatatccatactcataaaatttgataattgatgatactggctcctcaaatcagtgaagaaaggatagattcttaaataatagaactgacaaaaaattcgtaaaaatatttttctgttcctgcctcacaccacgtgtgaggttccagatacactaaatgaagttctaaatacattaaagatttacatgtgaaaggggaataatatacagaaaagaatgtgggtagatatttaatcttcaggtaattcaaacagtatgctaaatgacactataaaaagaaaaatggtagattctgttatagcaaaaactgcatcataaacaaacaggaaagattagcatgaagctgtaatatatatgatttgcttttcagactcagtatataaagttagttacctatctaagaagcttttgaagcattgccttccccacttaccctgtctccttgttgagactcccaaacggagagttacttctcttcagtaaacaagaggagaactagaacttcataagctcactagtgctgttacgttttgttgccatgtggtgttgctattgaagtttgatcctatgtagcccgttgaatatttgtatgctcagcagtgaagctttggttggtccagaactttgcacacatcagccaaactatgtccacagatgggcatcagagttaaagcccttttagttcgtgtactcaaaagctctgctgttgtttcccaccttacacattgtaccaggctaatgggatgtggaggagcaaccaacatcattcattcactcatgaaacaaatatttatggagcacctacttcgtgccctaaatactgtttatgtactaagaataataatagtgaacaaaacaaacaaaaattcgtgccatgatggttacattcattctgggggtggaatgtggtgaaaggttgtggcaaagacagatgctaaacaaaaaaatgctatgaaacatctttagaaaggactatgcacaaaatcctgccttcctaattattttatatttagtctatgtgagtcaccaatatgaaagataccaataagtataacaaagaagacagattgagtacctaatggatttagaaccagtttgctgataacttttctctagcttgttttgggactttgtggccactctgtatgtaatggtacattatgcaggtactaaaaatactggtatagacgtatatttctgaatgtgggcagatgtttattatgagtagaaatgcatgttaagaactgatacatttagtatgatcacaatgttagtggggaatattttttctctacccctgtggtttcctttgtgagaagggagttccattagtgtcaccctgagcctgccctttgttttgttttgttttgttttgtagagacaggggctcactctgttgtccacgttggagtgcagtggtgcgatcttgtctcactgcaacctcgacctcccaggctcaagccatcctcctacctcagcctcccaagtagctgggactacaggccctgcaccatgcctggctaattttttgtatttttagtagagacggggtttcaccgtgttagccaggatggtcttgatctcctgacttcgtgatccatctgccttggcctcctaaagtgctgggattacaggggtgagcaccgtgcccagccgaaaatatctaatttctaaaaaatcttgcgggtattgatgaaccaattggtataaccagatttttaaatatggtccttctggcttcagtgtggtgggtagtcacaggggcgtggtggtgagtagaaaccatgtgaggaggtgatgatagtaacaggcgagtgaggatataaacatactgagcttcggtcgccactcacttgctgtgccttgactgctctttgtcacactttgcccagtttctgtctccttcctccttagtagtcaaagtttgaaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcctgggcaacatagtgagatccctcacctcttaaaaaaaaaaattgaaatagtagtctggtacggtgatgcgcacctgtagttctaggtactcagaaggctgaggcaggagaatccgaggtgggcagatcatttgagcccagcagtttgagacgaacctgggcaacatggcaaaaccccgtctccacaaaaaatacgaaacttagttgggcgtgatggtgcacacctgtagtcctagctactcgggaagctgaggtgggaggatcacgtgagccccgggagataaaggctgcagtgagttgtgatcacaccactgcacaccagcctgggcaacagagtgagaccctgtctcagtaagccaaccaaccaaccaaccaaccaacccagatgttcatgaactggtgaatgaataaatgtggtatatctatacaatggaatattatttagccataagaagaaatgaagtactggtacatgctacaacgtggatgacccttgcaaacattatgccaaataacagaagccagtcagaaaagaacatatattgtgtggttctatttatatgaaaaatccggaataggtaaatctttggagacagaaagtagacaagtggttgcgtagggctgggaatatgtggggagaatgaacagtgactgccaatgggtatggatttcttttggaagtgattaaatgttctcaaattagatactggtgttagttgtacaactctatgaatatagtcaaaacattgaattgtacattttaaatgtgtaaattgtattgatacatgaattatagcgataaagctgtcttaaaaaactcatgtagctgggtgcggtggcttatgtctgtaatcagtcctagcactttgggaggctgaggtgggcggatcacaaggtcaggagtttgagaccagcctgaccaatatggtgaaaccccatctctactaaaaatacaagaattagccgagtgtggtggcaggcgcctgtagtctcagctactcaggcggctgaggcaggagaattgcttgaacctgggaggtggaggttgcagtgagctgagatcgtgccattgcactccagccagcctgggcaacagagcaagacactgtcgaaaaaaaaaaaaaaaaaagaactcatgtaaatattataaattcttctgctgttagcttttttgactcagcgttataagcccaagcaaatcatattttgagattcataaatttttgttcatttaattttgtattcctcatttcatatttcgttgtatgaatttattaatcaattttcctttttgctattgaaaacagtgcttcaggctgggtgcagtggcctgtaatcccaacatttgggagccaaggaggattccatgagcccaggagttcaagaccagcctgggcaacatagtgagaccccttatctattaaaaaaatttacaaaaccaatgctttattggacagtgtagtgcatatttacttgtatgatatactttctaatttttttaagaggtagagtctcaccctgtcatccaggctggagtgcggtagcatgataatagctcactgcagccttgaggtcataggctcaagcaatcctcccatttcagcctcccaagtagctaagattacaggcatttgccaccatgcctggctaatttttaaaatttatttttcgtagaaacagggtctatctatattgcccaggctggtctcgaactcctggcctcaaacgatcttcctgccttggcctcccatgcctgggattacaggcatgagccaccatgcccggcctggattatacatctttaaaactttcttccaaattagaatttgatgggattattgatacttagtaatttgtttatttagaaggcattttattgctttacctcaagatatttagttcatttaattatacaatttaaaattgaagttagtagaagtacttttgtcttctgaaggtcgtctgtagtatcttcggcaatagaaaaggtaggatttcttaactgttggacctttactggtattttagtgttatatgagatgtgtcctcattgttgtgtatgccaatatattttatagaaaaagccacgaatgagtacaacactacagaagattggagtcttattatggacatatgtgacaaagttggaagtactcctaatgggtaagatgtccagtcatgctcagtgaatgtctaggaacttgataaccagtgtctctttttgtgatgtaactttgagaggaaaatgagactttatcacagttgacccttgaacaacacagatttaaactgcgagggttcacttatacataggttttcttccacctctgctacctctaagacagcaagaccaacccctcttcctccaagtcatgatttccttaacaacatttttttttctctagcttaccttattgtaagaatacagtatattatgtatatacaaaatatatgtccatctactgtttatggtattggtgaggcttctggtcaagagtaggctgttagttggctgggcgcagtggctcacgcctataatcccagaactttgagaggccgaggcgagcagatcacttgaggtcaggagttcgaaaccagcctggccaacatggtgaaaccccatctctactagaaatacaaaacttagctggacataatggtgtgcgcctgtaatcccagctacttgagatgctgagacaggaaaatcgcttgaacccaggaggcagagcttgcagtgagccgagatggcaccactgcactccagcctggacggtagagcgagactctgtctcaaaaaaaaaaaaaaaaaagagtagactattaatagtgaagtttttggggaatcaaaagttatacacagattttcggctgcgtggggtgttggtgtccttaactttcatgtagttaaagggtcagttgttttacttttgggacataaaagttaaaaaagcctgaatgctggatttatgggattaacttacatgaaaaagagttcaactgaaaatctgctatagtaacacacataattaaagccttgacacaataggatacatgataacaatgtataggtgagttatttaaggaattcctctgggacttctatatgtatgggaacttttaaataatgaagtagataacacagtagataatataacaaaaaagtcttcaaataatatacatataaatataatagattaacaatgaaaaaagtgaatataaaaaagtgcttttggggagatgtggcaattagctgaactatatgttagaaatttagaagagtgatgaaagcatttgttttaacattaaagcttttcatagtacattcacatgtttatacttgaacctcttaaaattgtatatcatgttagatttttttcaagataagcttttgctgtttgaaagctaaacctgtcttgaagaaatagaaagatctggtatacgtctcttgtgttgacagatcttttgtgaaatggtttgtctcttaattttggaatacacaacatttgcaacatgctttttttttttaaagttctatgagcctataaacaaaatattgtgtaaaatcattttatagatttattcctttaacaatatgaaatttccaggattttagtttagtttatttttattttatactttctttattttgagacacggtctctgtcatccaggctggagtatagtggcatgacacagctcacagcagcttcctgggctcaagcagtcctcttgcctcagcctcctgagtagctaggagtacagacacatgccaccatgcccagctaatttttaagttttttatagagatgagatcttactttgttttccaggctggtctcaaattcatgggctcaagtgatcctcccgccttggcttcccgaagtgttggaattacaggcatgagccattaaatataaaattatttggtaatagaataataccttaatgtttgaattaaatttatcagtaaatacttaactgtctctctctctctttttttttttagagcgaaagattgcctaaaagccataatgaaaagggtaaatcataaggttccacatgttgctctgcaagcactaactgtgagtacaaggcatgttattatttgacgcaaattttaaatgtgtttttaattacagtaagttaatatttcaatattcatatatttttatttcaattaatagcttcttggggcttgtgtggcaaactgtggaaagatatttcatttagaagtatgttcccgtgattttgcaacagaagtacgtgctgtgattaaaaataaggtaaattttaaaaacagaagaactttaagtcattaaaaaaatgtagattgtgtgtcattataactatatgtggcattactaaagtattataaatgaagtcatttttagatcattgaaatgaaataaactgttctgaaatttgattttttaatttgtagcaccaaaaactattctccccaaagtatatatactgtaaataatagcaaatcctttttgagggctagtaagtagtcattactttaagcattttacatatactgtcttgttgaatgctcttaactacccttggagcattagattcttggaagttagattcccttatcattcttattttataaatgcaaaaactgagacttagaagtaacttgtccaaggtcatgcagctggtaactggaatagccatgatttacatccaggtttctctggctccattctccgaaacatggaggaaataatctctgaatataaaagatctgttgtcattatagtaagacttaggaattggtgttaaaaacagtcattttgtatgaaacaactatatcacaacatgtaaataggcatctatcaattactcaactaggctagaaatttcaggacttttgttgatgttcatataattaaagagaattttgatggtaattctccttgttaaataatttaagtacttattttaaccgtagatttttgtttattttcctttccttttccttaaaaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcaggtgagagatttattcagacccatggttgaccctataatattttgaaggtatgtatgttatgtaaagactaggcaaggtatgtctagattatcattttccacctttacttcccaaatgactctctagcatagtgccttccttacgtttagtagacattctagtttttatgtgtatttcttccacatatcagaaccttgtgaagttaatcagacatagtgtatttaatgttcctctaagtctacagtcatgcaaaaggcataggtatatgacataccccttatattcaagaaatttgtagcaaatttgaatgatagctttatacatgtgaaaaataactaatttagattgtaagtgacaaatacaggatgaggggaatagactgcatactgtctatcttaataccaaagagagaaagaggtgactacagattggaatggtgaagaaggtaaagaggtagaattttgagacttgaatgtattaatattttgttagagagaagtgaagaagtcatatcaggaggtaagtgaaatgaacaaattcatggaattgagaggctcaagacttgtttgttcaagagtgaatatgcctagagtgaatgcttcacatacaagatggatggaaatgtaagactagaaatttatttgctgggagaagggatagctttagtagaactggggtgtggaggcagggatgttgactcatggagtgggctggtttttttaggtctaggggagaaaaatactattccttgggttttgctctcagtaccttattccttcccattaatattaagatatgggctagggaaagagacgatgagaagtactatattttcttttattttaaatcatagattaaagagaaaaaaagatttttttttttttttttttgagatggagttttgctcttgttgcccaggctggagtgcagtggcacaacctcagctcactgcaatctctgtctcccgggtttaagcaattctcctgcctccgcctttagagtagctgggattgcaggtgcctaccaccatgcccggctaattttttgtatttttagtagagacggggtttcaccatgttgaccaggctggtctcaaacttctgacctcaggtgatccacctgcctcgacctctcaaagtgctgggattacaggcatgagccaccacgctggccgaaaaaagattctttatagctgaccagacctaagggtacaaggtaacgttttgagataagagtcttataagtaataaaaaggaaacattttcctgttctgtcctttctgcatatttttctgaaaaatctatgtaaagaaccggttgatggatcagtcctggatacctgtcttacatgctgtttattaaattcaagcatgaccttccttacttctctgctatgtctggcagaccactgccacccagccacaataactagtaaaaggacttcacacatattcctagaactgcacctcttgtctctgtccccattcctctctcttcagtgatgatcatgacttcttgctggcactcctcgtgtagctgtactcctatagcagagctcctctcactaagagaccttggacaattgagatcgggaatacaatcagaaaagagtcttttttaaattctattaatatttaagtactttctgtatgccaagttctgtgttacatttatgcaaaatctaagccagtttgatccctgtgtgagtttataatgttttcttgaaaaatctgatgttttattttagtatttgaaaacaattatttaaaattattataaagaacttcacttttagaccagtgatggtggctcatgcctgtaatcttagcactttggtaggctgagacaggagaatcacttgaggctaagagttgcagatcagcccaggaaacatagtgagaccctgtctctacaaaaaataaaaattagccggttgtggatgcatacacctctagttccggcttcccaggaggctgaggcaagaggatcacttgagcccaggagttggaggttacagtgagctatgactgtgccatgcactgcaacctggctgacagaatgagaccctgtctcaaaaaagaacttcacttttaaatgaaactcagttatatcagtattttttaaaatttaccatctgcaagtaattatggagcttgtgttttgtttgaaaagatagttgtgttcattttactcatacatttacagactgtctcagctgctgccaagaatggtacgtcatcgaacaaaaacaaagaggatgaagacatagctaaaggtaaatgatcaagcacatgtaatttagtgttgcttaaaatatctttgccagggctgggcgcggtggctcacgcctgtaatcccagcactttgggaggccgaagtgggcagatcatgaggtcaagagatcgagaccagcctgaccaacaaggtgaaaccccatctctactaaaagtacaaaaattagctgggcgtggtggcgggcgcctgtagtcccaactactcgggaggctgaggcaggagaatcgcttgaacccaggaggcggaggttgcagtgagccgagatggcaccactgtgctccagcctggcgatggagtgagactccatctcaaaaaatatatatatgtatttgccagaacatttttttgaaataaaaatgataataaaactagcatacttttatttttacctcaaatctaaaaactagtagcatccaaaaagtaaggaaaacaaatgacatgctatcaaatgaatttaattcattatcttttttcagtaatatgtatttgatgtgctacctttggagagattacatttcacctttttttaatgccaaagttatgagtcaagcagagaaatatgttcatggcttatcctatatggaaagctacccatattataatgtcacaatctgtttgctataaaaataattgctgctgtgtatgacagaccgtgataataaagaatgagcaaaaactttattttaaaaatgtcatggttccctgccctgccccaccctcccgaaagttaactgtagcatgtaattagacaaataaaatgcttgatttattcttattaaattttacattgtcatctaatgtttattttatcaaaattaattccagtttctttgcattttaatttttgaaactagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacaggtatgttttaaatctttatgggaaggtttaaagtgtaatgcccttaatttagaatccagagtattcagttctttgacttttagtgtatttaaatcataatagaaccatttcataccttgttttttctaaaataaaagttaggcatgtaatgtgagcctcttctcgttatatttgataatttatgtttgttatatttgataatttatatcttggatgaaagatgtattaaataatattgttgatgaccacaattgggaaacatgtaaatactcagttacttgaatatgtttacgttggcagttgtgtgtactgaaattattggcagaaaaactttaggaagaaatatagcaatatacccttgatcagagcaccaaaagctatacttggctcctccccaattcttaatctactactgtattctcctcagaatttctctgccatttaaagctgtcataaaaaatagatcaatctctgtagagcttaatactgttctgtacttttaaaagaaattcatgaaatttagcaagagtgagaagtaagcttgttgctgtgaacacagattgcagatgtatttggtatccattataaataacttagttatttataacacactagtctaatatatttctagtattttttaaataaagggtagataaataatggttttactttactgtggtaaatatttcttgagaaaatgttatgtaatcaactatttaataacaaatgaggacacagttctgtcttcataaaacctagaataaaataagggagttaaaattaccatatagacaattgtatggaaggcagaatgtggtgaataccataaaagaggtgctgttggagcccagatagcagatttacacttggtgcaagcatctggcaaagaaggcttatcctgcggctccatttcaggtgtgtatcttgattggttttgataagataaaaaattttgcaagaagttgaggatgggaaaaggaaggtctcttaggcaatcaagatagtaccatcttcacttagaaaatcttttttccataaagaaaaattttttaaataatcatttggagtggaacaccatgatccctgaaggagaatagatagaaatacagatgtttctcaacttatattagcctacagttgggcaaaatcatctaacacaaaacctatttattataataaagtattgaatatctcatgtaacttattgaatactgtactgaaagtaaaaaccagaatggtttatgggtatctgagtgtgtatcacttttgcaccatcgtaagtcatgccatcatgagtttgacactgtctgtaaagatggagagatagtgtgggctctgaacactgacagtctgaaatgtcaggcttatgagtgtcttttagttagagtacttacaaaagaacttaggtttaccgttttgatactcttatacaactatgaagttaaagatatttataaaataaaaacaaaatgagtggttttgtctaagattttaatttagagcattactttatataacaaaattttctaaaataaattactgctcacaaaacaattttcagttaagatttatcacctcaaaaaagaacttttttatttgtaactgctaagagaattcaacatgaatgtgatggaatttgtaggtcaattgctgtcattttgacgataggacaccctacttttatagttgctgtaagcatgcttatgggtaaaatattgtcattttaggtgattggtaatcgctggtagacaaatgcaaacttgcatgctaaagttaaatgacagtcttcggttaaaaggaagtcatccagaaaatgactctattcattgtttttatacttttgtggaatttgaagcataaaattttcacacacagaagtcccttgaagtcccttgaaaatatatcattcttggatctccatttaagaaccatggagctggcagggcgtggtggctaacacctgtaatcccagcactttgggaggctgaggcgggcggatcacgaggtcaggagttcgagaccaccctggtcaatatggtgaaaccctgtctctactaaaaatacaaaaattagccgtgcatggtggcgcacgcctgtagtcccagctacttgggaggctgaggcaggagaatcgctggaacccgggaggcggaggttgcagtgagccgagatcgtgccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccccgccccctgtgttcaagtgattctcctgcctcagcctccccaggagctgggattacaggcatgcgccaccatgcccagctaatttttgtatttttagtagagagggtttcgccatgttggccaggctgatctcaaactcctgacctcaggtaatctgcccatctcggcctcccaaagtgctgggattacaggcgtgagccactgtgccggcccaaaggcgcacattttttattaatggagtatatcaagaaaagcgttttactttctacacttttagctttatcttaccactccatgtttcttttcttttcttttttttttttttttgagacagggtctcactctgtcgcccaggctggagtgcaatggcgtgatcttggctcactgcaacctccacctcccaggttcaagcaattctcccacctcaacctcctgagtagctgggaattcaggtgtgcaccaccatgcccggctaattttttgtatttttaggggtagagacagggtttaatcatgttggccaggctggtctcaaactcctggcctcaagtgatccacccgcctcagcctcccacagtgctgggattacaggcgtgagccactgtgcctggcccactccatgtttgttttctgtgtaccatttcaaataatcaagtggaattcttgcagttccaaaaatgccattttctgcttagtcctctgtagcattgcacctttggttctgtctgcctggaaagccctgctgaaggaggtaaaagcatttagaaaaggaaaagaactttactttcaaggacagtttgcaagggagtccaggctttagaaaagttgcctccccatgttaaaaagtaaaacaggtattttaaggaaaagacccccacaaggttaccaggtttttccaggtttgctatttatatgttcatggtagaaatagcagttttctcacgtgataattatatccataaaggacatcactaccttcagtcattgtcattgcaaaagttagcaggtgagtactttttgttaagaaatcagtagttaaaaggaaaggctcaagtttttatgtactttgagacctaaaactaaatatggtaacattttttgttttatctcagagtgcagagttttttgtttgttcgtgccttgttttcttgcttatcaataatggcaggagggcaaaatgtcatttttatttccacagacttaattttcttttcctcctggcaagtgcctacttaaccttcaaaacccgtgtcagattttatatcctctgagaagcctttcaacctttctctgctttttagctcccagtggagttaagagttctcttctttgagctatagctctctgaacatatgtaacagcatttctcatactgtattttaaatagagtcatttctcagttccttagagagttggttccagaacccctgttgataccaaaatccacagatgcaagtcttcgatataaaatggcgtcatatttgcatataacttacacacatcttcctgtatactttaaattatctctagataacttatagtacctgatacaatgtaaatgctatgcaaatcattatattgtatttttaaatacaatatattgtattaaaaattttttttgttgttctattgtcatttttgtttatctttcatgaatacttttgatttggggtttgttgagtccatggatgtagcacttgccagatacagagggcaaactgcgcttctttacgtatgtctctctactaaatcagttgattctgaagaggctcatgacttccttgggtgggaggaaggagaaaggagaaaaattctgaaggtaaagcaagataacatatttttagtcagttctgtaggagagattgtaaaacactgctagatttttttttcttgtttttatagatagggtatgactgggttaccgaggctggagtgcagtggttattcacaggcgtgagcatagcacgctacagcctggactcctggcctcaagcaggcctcctccctcagcctcctgggtagctgggactacagctttgtgctagattttaaacttcttgagggcacaaatggtgtcttaattatctttgtaatttcagtgcttagcctgaaggtactattttctccatggtaggttttcataaatgttagctgaataatgtttgttgaaggtgaggtttatgttctttacacttgtatcattttttgtttttcactcagttgtgatttattctttttttaatataaaaagctctaaatataaatgctacattaaaattttctttaattattaaatggtttgtgtaaaattagagtgccaatttctttaatttgagaatttaagcttgaacaatgtttttttgctatcaacattccatagaatcaacttgtagtcagtggagagaatatagagctggattagggctgggaaggagttgtcaatttggttgctttgcctacttttatgcttcatcaaagagtttgtagtagtggctgggaggaaaattatcctatattggtagaaccactaaggaagggtacacacatacagttgttggtaggttcatataaaacgcttgcatccatttcacaggtttgggttttctcgttttatacaaaaatttctcaagttcagctctccttttcaaaatgaaaagttaacttaaaaatgtgtttgtaagagaaagaaaatttttcctatcttccatagatatttgcagatatgatatcttagaactgtcagtacatcaatacatcagttattttctggctttaagaacttggatgatatataactctttcgtctctttctagtgctcataaatgaaatgatgtttcataatcatagacattaattcatccataagactcatacttaagaatgtctattcaataagtcagatttttggaaaggaatagataaaattatcattatttccagatactatgattttccatatagaaagttcaagagtccgatggataaactattacaagtggtaggagttcataaaggttgttggatacaagctcaacatacaaaactcagtagtatgctttaattacaactttttagaaaatgtagtaaaaaaaagtcattctcagtagtaacaaaaattatataaatgatctagaaatgaataagcctaacaaagatatgtaaggtctttatggattaaattataaaattatttgaaagctataaaagaatataaatatatttttacatattatgttttacataaatgtaaatggaggataccatgttcatagggaagaaaccttaatattgcaaagatttcttttttcttatattattgcataatttcagtgcatttccagttcaaatcccaacaggactttttccccagagaacttgaaaagtaatttaatattaatgtggaaatttgaaggtgtgcaataaatgagaaagagtaacatagaaagggtattttccctggcagatattaaggtacattaacaagatgtgtgaacagatacatggactattgcaacagaatggagtctagaaataggctcatgaatagattactgtttgaaaggtagggtattataaattactagaaaaaatggtggactatttaataaattttgctgtgatgaatggctctttttatactacagataaaattttgatcagtttcacatagtacattaaaatttcattccaaatgaattaaagacctaaacatgggagagggaaaaaaaaaataaaaaaactaaaactacagttaagtatataggagaatagatttaggagtttaagggtagaaaagggtaaaagcataagccatgaaagaaaagattgccaaatttgattgcataggggaaaaaaccactgtacagttaaagaaaccataaacatatgctgaaaagacagcgacagcctagaagaagttctctgcataattcagacaaacaactgctgtccaaaatgtgtaaagaacttctacagatccatgaaaaaagacaaatgatccagtagaataagaaaagtgggcaaaaatacgaaaaaaaaggcagtttacagaaaaggcaatctgaatagctagcaagcacaagtagatgcttgggaaatgcaagtgcatacaatgaaatacgatttctctcctgtctgattatcaagtgttagttgggaaaattatcacatataagggaagatgacattgttacatgcaaccggggggaggagaaaggtgaattttcacagccattctagggaacatttggcaatatctagtaaaatgaaatgcttatggccgggtgcggtggctcacacctgtaatcccagcactttgggaggctgaggcaggcggatcacttaagataaagtttgagaccagcctggccaacatgacaaaaccccatctctactaaaaatacaaaaataggtgtggtggtgcatacctgtagtcccagctacttgggagaccgtgacaggagaatttcttgaatctgggagggagaggttgcagtgagccaagactcgtgccactgcactccagcttgggtgacacagcaagacctcgtctcaaaaaaaaaaaaaaaaaaaagaaaaatgtttatattcttaaatcccagcaagttcacgtctgtgaataagcgcagagaaattgttgcatgggtgtcctcaagtctaggatgatcattaccttatctttgtaatggtgaaagactggaatcaacctaaatgtccatctctacaggaatggataaatatggcctattcgtgtgttggaattttaatttaaaaggaataagcaaaatttgaaagtattaatatataaaattaaaaaggtctgtatggattagcatctgtgtctgtttctatatggacttggctatagatacgtgtaaaagaacaaaaaacagactgacaagaaggctaccaactttattgtggcagtgtggtaagatggatgtggtgctgggatttggggtcattactaaagggcacttgtgtttcctgtttactttttaattttttaattttattattttttttttgagacagagtctctatcctccaggctggagtgcagtgacgtgatttcagctcactgcaacctctgccttcttggttcaagcgattctcctgcgtcagcctcccaagttgctgggattacaggcacctgccaccacacccggctaatttttgtatttttaatagagacagggttttgccatgttggccaggctagtctcgaactcctgacctcaggtgatccactcgcctcggcctcccaaagtgctgggattacaggcatgacctactgcatccggccttacttttttaaagtccagaataaaaaatgattaattgctaattggttctaattttttttttttttttttttgagacgagtcttgctgtgtcacccaggctggagtgcagtggtgccatcttggctcactgcaacctcctcctcccgggtttaagcgattcttctgcctcagcctcccaagtagctgggactacaggtgtgtgccaccatgcctggctaatttttgtatttttaatagagacgaggtttcaccatgttggacaggctgatctcaaactcctgacctctggtgatctgtccaccttggcctcccaaagtgttgggattataggcgtgagccactgcgcctggctggttctaagtttagatatagggatgtggatatttgttttacttgtactttttaatatcgtttattaaatttaagaaaaatgacttaattatagctgcttgtaaacggatatattcaaaggaggctaaatttaatttttaattcatctttgcttattgtattaaaatgtggggaacaaatgatattttttgcactgtatttttagtgatgccaattggtggaaaggagaaaatcacagaggaataggacttttcccatccaattttgtaacaactaatttaaacatagagactgaggcaggtaagttaaatcttagacgacattagatctatttaagtttttttcacttaaattttatgtttcagttttggatgtaaagtagattggcatttaacttttgttttaaatcatttctttataggcatgacaatctaacctactttttaaccaaattaaggggttaatttagcctgtgtcaatcccaagaattatttcctcttattttacatcctctgagagttagcatacatagttaaatgtcaggcataaaatcatttgtgaccatgcaggtatttaaatcaacctaactatgtagtgtaagaggcagttcatatctattctgtacaaagagtgttttgattcatcagtgaaccacagaggcaaagcgggagtggtgtggggaggttgtggttggcaagtgccgaatatgattactggggttaggagtactcctaaattttagacctttcctcaccttgatttgatcctagggagcttgaaacaataacaacaaagtaatgtaatcaagccactaagcttcctgtttcagatctgctgaactttagtcagtctgcagccacagacagttccattttagtcactttagccattgtcaaccatgctgagaaagcattccatttgttattcaggtagggaggtggggggatctgagtgtaaaggaacagctcgtaatagtactaatgatggtaatcagaaatagttactggtttttgagcattcattatttgtcaggcattgtgctaagtcatctgtactattgcatttcaatctcacggttctgtgagatagctacttttgttgccctgtcttacagataaggacactgaggctgagggattatgtgtctagtaagtgattgagccaggattctaaagtcagtcagtttgaccttaacaatgactcactgagggatatatcagtgctagtccttgccagttcaggagaaagaacttcaaatgaaagcattatgcatgtgtaacatcgtctttgtatgtgtagagtgatacattcagaaaaatgaagtcgtgagaggttgatactcactgatttgaatatagagtactttgccattatttataattttattcctcttaactgactctctaagtagataggaatattggagatacctttaaaaaataactttatagatcatgctcaggggattctatatagcagtttctccttgacataggctggagagtattaagaggaaaaaatattgtggattttcagtttatccttgtgttatgctgacttctgttctttgaaagttagccaaatatttgaaataaatgactaacagttgggatttaaaattgtttggctacataggtttttattgtagttttatttttaccaaaatttactttgttaaaatatggtacattctagcaatactccagggaacatttaaatagttttctgggtttatgtatttgtaagttttttttcaaccttctcttcatgaaaaacttttgtgtttagtgttgttttaactattatcgaagttagcttaaaataagttttattttttgttcatataggaaatagtttttttaaatagaagggaagagtgtagaaggaactcgtagatgtaactatgaaattagctagttaataatctgctagataatagtctgctgtcatatatttattcaccccagtggtaacactcagttttcaggaaaatgcctaaaatgtcagctgctgtttatattgtacacttgttccactaaaattttaagttccaagaggttagggattcttgtctgttttattcaccggtgtctgtataaatgcctagaacaatgcctggcacataatgagtactaaataaatgtttgtgaaataaatgaccaaacgtatgtaataaacgtatgtaatattgattataaaatgtggtgaatatttgaaggacttttatttttttttcttatggacaatcataggccacttataaattaatgactaaaattactgaagtaaatgctgaggaacttaaaattactttgtttctatagcggctgtggacaaattgaatgtaattgatgatgatgtggaggaaattaagaaatcagagcctgagcctgtttatatagatgaggtagggtccctcttttgtttaatagttaaactatcaagacatttaaatgtactatctttgagaatgcttggaaagagtaatttcatatttactgaagttaaaactcttgagtttttgaaaagtgtcctgttacttttttaggataagatggatagagccctgcaggtacttcagagtatagatccaacagattcaaaaccagactcccaagaccttttggatttagaaggtacttagtgaatattttatattattttaatattatttaatattttagctattcatgatgtcttcagtttcttctgccttgtatttgcctctagaggttagaaatctccggtggggaacagactagtacagtaaaatagtaaaagtattacttggaaggcattgtcataaacctgcaaatccttttcataaagcaagtatttgtatttctttaagcccactagtaaaattggctgaagatttttgcagtccaaaaaaggacagaattaaaaataacagtacatcaaattgagtcaaaatgtttaaaatgcttattgctgtttaatgttcttgtattatgaatttaaaggacaaaattatacatgataattgttaacttcataacatagtcaattgatgcatgttgatgtgtcttttagtctctaagaaatgtgagaacaattaaaacgtgttttttatgctttaaaaaaaatcttttgggataagaatctctggtaaataattcttcttaaatctttatatagaagaaacatctggttatgaatatagaatacagcgttgtgctctttattgtgtcagtgttcacattgggaaatacacagtatgtttaatcttgaaatgtcttaagtaaatgaaaaatcttcatatctgatgggcaaaggttacatagtttatatactgtggcttaagtttgttttagttaactaatcatagttttctagatgtctttaagactttgggataactccagatttcacagtctgtcaacttagttaatagtttcaagaaaacataatgaggtttttattttaaagttgaccttgcttttagtcacatgatagtaatatgtagtagtagtgctgaatagtagtctttctctagcatgagcttaatctgtgtgtattatgcatagtgttgtatattggtgctatattgttaaaaattgttgaaattggcttaaactggattaagtttctatatttgtaagtatttttgtatttacagatatctgccaacagatgggtccaatgatagatgaaaaacttgaagaaattgataggtgagatttttcgtgcaaggaataaaaagtatagttttggggggttcacttgtgttttggcaaacagtaaagtagggaaagtttttgtggaactgtacaattcatggaaattgtttttcagtttcccaggcttttaacaaatttatagcaaggtggtgctttttatcttgtttttgtttttctaaaaaacaagctctgacaagttttattaaataaaaattttgcatggcttacttttaaccagtctgttctagcatgcttctagtgatattagaactgcctggatcagtgatagccagtgtgcctactctctagtattttctgcatgccgtgcccatcattgccactgtagtgatggacagcagttttggccaacattgtatagcactctatttcagatttcctcaaagctggacagttttagtgaggatgaccaattttgctttgccttttctgatcatcttcagagtctacttttaccccagcacatactttccacttttcataagttggagcctagagttaatcaactccactgactttttcctctttgagaccatcctgccttaagtccaggagggtccccaactaagagcagctgccaagatggctggggagcctggtgttttttatttaggtaacagttttctggggtttttttggagattgacttttgctctgatgcccaggctggagtgcagtggcatgatctcggctcactgcaacctctgcctccccggttcaagcaattcttctgcctcagcctcctgagtagctaggattacaggcgtgcaccaccacacctggctaatttttgtatttttggtagaaacagggtttcaccatgttggccaggctggtctcgaactcctgaccttgtaatctgcccaacttggcctctcaaagtgctggaattacaggcatgaaccactgtgcctggccaagaattgaattcttatgagaagtggtacttataaaaattttaaatgaaatttctctagtgtttgaagctaaatcacaccttctcttttcatttcttgtccttgtatttgtttctattgctcttttaattttatcctacagagttttgtttttctttttttcttttttttttttttgagatggagtcttgccctgtcacccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatcgagaccatcctggctaacatggtgaaaccccgtctctactaaaaatacaaaaaattagccgggcgtggtggtggtggcctgtagtcccagctactcgggaggctgaggcaggagaatggcgttaacccaggaggcggagcttgcagtgagccgagatctcgccactgcactccagcctgggcaaaagagcaagacacggtctcaaaaaataaataaataaataaaaataaaataggagcaacactgaagggggtagactttcagggttttgagcttttaacttggttctgctcccttatttctcagctctctatctgaagtcatagggagaacctgtagtgaaaggaaaacaagggatagggcttagtattccatcatcatccctttctagtgatatttattgaattaatatataagcagcacaagaagaaaagattagataggaccaaaataagaaggagaatataaactactt

SEQ ID NO: 14966 - DNA, 9119 bp, Human
agattaggaagtcaaggggttgtcacagcttataagtgagaaggcaatgcaactcctggctccatcacttaccagctgggagacttcgggcaagttatttaacctccctgacccttggtttcctcatcagtaaaatggggataatggtacatacttcatatgattgatgtgagaattagagatcatttacgatatataatgatgatcacatagtaggtgaccaattaaaaagaaacatattcttatcaaactaagatccatgtttctctacacagttctttctaattctaattctctatacagtttttcctaatacagggggaaatgtactgaagtgatccaacctccatctcctgggttcaagcaattctcctgccttagcctcccatgtagctgggaatacaggcacgtgccaccataacgggctaatttttgtatttgtagtagagacggggtttcaccatctctggtcttaaactcctccactgaggctggtcttgaactcctgacctcaggtgatccacccccctcagactcccaaagtgctgggattacaggtatgagccactgcgcccagctgtgattcaatttagcatcaccaatctgacattttatgcttcctggggtgatataataagagttacacagcatattttatgaagtattctgtcccaacaatgtttaatttaaacctaatccagcctctagcccagtgctgtccaacagaattttatgtgaaaataaacaataaataaaataaaaataaataataaagaagtgttctttatatgcactgtctaataaggtaggcactacttacaggtagctgctgaggactcaaaatgtggatagtgcaactgaataactagatttttaacttatttagtttttactaacttaaatttaagtagccacatctgcctattgtctaccaaattggacatcccagctcaagatttactttctaatttatagaaaatacaagggctagagccacaaattaaattatgtaaaatgtagttttaaaatccttaggacagttaggaaaattgaatctgagatgaatagtaagtggtgctttggaattattgttaattttcctgaataagaaaatagtactctccttattcttaagaaattcctgctgatgtatttaagggtgacatgccatgctttctgccactcaaataattgggcaactgtgaaagcaaatatggtataatgttaactgttgaatcggggtaaacaggtggagcatcaatgcatgtgtgttgtattattccaattttcctcaatatttgaaagctttcatcataaaaaagataaaagacaaatatttaataatctgctgactgttcccatggtaggaaaagtgagatggttttcagctgccaactgaaaaatctggagatggggaaatccagatttgtgtttcaggagcactttagccacagctgtgatggaaatgagagatggtatttattaatgcctcagcctttcctgaaacccctctccccacatcacacttaacacacaggtctcctcctcccagtttctcccagcacctggcctcccttctcttcccctcgccaggctctactcctccttctcgtcctctcctctgccttccccttccctccccaatgcctgcagatgaaggaatgccctgctggcaagacactttgaagatgaaacatgctgactcccccagagcccaagactgacatcttttacaaagaagagggtgcaggccactcccccattaaagcacattctggagaggccttagacccggctaaccacccaagcccataaagcgcaaattgccccaacatcatcttcacagccaagccccttcagaatctgcgcataaatagggctgcggtgccctgaggagcacattggagtttccatcaggactccaggtcccctatcctgtcctctgcaacccaaacgtccaggaggatcatgacctgcggatcaggatttggtgggcgcgccttcagctgcatctcggcctgcgggccgcggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgggtgtcctggatcacacccttcctgaacccccaccacctacacagccagggccgggcactaaggatggagtcagaggcacaaagacctctgcctgcctgagatcccagtctgatgggcgaggcacacagacacacagacagacagacacatgcacagacacacacacacaggcactcaagatgcagactcagctgacagttcagatagagggagcttgtgaaggaaaagtgtggccaggctgctctggggcacaagctagacatcagggagttgggggaggggggcatgtgaccactgctgctgaactcagaggggtttgggcagccccagggtgagagagtagggtgcactgacttccagatgacacaggggaagggctgggacagctgagctcccttccagatggcctgtgacaccctcttcctggcaccatccccagaaacctcatctgtgatctgaacctgagtactctgcctgtgtgggttgctgatcacctagtttcatagtgagggactgagcctctacttctgttcatctgcttgggtggggggtgggggggggggtcactcaactccccagggagcaggcactgacaccacccagcccttgctccactcctgagtgggaaatctagacacagatcatgaccaggaaatccagaaattgtctgtctcccactgcccacctctactcaatctcagataagctccagatttgggggttcccattaaagcacctcccctgcgagcccccagagctggctttggggcaccagacaccatctgccccaccttcccacaccgaatggcaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtgagtgcgggcaagagggatgctgggcacaggaatggggtttaggttaaatacactggattagacaataagaactcccaggtagggtgagtggccatgaccactagattgaccgagggtggcggggtcttttcctttgtggaatctttgcccagacacctgtgtaagaggagggctgtgactcccatgacctgtctctgtcccacttcagccttctctccctgaaccacatcacccagcagctctcccctgcgctgggtggggaggaagcctctgcagggtccaggccttctctcctgaccctcagcccctatacttgtagcacctgtcagatgtgagcccagggtctctcatgagtgacaggtcttgggctctgggtgtcgcactgccttaggttctaagtcctgagggtctgcgggtccaggaggccccatacctgagctgggattgataccagtgaggggaggctagggctacaggccctgagagtccacgctgtccactcccaggatggggctgggggctgagtcctatttgcctcctgggggacctcagagcccctttgggaacaggactgggaggtcccagatgagcactctccatccccagttcaaagtggatagagaatcccagacacatcccacatccaactagaaagcactaagctaggctgccaggccggggctgtgtggaggtgtttctagtactgtccccatggctgtgatgaagtgtgatgtgatggtggctctgcagagacctgccctgccctgacctcccctctcttccctctgctctgtctcaggtatgaggaggaggtttctctgagagcaacagctgagaacgagtttgtggctctgaagaaggcaagtgacacaggattgagaagcacagatctgtgggatctcagaatgacagattcttcctggggacacacagggggtctcaacctcagcgtggggcacaatgacctttccacagcaggctaggactgcccagatgcaggcctttgtattgagcatccagggccttgacaaagggcaatgacttgggaatatctaccagcacctaccttgggcaaggggatggctgcactgtcctctgtgtgtcctgctctgttccagaggttgtggtctattgctgaggcccctggagccatagcagatacaatgtctctgctgagagacagtgcagtctgtctagcattttggggagtctgaccttgaggcagagacacaatcccagggtctaaggggggatggagaagaaccaggagcagccactgggctcttggagcacttgtgggggacaggaaagggtcagggtgtgagagctggggggtcagtctgggcaggcttcctggagcaggagatgagagaagggagagacaggagggcaaggaggggtgaaaggctggtgaggcatggtcaaggcaaacagggtttgtcatcagagggacagaggatgccagctcatcccaggaagggcagaaggggaggaaaggcatgggaatgggacaccagggactgctttcccctggctacatggaatggatgggcagagagaggagtctgggggctggatcaccagggtccttgagctccaacactccccacctttccaggatgtggactgcgcctacctccgcaagtcagacctggaggccaacgtggaggccctgatccaggagatcgacttcctgaggcggctgtatgaggaggtgcgggctcaggggccagacagaaacctggcagccagcagagaggagagttgggggtgggagtgttggacaggatgtgggtagaggttgcagtccctgaggctgtgtgagggggcagggttggggaccagagaaagcctgaggaggtggagtcaggacatggtgggtggggctgtgttctcaactaaagtcactgccctcacctcctgcaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaaggtgagtggcacaggacacctgcctgctagacgtggcagtgggagggatgtgaggtatctattaaataggcttccttttctggggatgctggtccctagggatgagaagagagggctgccaatctgaggttggggtggcagggcaggactgccatgtgtggctgcacaggctgagcactgtacaacctgcaaaatcatctgtggtgtcctgaatggatgggaggtcccaccctgagcctcatgagcatctctacttcccccagtgtgaggagatgaaggccacggtgatcaggcacggggagaccctgcgccgcaccaaggaggagatcaacgagctgaaccgcatgatccagaggctgacggccgaggtggagaatgccaagtgccaggtatggggcatctgtgcgcaaggtcagagagaccgagggcctaaccattgtcacacagcctatgtgtgccctacctggatctcagcattcattctccgccccctttgtccatgtagagtccctggtcgtggtctctcaatgagtcccaggtgataaaggcaagaggctctgttctggggtgctcccagcttggtggggagtgtggtctcatttggatgagcatcagagagacccagggactctaatctaccttgttctttctgttctcttcagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggtgggtccaaccaagggtggcccagaaccacccttccccatccctggcacaagcctacccttggccttggctgagcaatggccagggctctgggggaaaaaaatattattattcacttccggtgtggggagggctggtgtgtgagtttgtctgaggcaagctgttccctcagactctgttcttaattgaccagttgtggaccctaccctatgaactggggagctttttcagccactctggggcagtcactaatgttgcctttttctcttttgccctcaggctatgtgaaggcattggggctgtgaatgtctgtgagtatttggggtccagtgtggacagatttactaactacctgtgatggagggcagagtttggaaaaaggagtgttactgagattgaatataaaagagtgggctggcatcacaacaggagggatttggggtcagacatccaaaagaccccagctcttggactagatggacctagaattgtccacaaagatgcttctgacttttcataccagagctcaggtcttgggcaggggcggttgtcaggaaggcaggatggcttgcccttcagaattttgactcagccttcggggttcacaggtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcgtctttcctgccctgccttgcttggcccatccagtccaggcgcctggagcaagtgctcagctacttctcctccactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaacctgggtcttgtgtgtgtctctattaccctcctcaggggtcggggttagggagggtccccaaagtcacatggagcagcaaaaggccaagccaagggtctccagtacagttttctatccctcgcctcatagaaggttcagatttagccaagagttgtgctaggcccctatttgatgtaactttatccacacaaccctaatgatacaccttgcagatgaagaagccagaactcagaggcactcaataattggggcagggtcacccacttagttgggtggttcatctggggtttaagccctgtgtgtgtcgctagtgctcatttcactaaactgcagctgtctctcagaaaacatctcatgcatatctgcaaactgatggatcatgaaaatcagattcaccaatcactcaaagcttgaggcaacatcacccattgctttggtagggaagactcatgcctgagtaatttattggaattctttaagaggtgaatacatgaatatgatttaaagtttcaaaaagcctttgatgttggctttctttttttttttttaaatggcatcactctggggttttggagacctgccacagctgatacattttcctcaaagacagaaaacagcacatagcaagatgatgtggcatagaggggggacacggactccagccagactgtctgggccccaagctgggccctggtccttcctaggtgagtgggttgggcaatgtatttaccctctctgtgcctgtttccacacctccaaaatgaggatgatagaaagggcaaccacctcataagttgatgagttaaaggatttcatatacgtaaaaggtttagatggtgcatgccacaaaattatcactctattttttatcattagtgttattcttttgcagaatgtaaagtagaagtccctctagggatcagggcctcttatggccaacctcttattacattgatatctgtgatcagagattgcaagtacagagagaaacctccgtggttaccagggccattcagctccttcatgcatggaagtattaacttgacactgacgaggtaggggaaggggaagatgacagctcagccccactatgggccaaggtgactccctgaacatacatctttaagccggagtgaatctctaaacttccagtccaaggcccagaaaatacagcagaaatgggagtcccccacccctacccttctgggcactagaaattattaagaatattaagagaccagaagtgagtggactgaaaagaacaaattctcctgtaaaagctagaatcaaaccaaggtctctcagccacccctgatggaattctgagagggacacaatcctagaaagttccagaatttgtgatcaatcattccaaccagccctgtatgctgtgacgtcacacagctcagaagctggccctaggccaggtgcagtggctcacacctataatctcaacactttaggaggccaaggtgaaaagatggcttgagccccagagttagagatcagcccagacaatacagtgagactctatctctataaaatataaaaatattagctgggcgacgtggtgtgcacctatagtcccagct

SEQ ID NO: 14967 - DNA, 19990 bp, Human
  misc_feature (1)...(19990): n = A,T,C or G
tctggagatttcatcttgggtgaaaaatccatggcccagggaggggcagtgacatgtccagggcctcaaggcaacagcagtgccctgacaaagatttcccagccaggctttaggggagaagtggatgcaggaactcctggtctaggtgggcacagcctccagagcgcagatcctgtagggggctggagatggggacggatgagagggccagaggcagaacttgttagtggaggtatgggagagcaggcgttggtgtgagaggcagtggtaaaaacagagttgaagatgagccctgaggggtgaggaagttggagtgtgtgtgtgtgtaaattaaacaattggtcttttttgcctgcttgggcgttggggaaggagggcagtgagattcctatgaatgcaaatatcacaggaccaggtaatccgtatgctcttcaagctacaaccaggcacaattccaggtcgaatctctctcggtcttatgcacacatacatgctccacagccgataccacagcaggtctccttgggcacccctccgcctctggcctgagctgacccaacaccaatggctagggtcaggaggggaggcagggagggaggctggtgagccttcactaagatcactgagaaggagtgacagtctttagcctcactggaagtcgttgtgctttaactgaaatggccaagcaggaaggacattccgtccccacccttgtctcccccaagggcttaggtctgaggtaacgaacctggccagcttattgggaggggctagaggtgggctaagggcagacggaagccaggcctgagaacagggtgtggcaagcatggctggccctaccgggaagtgaggccaacactcaggctttgtccggtattctgttccagcactaggattacccctcttgactgggtttgaaactgctgggaattgtttggtggtggcttcacgggagaaagatgatgaaagctgagggcctttaaacaggaaaatggtggagggagcgggaggagagttgagtgctaacagaagcacacgcactcaggcaggcatgaaaatgtgtgccattgtgtagccacagctgccccctcgcccaggatgcacgcacagacccccatctgtgtaagcaggctcagacatgcgggtgcatatgcctgggggtgtgagcacagcagagcccagaggcctgcaggcgtgtgcacacatccacaaagtgtccacacatccacaaagtgtcacaaatacacacaagtgtccccttcctgtacagggacgcataaaataaatgggcaggaatatgagtggagggtccgggaggtgagggtccagggtaagcattcccaaggtccctgggattccgatgcctactggagtggggaggggaggagccagaggtgcggtcggtcgtgtgtctctctcagcctagtttctatgggaaatgaagtaggaaggaacgcagccagggaaactagctgggccaggaggggtcagacccctgaacaagtgagctgatctctcaaggaggagctggatcggtgtgagggagagcggtaaggaatgcctttctggcttcagcagcctggaggatggggacgtctgggcgttgactcctgggttggaacttttcagcccaccccttcccccagtctcttgccactgggtctctctgcttgggcctcagggatctctaggttcttcactccctctccaagcatcctcctccgggaagccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggccagccccgcccctacctgtggaagcccagccgcccgctcccgcggataaaaggtgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgagcgggactggacctcgcctctcctcgagccgcgctccagaccacaccagccgccctaactagccctgcctgcgcgcgggccaggcgctggggagcactgccgcccttctgtctttccgccagtgttggggacacgatctgggggtccttcctccttcgcatgaaccccgtggctattttatcccctcggtttccaagccctcccttccagcaagctgcccagctgcccctccctttcctcccggagtgcgggcctgagtcctgtagggctgccctcgctggctgcctgttggtcccctggaccagttttgcctcggactaggagttccagaggcctaggccaggagttctctctctgggaccctttccctgagagaggaccgtgtggagtcaggaatggagttggatggcacgcccttcccagagggggagacccaggctctctcagatgctgatgcggatgcagatgctggagattagagctgcagtcggtggggcgggggaggacttctnnnnnnnnnnnnnnnnnnnnttgctgtggcttgaccagagtatctaaggaactagaggagctagagcataagtgcgaggctccccgaaagcaactgccgagataaagcagactgaaggcaacagagacaagattaaaacgaaggaaacacagtgccccacggcacaactaaacctagagcgcgggggaaactctaacctaactaaaaaaaacgaaagaggaagaaggggacaaggggactgcacagcagaccgccctcagaactaaagggcaccgaccaacaagggggcggcaagaagaacagagacgacaaacttatcctactcgcccctctctcccccactcccacagcacctacaaacactagaaaacgcacctaacagcaacccacagaaaacagctccggacccaccccggcacgccccacccccaaatctaacaccccaccacacctctcctctcccccagcgccacaactgacacgctcccccaccggcctggtcctccagcctcccttaggtggcaggaggagaggttatacctgcccttgaagacagcccagttgggggcagggagtggcagagagggccctcaaaaaggggtccattttggagatatttttcctggctgttggcctccgccacacatggggccgctggagggggcgagggcagacttgactggtgggtttgggaggagtgctgccaaagccaggaactcagggctggccctgctgggctgttctggccagggcccccttcctcagcttagacgaagtgtactcccacacccgcctccctcacgttctcctttccttcgccattcacccagaccggtcttttagatttcataggggcctccccaagctgctccaggcccaggttcccccatgtgttgagctgcaccgtcttactctctgtggtccccagggcctggggccctgagctgctggttttgcagaggcctctattgcctcccacctccagtcataccggctactccttaagggcctttgtgggctccaggctggggtcattttaccatggattgactgtcctgaggccttgctggagaaaggggaaggagagaaaggatattgaggaaggaagagaagaggtcccagacagaagggagggctgggcctggtcatcctcatgatccattgacaggaagaggtggctgttcagatagggaggtggagaacaccacctgtaatgtgatggggagtgaagtggagaggaggccctggagcacattcgtcgagagtcaaccacggggcacttccgtgcaccaggcagacctgcttcctggatcactctgtaggacacttgatttggagtccaaagggagagggctggaagccccaggcagggaaacagccagggggagcatggctctgctaagtggctaaagatgatgttcctcaatcccgctgtgggtggcacgctctggctcctcttgagtttcctccttctcgcccgttctaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtaatgccccctgtgccacatgcgaagacccctgccccgggccaatgtgaccctcatgagctgaccctgtgcaagtccccctgcttcaggaatcagcatgcagctgctcagtccaataactccctgaggggccagtcttgaccaacacatttcctgcctttcctctctcctctttgtccctgggggctgtttccaaatcattctggtcttttcccctgactcagtcccagtgaaatgtctcagcccagccctgacctgcactgtctcctttgggtgtctgaccaaggccccgagagagagtagggcagaaagtgtcttctgacaggggtgcttcagaactggtatgaccttcacagattattctagagcaactctcttttgttcaggtgaggaattagagaccagagaagtttagggacttggttgagctcacactgcaaaggtcactgggagagctgggacttgaattttaggtccctgactcctaggagaggacacagagccaacttgggaagcaaagaagcagagggggaaaatggtcattgtgagccatgcgagggccgcagaggctgagggtgggtctggtcatggcaggagccagaaggaggctcaggaaggctgggactggggcttttgaggacaggtctttttgcactcttttctcattgaatagaaacaaaagcctgaagctcaggctgggccccaccctggcacacctgaggggcactggggcagtgagtgagttctgtcccctgcctgtggctgtgtgactaagcaggagtcacacattggctctgactggaggagagcaaacaaggtctctgtggagtgccccccccccaacactcccacttccctagggcaaaagtcaacaggattagtcccatagcaggtggaaccagacaggtgcagagtagggaaggtgtggggccatcattcagcccctgttgtcaggactaacgtgtgtgcatgcgtgtgtgcatacctggtgcccacccccatactccccccaccccaaaccctcagagcaccttcctgtggagccagtctgagatccaggctgggactgaaagaggaactggaagggagtccagggaaggagtacagggagggtccctgtgtgcagctgctcagggagttccgatctgtgcaccctcttgacctggctgtgcactgccaaggcaggggtggacggaaagccttgcagatattttccagcttctacagaacttgagggagtgcaactttgagggtatgggcacctccaaccctgagtctgggctcctgaaggggcttggcctacctggatgtcctgccttccaccccaggttgtccctactgcttccagcagctcttggaactcttgtttccaacacctttttttgagtctcaacataaacattagattaagccattgtggtctcttcctctgtgccttgtttgcccaggtcctcctaagggccaggagtggctccttgggaggaagagtgatgggagctatgggaggaaggatgggggctggatcatcaggcgggacctggttctttcaggactttgtgtatccctcatcctgattctacagggttcctccccttcagactccttctttgcccctgaggggtgggattaggtagtgattagggcatggctggagtcagctgccaaggttcaagtctgggctgtgccacttagcagcttagtgacctgggcagattacgctgcctctctgtgtctctgttcccttctctgataaccacagtaccatcgttataggtttgctgtgaggatgaaatgagctcatgcataagaagcacataatggtgcacaccccatagaacacagtctcatgcatatggctgttattatttgctttttttctcccaggacatgcagcttttgtgctgtcattcacatgtttcctatgtgccccaccaacaaccccccatgccaagactcaaagccctaggaatggccgcgtggaagtcagggaaatttggttttgtagctgacacctgttttttcaggtgtgtctttaaagagtaggggaagggaggcagggcagatttcacagctgcatatggcggaggggggatgggagcatggaggcaaagctgcatcaacaccaggccctcctctactgtaggtacgaagatgaaattaaccgccgcacagctgctgagaatgagtttgtggtgctgaagaaggtgagtgggaaagacaggctcgaggagggttgtctgaaaacatatgggacaaaggaccacaggatcctctcacctgagcagcccatggggacctctggccaaggcctgcctgagctgtccaagaggaagtctgcacagcctgtcctgtgggtgcgtgtatgtgtgtgtgtgtgtgtgtgtgtgtgtgtgtgtgtggtgactgattagactcatttctaggcctctaggggttagaactaagagcaaaggatggaggttatagagggagatttcaacactgaataaggagtgctctattcaagccagaacattttcatcacaaaggtgttgcttggctggcctgaaatgtttgctgaatgaatgcaatgagctgcctcgagccagcatgagctctctgttcctgcagatgtgcaagcttggaacgccttagaagtatcttaggggtcttgtctacatgccctttaagattctcttcaatacactgagcagttggtgttccaggccaaaccacagaattgcaacttgcccctgggagctgggcccttggagattcaggaatgagtaaaagtgaggcctgtccgtaggagtttaagcttgagaaagtgcagctggaagaggctcagacaccatcttcacctggggtgttatctgaggcccacctgcatcatagttaccatgctgcaaattaaaaacatagcttggagattttccatctctgggagcggggctgggaatctgaatgactttgtgttctgctactgactgacgaaaagttgagctcccagagttgaagtgatttgttccaggtcacacggttagtaggtggagctagtggtgttgaaaccatctaggtctttaggaactggtcaagtgctaggttggggcttcagttgctctgggataccagtgctgatgcccaccatgcagtctggagggtcagcagggcaagcttcatgctgtgaccatgtacagcagctgtagaaactgtttctgggtagggcagtagtatttggcctgtgggttggacagggcaggcctgcttccacccctactaaatgttccctgtactgaggacatggtctccctctgccccatcttgccccaacccccaggatgtggatgctgcctacatgagcaaggtggagctggaggccaaggtggatgccctgaatgatgagatcaacttcctcaggaccctcaatgagacggtgaggaccatggagctgggtgacatgtcttatcctacccattctaaccagggagccatctggtccagccccccgcctctgtgtcagtccagatatgtgtcagtgtgagaaacaaactcatccgtccaaacccaaagaatggactcagagacctggagaacagcgaaagtgagattttaatgacagtcttgcaagatgggtgtctgatgggcaggcatgcccagcacagccacaacaagcaatttatcctctagtgcacaggtccctccctccgttcctcacaggctgagtactatggggtcacgatcttcctggacgttgtctattggttgttgggttggggctttaggtgtttttttttaggttgtcttgctgcattttattgcagcctacaatgcattgcaatcctagtcagctcaagggctctttaagtatttgacttatgacctaagtagctgggcaggctgataagaacagaaaaagtgagccattttgcaggctagaaaaccttcattttagactaaacttctttggttcaggtgagggcaagagaagctgggggctgacaagcaggcactggctattcaagcaaagggctagtatatcctatttcttctgtagtttgctgacctaagccaatttaaagcactttgtcttggaaatggaccattatatacattatttccttcatcaggggttgcgaggatttatcctgccctttatcccttctggactcaggaattcaggacaggctaaggattcgggaggaggtgggggtgagtcaatcaggattgaccttggagagacatgggatgatcgcagcatttctaaggaagggggattgggtgggactggaaggaaccaggaggaggtcaggggactccaggttgtgacagggttcaaaggtgggctaggtagggccagcaggggagcccaagtcaggagagactggattgcctgagcatttactcccagaggggctgggtgggtagctgcctgccaactcaccactctaatgtcctcccttcccttcttattctctccctctcacccttgtcctccggggtttccagctctttttcttcaaggggatttaaaaatctctccactctcatcagtgtgagtctctggccttaggcagaaggtagggtggccagtcacctggcagaggctaggctgggcataattagcttgtgaggttaattacaaaccagttcttcagcctagtctttgcctgaacgtccagtctccaccagcccctcagagcaaatgtccacagattcattaatttcaggggaagtttctttgaggcttgcttcaggcacttctaatctcaggtcttcctgggtctatcacatggtttatttatgtgtaaacacacatgtgtacacacacacacacacacacacacatatatataaagttttcttttcatggtgaaagtttagtttatttatgtgtaaacacacctgtgtgtatatatataaagttgttttcatggtgaaagtaatacatactcattgcaaaacaaccaaaaaattaagtaaatcgtaaattgaaaatggattacttggccaggcgtggtggctcatgcctgtaatcccagtagtttgggaggccgaggtgagtggatcacctgatgtcaggagttggagaccagcctggccaacatggtgaaaccccgtgtctactaaaaatacaaaaattagccaggcatggtggcgggtgcctgtaatcccagctacacgggaggctgagacaggagaactggttgaacctggaaggtggaggttgcagtgagccaagattgtgccactgtactccagcttgggtgacagagcaaaactctgtctcaaaaaaaaagaaaaaaaaaagaaaatggattacttatacccaatgctaccatctttgtgtctacctttccagacttttctgtgcttacatatacataaagatatagaaatatacattttcaataaaaatagcatcatgctttattttaatttttattattatactttaagttctagggtacatgtgcacaacgtgcaggtttgatacataggcatacatgtgccatgttggtgtgctgcacccatcaacttgtcatttacattaggtatttctcctaatgctatcactcccccctccccccacgcccccgacaggccccggtgtgtgatgttccccgccctgtgcccaagtgatgtcattgttcaattcccacctatgagtgagaacgcatcatgctttttttaatgcaacagtataccatgggcatattccccacaggtagttggagccatatcatcggtgtacagactgcagagtattctgtagcatggtggaatatgataatttcatccattccccatggcctccctcacaatagagctcgtgcacctacagaacctcacagtgagaagtcaccacagcgcaccacactgtccctttccttatcccctttaaccctgccagattctcgtttgagacactgctaatgggccctcagggagccaagggtgggcagaatgaagtaacttaatgtgtgctgggtctgggcccccttgctgcctggtgactcagcccactcccagctgttctctcttttctttcctttgtgagtggggaatcccagggtgggcgtgggcataggatcctgccctaagtcctgatgtcccgtctggtccctacaggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaaggtgtgaggccaccaggggcgtacttcctcctgccagggtccttggtggcagcttcccttactcctcaacttgtctcaagccttcagggcctgggtcccactgttctggcaggcaccagtggtttaagtctgtggtgctcagccctggagaaaatcccaagatgggaggacagggcagaggaaatagatatggattaatcattataatagctaaaatatggcaagtacttacacagtactaggctcatgtaattattgactcatgtaatccacagaacagccctattagataggcatcattattacccccattttgttttatttaatttaatttattttatttctattttttgagatggagtcttgctctgtcacccaggctgaagtgcagtggtgcgatcttggctcactgcaacctttgcctccctggttcatgtgatcctcgtgcctcagcctcctgagtagctgggactacaggtgtgcaccaccatgcctggctaattttttttgtattttgagtagagacgaggtttcaccatgctggccaggctggtctcaaactcctgacctcaggtgatccacctgcctcggcctcccaaagtgctgggattataggcgtgagacaccgcacccagcctattacccccatttaaagatgaggaaattgaggcacagagaggttaagtaatttgcctaactgcatacagctagtagatggaagagcagggactaaatcctgaatgtgagggccctagacctgggaggcttaatcatcacatctacttcatggtggcaggacagttgatggtgcaggggctgagggagcaggagtgggtgctggggtgaaccagtgttcctgaagaagggatcccgaggcaaggattgagaggtctgcccctgcagagatagagagtcattcatggtgcctgggtgagaacacaagtatgccaacaagaagacctgggttcaggccctcgttccatcactgattggctgtgtgatccctgggtggtgctttctcttctccaagactcactctcctcacctgtgaaatgggtgttctgggtgttgaatgggtgcgaatctcaaactctcagtgattctccagcagaagggcatggtgggagtggaagagccctggggtccatggggatgggactgcggagccttgtctgtcctccctgcctggcttggaggagaatgaatcccttcctcacactgctgtctggtctcctggcatcgggcaaaggttgatgggagtcagactgtccttccctgaaaatataagttgggaggggccttgggtggggagagggatgagttacctgtactcactgcccatctctctgccataactctctgtatggcccctccagtttgagaccctccaggcccaggctgggaagcatggggacgacctccggaatacccggaatgagatttcagagatgaaccgggccatccagaggctgcaggctgagatcgacaacatcaagaaccaggtgggacaagtcctcctggcttcccctgctacttggggcatgcaggggtggccagctgaggccaaactcaggatgtggagcaggaggttcccatctcccggccaaagctggtgccactgtctcagacccccttgtgagatctccagcacagaatgttcttggccaggtcctggcatgggctgatgggagaaaggtcctggatgtgcacagagcctgtggagggagactcaggctggctggccagaagaaagccaccactggttccacattgatactgagcactctgcttgcacctggttctggctgcagggcgctgtccctgggagctcatcattcattgcagggacagaggacagcagaagaccttataatgactcacatggccctttcccacccactccaacctcactttccacgattcccctcactctgctctggccatgctaacctgcttcctgcatcttgcatttgccaagaatggtcatgcttcagggcctttgcacttggcgttgcctccccctggaatgtggttctcccagctctgtccatggttgttgttttctcctccctggggtttaggaaaagaccccttctcagagacggcactctcaaacaccagcccctctatcggcagcctgtctgaagttctttgaagcccctgtcactctctgaaatgttctgtcttattcattaagtgattgatggtccctacctccactggaatataacagatgcctggagagcagggaccctgtctgtctggttcactgctcctctcttccagcacctggcacatggcaggggcacgggtctcagatgagagactgcctgggaggatgagctttgctggaagctggggttggaggtgttgatgggggaagggcccccagccctggctgagtagtgtgtggccagggcagctcagcctgtgcaggtgtctgcagtggagagagggggagggcacacatgtggaagcttcggaaagctgatttccagatgagctgtgggtggtggggggatgtgagggtgatttacccacaaatgtcctccccttggagccctgtgggcctgtttacaggagggcggaggctgccttggggcacagaggcagggccgtgagtcaccccatgaagtgggccagcttccaggccaggaggggaagcacagaataacaaatggtggtttcccaaaccctgcagcctctactacatccggttctcctctcacacaacagggcggatccaggcctatagccaggtgtctaccaccactgaggggcgtcatggggagctacaaggggtctccagaggcagcggggatggcgttggctctgggggcaccagtgtgacagggcagggcaccgagctgtggccgaggggcagagtgtcagagggcctcctggggaatgctgtctctggcagagaggcagactgcctccactgagggaagaggatctgaggatagagaatggccggtaagaagggagagaagtccttgcccaggggacagggatggtggttttctgagctaaacaagatgaggcctgggactattcaggctcctggcagtgggggctgagcctaaagcagagggcactctaaggccagggagaaagtggcagctgctccaggcaggcacaggtctggaaccagagcatccctgaccaaacccggggactgtgagtcatgcatctcatggcatctgggggcatctaggagggtctctctgctccaggccctcctattctgcgcctgctctcaactggttcctattttataggtggtttctggtctttgtcagctgcctgacatctggagactcaattaagatcccatggtcttcgagctcctgcagctgggggctggggctgggggactgggggtttgaaaatcataatagcattcattaaaaatgatcacaatagcatttattaagcacttgctgtgtgctagacattgtgccacggacatcttgtatattatctcatttcatcctcaaaatctcctgatgttctcttagaaaagaggggactttggcttagcagggttgattcatccatggtcacatagctagtaagtggcagagccagaactggaacataggcgttggatatccaaacctatgtgtttaacccttaggattctctggtacttgggggagtaggtggtgccaatgaagccaccttaagcaagttgcccgggtgctcactgcaggatgggcaggcaggaaggcagactggtgagccccagcttacagctgcactgctgcccacagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggtgaggacaaggaacctggaaaggggatgcttctagggctccgtggggtttggggcttgacattcatccatttacaagcatttcctgtatgcccctcctctgcagggcactgggtgtggggatgcagggaacacagagctgatgcttgcctctttgccttcaatgagatgaccttctagaaggaaagaccatggagtgtgaagctcagtgggcaggttgaaatgataacagtccctttgtgtgtgcggcttcttagggttatcatatttgatcctcagcacacattcaggtagtcaggtcagagacgattgattccttagtctccagaggggaaagctgtggttgagtttcattaattgagggaatagggccagagtgcagtcagggtgtgctgattcctgctccaaggatcttccaggacgccaggctgcttctcactacagaactaagtgctacatcatgtggggctaactgactgtggtggagggggatcgttttgtttgtccccagagatatttgcagactcacttgcagtcagagaggaggctggaatgggggagtctgatagcacattcttcatgaaccgcatgccacctctgtctatgcagctgggccttcatgggcatattgttgggttcgaactcaacctcttcattcttggcttgttataagacaccatggcaacagagaatacgtaggacatgtttctgccctcagggaggttgcagagggtggaggagacaaaacatccacagaggaaacccccagagaccagtaacttacatttgtaaaatgctgagtgtatacaagaacttattcttttctgagtattattcctaaggggccagagagagacatgacggaggatgaatggagcagcagggaagggaatggggagtgaaggggtgctagggccgagggcctgggtgctgggaggagaagaggagacacagggccgcagggtatgagtaggaggcggagaggaggaggaaggggctttgcccctgctgctgacccgccttctccctgggttagcacccagtcttctttgtgggaagaagaattaacaccaaaagtctctgggaacacagaagctgatctgggcacagggagctccagccaagatgcctctctctgctttcgcctctcccacaggcacagggcccccaaattctctacaacccataccctgggccttctgttgtcatagaagtcagagttgggggactcttagagtggtacctgatctggcttcctcccatgggaagaaaaggggactgaagctcagaaatggtcagtagtgtgcccaaggtcacacagcacgcagagacatcctcttctgaaagcttaatctcagtctgagctgctgtaaccaggcttagatccgggtactctgagaggatatggttcccccaaccctggggggatatggaggtagataccttgcttttatctcttaacttatcagagttgtggtccagaaactcattcaaactgggaggcctactttaagaatacaaagttaccaaaaaaaccccacttacttagaatgagaaaagtcacacagatcactagagccttggacattcaggcctcttccgtctgagttccttaggcatcgtaccagaaattcttcgagttgctgcctgactgcaacctggctccctctccccacccacaagtgccagcaactcccagcaccagcaggggccatttaagcaagccccctggaagctttcagcaaacctctctctttccctcagcctttgctctgcctgcttcctgggcttggggccgcagaggccagcgaggctcccttcattccctccaccaaagtgaggtcttccctgcccccacagagcaaactgatccccaaggccaaggccttggtgacaatgggactgtgagtcacaaaacaaacatagccagctgtcccgaatggatttttaatttctactgcaagacctgtttcagccccactggctgcttaaagccacccccactccctgctccttccttagtcctggctggagccccattcaatcagtcaacgattcacgaattattttgacatatattaagcaatgacttctccaggcctcatactggggataaaagtatcaataggccacagacacctttaggattttatgatacggtgaggaaaggcagccatctacataaataacacatacagctaccattcaccgaatcccaggtgctcagggctttagacagattatgtcatttagccctcacaggcccatgaatttggtcctgtagttgggcccaagacataggtgggaaatggaggccctgagacattgcctggggtcaggtggccagtggatagaagggccaaggtgaacactcccttcctgcatgcctcctcgctccttttacaaggctgaaggcaggctggaagtgtggggcaagaaggaaaaatcaatgatcctgcttggggcctggaaggagagagggctgagagcgcttccctcccacgctaggaaagagccgtcctcactgtctgtcctctgcccccaggttggctggagatggagtgggagccgtgaatatctgtaagtccttggctgcggcccatgggaagcatcccttgtgctgtttagatggggctgggtctagagaatggcagactggcccagggccctgctggaggggccaggagactccttcctttctacagggattgacaggtcccctggagcacatactgccaggctcaatggcctgggaagcactacaagagggcagggtggggccaggagcacctggggagcagccctacccctgtcagatgctccttctgggttggcccatggaggggggcaggggtgagggagaggggcagctggggcaggagggtggggtgcagtgaagggatggggtccctggtagggagcctcacgctgaagagagccctcctcttttctctcccagctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccacgtgcctggtatcctggcttcatgaggctgggcaggggaaaagacgggactagagaaggcagggtctccctggtgactaggaagccttttgtgcaggagactgagaaggcacatggtgggatggggtgctgctctaaggagcaggacgcttacctagggtgagccttggcctccaggtctggggctgatcccaaagattctcctgaggaagcccagaagagccacggggaaatgcaggctctgccagcaattgggccttggagggctgccctgctaagggggtggaaaggctgtttgcctccctccccccatgcccagagctgccagagcacattccttttgtgaggaggccacagacgttcagctgccccagcttccagtttcgggtggcccagccaactttcatgccagccgtcctcagcccttcctggtgctgggtctgccaggctcatggtcagccaggcctggggccctggagaggtcctctgcatcttgaattctgtggaggtagtggttgtgggggggaggtgtgtgtgtgcatgggaggagggtcctagagtctagatccccggtaacaggtctgtgcctaggaccttagtggagggatgggtttgtatctggatccatgggagtggggaaggacatctgtgttaagtcagtgcttgatgggggcttctatgtcagagtccccgacacacaggtctgtgtgtctgtgagtgtggcaggtgttctgtggcagggcctatgcatggggaaatgtgtccctgatgggcagcagcacatatgatgggtactgtggagccacagggaggtctctgtgtctgggaccccaggggtgatggtggtggtgtggatgggggagctatgtgggatgtgttggcttctgggaggaagtctgtatatttgaccctatggtcagggaactttcaaatgctgaggtgggggctggggtggagagtggaaaaagtggaccagcagccacagtgatggggttcccacccaaggtgtcaggagatccaggccctctccctcccgactaagaagaccaagtgggcaagaggaaggagagactctcagggcacaatgcatatgatcaggagctttactggaaatgctgagacaagcacaggggagagggagggagccaggcagccaggcaggagaggtggcctgtcctgcacgtgtattagaagacattggattagaaggcacagcaagtccacaccaaggggctccaggcccatctgtccctcagaagccacaggcatccaggcctccggaccggggtctttacctagggctgcgaggacagtcctttagattcgggggttgggagagctgcgggctaggagccctgtgctctcggaagcagtgaagggactagcgggcggggatgcgagacaggaaggcgcggcgtgggggccgatggggaggctgggccccgaagccctccttccccacgtctggggaccgtgggagctccgggctgcctctggaggcagaggctgctgctggtgaggcggcgtcggtacaaagtggggcgctcaggcgaagcgcacggagcggccgctgccgctgctctggccgcagggcgcacacaggccggtgctcaccgccacgttcccgctgcagggggcactgcagacgctgcccgtcaccggccgggagcccgacacgcacaggtccccgcataagaccccgccgcgggagctgctgacacctgccagagggggaggacagggcccagtctcctggcggccagaggccccttctgctcagagcttctcccctctgtttctatgcgcgcccctcaaaccctcacatgggcactccttcctg

SEQ ID NO: 14968 - DNA, 80717 bp, Human
  misc_feature (1)...(80717): n = A,T,C or G
gccattctgtggagtccagggtaaaacaggttttagatctgggttgactcagggctcaagcagtgtccctagagccctgttatttcccctccacttcttcttttgtcagttccatcctcagcaggttctcttttcaaggtagcaaaatggctatggcatatcctacattcaagtataatgagaaaatcacactttcttttctagtagttcctgtaaaatcccaagagtcactctgattgggtgggctcaggtcacgtcacaccctggaatccagtgcagtgtgatgattggttttcaaccacacctcagcatgcagaataggagggggtgtatcccagacccagttcaggagttgttgccgagaaggagagagggaggaactgaggaagcatagagtttctgcagaatgattccatgaagcacatattggggactttcattctcataaaaagagcactgttcttgggacctcatacagtgttgcttggttctcaaaaagtactaagttcttgtgtggtttctgggtaagtctggcatcccccagaagcagggagccagtgattttcctgatgcccttgggatgttcactgcatggtatcagattacagtaggtcataatggatgccatgcctggtagttgtgtggtgtgacattagatcaattagctttccctgtacgccattacatcaaagagtgtcgctggacagctattctcaacatatgttttgtttgtctctgaaaacacgtgttccatttctccctgggccattcagattcattttgggtgactgtcttgtcagcctggggctggggagaggggaggacaggcttcattttggcagtgcttcaagcttggagcagcatcctgcagccagcaccataagctgtataatttgtccatggaggcctatgcattatagaaatgaaaattccttatctgacagcattcattgcttagcatgcagcaatttggctgtcagaaacagctggccctgcagggtgggacaatagaaaggcgagacccgagagaggccagtgcttactcaagactcccactgtgagaggatcaggttactgagactgtcattaacaacagactgcaaggggctctgggcacagcttccagtgagcaggagcctgtggctcagacagtgagtgattttcccctgttttgctgaatggaacaaaaataaataaattaaaaataaaccattaacctttgctgacactcagatgttcagttctgattttgtcttctactgggtgatgagcatttctggggaagtaagtcccttctaacctaagtatagttattggtgcattgcagaaaactcaaaaaggagtggggctgaggggcaggatggattgcttgacacctgcatgttggagggctgtaatttttaggttctacttacctagaaacaatgctgaaaggaccaggattggagaccttatgaggcaggtttaaacatgaagtagaaatggggttgtgcgttctccccagatgtacatacttggaagagccatgcagcaagcagaggagaggaacagaggagctgtgtggcttgaccctcctcggaatctgcagtgtggctggctctgtgtgcttcctgtattgattccatgactcacggagcatgagctaagcagaaagcacacttaaactacagaggagacagctgtctgttacagaaggacatattttctgggtttaatggcgccacatttttcctaatagtttgtacactggggatgtacttactagtaatgtctgctaaagggtctttattgttttttcctttttgaataaaaaagacattctttaaaaaaatcacctaaatattattcttgacttttatttcacaacaggacttcccttctaggaaaacagtaccaataagcaacttgtcactatgggttgtttttttttcccccacctcttgatagcaagggtctatcggaagtttaaagccatgcagcgggaagtaccttgcctttttgaagcgaatagcgtttcagagatattgggcggctcaaggttagttctcctgttggaattcgtttgttgttcagtgcgactggaactgtactttctcctgctctccctctaaatctgtttcgcttttacatgatagaggctgaagttcccagatgttgtttggattaaagagtgtgtgtggggagggggggaaaagctttcttgatgataataacagagtcagactggctggttctgtactgacaggaaaatggagagataaaaactccattaatggtgtgtgcattgcctaagtagccaataaaacaatgctgtcctcactggaagccggtcccagactggcaacgcttcgtgccaactgcaggagacaacagctgcaaagaggggcagagaattcgagtcaagagtccacgttcaatgactggcttgcggggcagttcttttgttctctacctcctcctctcctcctcctcctccttctcctcctacttttgcccattttccttgatgagcccctcttaatgctcactgttccagaaattgaaccacatctgattaaaacttaatggttactcacagaatgaagttggctggtagtttccaagcctgtttgtctgggttgctttgagtgtgtgacaatagaaattgttattttgaataaaatgtatctaagggttacagtccttaaactttgacagaacagtcacttatcacagatgtaccgctctattttccctcaaatatctttaaatttccgtgctcgaaattaaattaaaaaatttaaaagttttttttaaaaaagcatctcattttagaagataatggaaaatggtaaaggcttgccttagtcagctttcattctatatgtacttcctgaacccgttctctgagtgaagctctcttctgtgactgtgggccaggtaaggctgtgctcagacgagacctgactttgggaacttactgcctcatggtcaggtaaatccttcgatctccaaagggaaagaaagacatgctgtttgagtgatttagaaaagcatccctgtaaattcaaaagagagatgagctgattacctagctctgcctctgttacatgtgagtgtaaaatttaaattactttgacttttattcattactatacatggggaagggaaaagatatttgagtgtttatctttgtgccacatcctgtgctatgaactttatgtatattaggaagtaggtatctgtagcctcattttacaggcgagagaaacgtaaatcttaaggagctcatttactcaaggctgcaaagtctgttcttcctgttcatgggtgcagatgtaatgaagcacatgatatgaaccaattcatctggtatttattccacctaattacagtagatatccagaagaggagatggagtgttctttatctaggcccttcagaatgctggtgttgtggggtaagggcacacattacttttaaattctggaagccttataaatcctggaaggcttcacagaggaggagagacattcctttatcttgcagcacacccccttgagtgtgctcactgtgtcaggcaccccggtagggactggggactcagtgctaaagaggacaaagtccttctgctgtcagaaggtggtgatgatttcctggttgggaaagccatgggaagggagaacaagggtgggtatccaagcaccctggaggagatgaatcttgagtgaagtacctggcgaagagctcagctgggagtgacgcttgtcctggtttccttcctgaaatggaggactttgtgtgcagatataaggtggtggataaaatgtgtagggaggagcaataaggaatgcttttaggtacaacctgtgtttcctttttggaaaccccatgtagattgtgagctgtctcaaggttcctggctgcggacttctcactctcaggccacaccaagtggccagtggccacagtatctcaagcctggtttcttctctcatcactaaagatggcaaagtaaggtcacgggcaaaccttgttcttacagataaagcctttatgttaggcatttccaaaaaagtatttgcctcttctgacacagttttaatttacacagcaaagtagagagcctgctctgaggaaatacgactccccatgatgaatattagatattgaatggcctttaacatgtcatgcatgcattactgtgccagcttgtctttttctaaatgtcaggtcgtcactgttaattttatatgtttaaaagatttgggtgaattccaggtataacactttggttttcatttttacatttcatagtagttgaaaggctccatggtattcttgatagatgcttgtctgcgtccatattgatgaagaacagtagagtatattaaattaaagggttgttggctggttgtttggcagtgacttgctttctgttttctgttcactagaggatgcttggaggatgtaatctgcatactggttatcaatgtgaaggtttccctttgttctgtcagtaaaccctactggttaacagatccttgttttcaaccactggttttcagccctactgtggggcagagctacactgcagtgcattgtgagtattgctaagtaatttattattcattattgaggtaaagaaattttgacatacgttggagctgattcagcacaatactctcccatgtgttccattatgtctttcagagtgagaaaaaaatggaactcaaagacaagtcaaagaactgtatgttttagttagtaaaatatactattaagaaaaagaaaaagtgttaaggaaagaaatgagtatcacaaaagtcagcattatggttataagagcatcaataatattaataacttaccctttaatggtgctcatatcatgttctgttgtgagtgctttacatatattaactcatttaattcttaggataattctgtgaggcaggtataatttttaattgaaatttttcagatgaagggaatgaggcacattaagttagctcctgaggccttaaagatagcgcatggcaggaccgcagttctaactggctcagttctgggttttaaccacagtgtaggggaggaagggggcatagtggttgaggacacatgggatgtggtgggatgtggagtgctggcagtttcctaaaaaggaaacatcaggacccttactaaaggttttagttgcatttttagtctatatggattgttttagtccatttgggctactgtgacaaaattccagaggctgtgtagcttataaagacccgacgtttattttacacagttctggaggctgggcagctcaagatcaaagcactggcagattcagtgtctggcgagggcttcttaggtcatagttggcatcttcttgctctgtcttcacatggtggaagggataaggtagctatctggggtctctcttataaggggactaaatccacaggggcactcatcccacgaggccctgctttcatgatttaatcacctccgaaagcctcacttcctaatgtcatcccattggtgattaggttacaacatatgaatttgagaggatacaaacatttagaccatagcatggattgaatagatatagtcatatactatatgtttttatatatgtatatatgaatatatttatttatttgatatacatctgcatgaattcatactgtatttgagaaatggcagtataaatggcacatatgtgtgtgatatatatagctctctattcttgctgtctgatgtattcatacaataaaccccacagttgggacctacgcatctacctctagagaaagagcatattcacatatggaagcttttttcaaccctggaatgcccctacttctgtgtagcattcacatttatttgcctcttaaaaaaaaattaccaggctgggcatggtgggtcacgcctataatcctagcactttgggaggccgaggcaggcagatcacctgaggtcaggagatcgagaccatcctggctaacacggtgaaaccccgtctctgctaaaaacacaaaaaattagctgggcatggtggcacgcacctgtaatcccagctactcaggaggctgaggcaggagaatcgcttgaattcgggaggcagaggttgcagtgagccgaggtcacgccactgcactccagcctgggcgacaggtgattttaaatttaatccaaaattatatttaaaagaaaatagcttctagacatgtatgtgacctgccctttgtatgaacaaagtattattaaaaaactggaaggatacctcatggttgtgttaaaccagtctaaatttggttagaagttctaagagactcagttgaattcatgctagtatgtgttgtcttaagcctgagtgcacagcagtgctggcagaaccaacaaaagtgctgcacatgaaacaactaaaatggatttttaaaaaagctgttatctaagagttacctccaccaatacttaacgcattcaaaattaaaactaacaggagctagccttttccttcctgacagtgttagaaaataagccattctaaaacttacagaagattatcatttccctcttggatttagaaagtaaaaaaaaaaaacaaaatcaggtagacaaatgtttatgaaatggactaaggtttagtgacctgaaactcgttgaatttttcttgtaattgttgacagtgtgaatggtaaacagagacaattgctaacgttttatttcctttttatatgtgtgttgtactttcatgtcccatcatattgaagcaatcctgaaagtattaactgtttcttaccatgtctctctcagtgatactcaactcccagctgctcatttgagtcacctggagagttgggacaatggccatcctccatttccaccagagagcactcttaggcacttttaatgtacagccaagggtgagaacaactgagctcatttagtcctttaaccctggggttttgggtaatgcttgtctgcccttcctcttcagtccacagagctcaagtatatgctggacatcaggatatacaaagatacaggaagccaacctgtgcagtatggagacagtttgttaacttactggtctctggaggaacttctgagagaattcagctggctgtagtatcacctctacctgaggaaggatagggctgacaatttgctagtctctagctcttcttgaattgcttttgaagggtagaaatgtgtgacaaaaggcttatatatgtgtgggtttatacacacatattcctttcattgttgcttggataaatagagcacattttaaatgagaatggtgttaaaatggctatgaagaattaatttcacattagaaattctggcccaaattctgggaatttgggttattgataaatatagattgtattaattgtcgggtaagttgcttcttaagagttgcaatatcacaaatgatcaaaaagctgatgtttcaacctgtgcttatgtaaattaatcacaggtgtggaatcttgaggcttgtgaagaaaagactcctaacagtcaaattcaggcatgttttatgttatagaattaatctataaaaaatgaattctgatgcaaagctatgtgttctaattaatagtaacccaaatcaagaggctaaaattccattagtggactgaatgctgagtgacacttgaggagagtaaagtatagaaaatgtctctgttttgtggttactcatataaaaggtcttgcattaaagagtccagagatttatgtatcatagacaaggtcatcttgataatagcacataattctgggagcagacacatccccatcttcccaccccatatcacccctactgcaaagcatcactggaatcccaaagaggattccaggtaggctggcctcagtcctgactcttgacttgccatcatcctttctcgtttttgtctttcctgttagtttcttctgatacctcacgtgtcctttggtagaggctgtttcattttaattatttaatttcattttaattatctgccatttactaatgttagtctgaagttggcggtgatttgcagattctcagtagtagttctcatctgattggggggtggtgtctgcctgttttatagatgggacacaggcagagagtaatgtgcttaagataccaatgcctgggaagtaacatgcctaggttcattcctcaagctgtgcgattccagagcttttgctcttttcacaaaaattaactgggagacaagctgtgtccaggtggtgaagctaggtccaggagtacagcccagcatgtactcgaggtctaagttgtacaaaaaaggctgtaagacctttcaaactgatttttaaaataacagttttattgagttagttcatataccaaaaacattcacccttttataatgtactattcagtggtttttagtgtagccacagaactgttcaactgacaccactatctaatgttagaacattttcaccaccctgacagagaaactattagcatgtaagactaattttaaagctaacattattggagtagaagccaaggattgggctctcctgatcatcctgtgaactgagtgagggtagaaaccagttcctggcccaaccctgcagtgggcacagagtagacaccagtgttgactctcacagaatcctccagaacagtgaattctcaacttttgaaattttaacccagtcccaattttggtaaactaaaaaatctcactttactctgcccacttgttttatgaaaacaataggatttaaaattgttttctaagcacctatttgttttttgatttttctcgggtagatctgccaccctcattattttgattggagagtcattggcatctcaagacttctgggttattttcattgcaggtttgcttgaacacatgaaatgattcagtgcagtcatgagttcagatgactcacgcattaagcaatttcatgtgtaaaagtgatcccagccagcaaatgctaataacagccatttattattccttggatcttcctactcttttctttaacatttgtctttggccattgcctcctttctgttacctttttcatgcttattaaagtaaattgaataacattatatagcaatgtgtgttatttgtcttttcttcccagtgtgatataaacagtctggggctgagaaaatgggtagtggggtggggaaaaacctttaagaaggtaaaggccaggtgtggtgtctcattcctgtaatcctagtgctttgggaggctaaggtgggagaattgtttgagaccaggaattcaaggctacagtgagttatgtttctgccactccactccaacttgagcaacagagtgagaccctgtttctaagacaaaaaatgtagcaaatgtaacattgtcatggtgagaggaagaacacttctttttcctacttgagctccctcagtcaccttgactgacaacatctggaagcaggccagccagtgagagcttagccaagggaattgtatgggggcatgagtccaagtgaccatcttgggaataattctctgggaaaaaattacatttttttttttttttttggtgaaacaaagcatctcccttcttacattttattgataacaatttagtttccagtaatattacattgttagcatggtatataagtatttcaagttttgttttctctctctgtgtgtatataaaatttagaaaaaagattatgtcctaaaatgttagagtagggaatactttgttttcaaatgtaagtcacaaggaagctgtggttgagtatatacacttagtttacacattgtctttttgtatgaaatcagaaacgttggtagttctctttgtctataacttagggtttggggaagtttgttttgttttttagtttgagttaaaagccatgacaacactgaaaatgggttccagtaggtctacctccttttttccattagcattattatttctttttcattttttaaattgttcatatttctcttggatggtatcttttctgctttgaatccattatcagggtacatcatttattatcaacatttatgaagggccttttatttaattttattttgagacggagtttgctcttgtcacctaggctggagtgcaatggcatgatctcggctcactgaaacctccgcctcctgggttcaagcaattctcctgcctcagcctcccaagtagctgggattacaggagcctgctaccacacctggctaatttttgtatttttagtacagatggcatttcaccatgttggccaggctggtctcgaactcctgacttcaggtgatccacctgccttggcttcccagacagagtgttgggattacaggcgtgagccactgcgcccagcctcttggcctattgtttatgactatccttgatgtttcataggtgaaaaatactcttactttgaagagtccacagactcaccagggaaatagtaaaatttaaaaattaaaatgcacttttaagggccacaatagttaagtttgggaaaaacagatgagggggcatgtgttaatatttcagacaggatgtagacatgggggctttgggaggtgatgctggggctgatcctgaagcataggagtttgccagatgaaaaaagacatttcaggcagacaagtgcaaaggcagaaggtgaacatggtcatggtgtccccagggagctgtaagatacaattagggtgagggtacctatgagatgataactcgatgatgttggagatgtctggggccagatcatgaaaatcaagaaatctacaccagctaggagaaccattgatggctttaagcagaggagaggcactagtgagcgttactcaatgaacaatttactacactcatggcagggatgtagaggagaccttgaaggagtcagttgggccactgctggtgggagaggtcctgggctgggttgtaggcagcgatggggtttgtaaggcaaacttggtttctggctttgtctacaagattcttcagtggttccattgcagaagataggacataaagaaagattagtagatttgggatggtgggtgacatggacaggatgctttcagtcttgggaacctggatgtattcttttgctcccttgagagactgttcttggtagacccactgttactgtacttctgtttgtacattttcgtactcagttatccttcaattggagagcaaatgattggtgagcaaattaaattaaaagcaaacctcagtcagacacagtggctcacgcctgtaatcccagcactttgggaggctgaggcaggtggatcacttgaggtcaggagttcgagaccagcctggccaacatggggaaacccccatctctactaaaaatacaaaaattatctgggcatggtggtgggtgcctgtaatcccagctactcaggaggctgaggcacaaaaatcgcttgagcccgggaggcagaggttggagtgagccaagattgcgccactgcactctagcctgggcgacagagtgagactctgtctcaaaaaacaaacaaacaaacaaaaaaacaaaaaactaatctctgagttaagaatgaaactgctaaattaaataaaaagtattatgttatttttacatttttttctttaattagtgggttgggtgccatcgcagtacagaggtagattggaaagctatctttttttggaaacagagttttgctatccctctgttgcccaggctggagcgcagtgacatgatctcagcagcctctgccttccaggctcaagcaagcctcctgcctcagcttcctgagtagctgggactacagggacccactgctatgcccacctaattttttttttttttttttttttttgagacggagtcttgctctgttgcctaggctggagtgcagtggcgtgatctcggctcactgcaagctccgcctcccaagttcaatcgattctcccgcctcagtctcccgagtagctgggattacaggcatccgccatcatgcttggctaattttttttgtatttttgtagagacggggtttcaccatgttggccaggctggtcttgaactcctgacctcaggtgatctgcctgcctggacctcccaaaatgctgggaatacaggcgtgagccccagcgcccggccttttgtatttttttgtagagacgaggttttgccatgttgcccagaaaattcctgggctcaagcaatccgcctacctcggcttctcaaagtgctgggattacaagcgtgagccactacacctggcccaaaaacagcacctttaattaaagaataccccttgctgttagcataattcttgaggaatcctagtaacaatcatgaaagaaatacctaagaagaatctttgagctagaaggaaacgtagtgacttgggccactgctctttctttatagttaggataaaaggataacagagaagggtgagtgagaagggttagtgacttctgagtgtcacacagcagtggtgcgggggcatgtctagctcatcggttcagtgttacctccatcgacctggatgactccctgctcagtcccatagagacgatagagctgagttgaaagacactagtgctcaagaccaccaagtcagcggtagacccagagttgcctaaattcttgactttaatcttattttaaattaactcactgttcataggccaacaagtatttgttgactggttagtatggaagggatactaccccaattattacacaatcagagataagtaagagactatttttcttttcaagaagtgtgcaggttaatttttcagattaactcattacaggactggcaaacacttatacaattcatggcttgtctgacataattatgggtatgtagtatatacacacacaaaaccaatgagaaaacgaggccacataaaacattgttcatttttcttttcttttttacctaactttattggattttgttttcttttgtttttttgcttgttaccttgttctctctgcacagtgggcaatcagtttctagactagctttagaaatgcctacatgctggtgggcaaacaataaatagaaccaaataataaaaaataatattgattgtctttttttcagtttattcttgttcaatcataattaggaagcatgatctggtgaaaatttttcttaggttggtaatgacataaatacttgcaggaaggtatttggtactttctgctactgctttgaatttaagcctagggtagaaatttagccatttctaccctagaaatggtaagagtgatagagaagtttctttttctttaccaagtttatgagcttgaaattattaatgctttttgtttttttttctttctttctctttctctctgtttctctctttctttctttcccttccttccttcctttcttttcctaccttcctcctttcctttcctttcctttcctttcccttccttcttcttttccttttcccctctcccctctcccctctcccctttcctttccttttccttttccctttccctttccctttcctttcctttcctttcctttcctttcctttcctttcctttccttctctctctttttctttcttttcttttgtttctttttttttttttttgacagggtcttactctgtcgcccagtctgtaatgcagtgctgtgaccatagcccactgcagcctccacctcccaggctcaagcagtccttcccccctcgccctcatgaatagctgggactacaggtatgtgccacccatgcttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaatacgccaccatacccagctaattttgtatttttagtacagacggggtttcactatattggccagactggtcttgaactcctgacctcatgatccgcctccctcaaatgcacacaatagtacatgcagggtcgaaatttttgtttgattttgtgtgtggcaagggaaagagaggaaagggctagagtacatagtgtataggctttaaaagaacttgattttgaaatgtgctgactgcagatcttactggtttttttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgatcttactggtttttgtgtttagaaaaatatttaaagaccagtatagatccataacctccacactcttcctatcagtgttttcaaacttttctgtacttgctgcacttgtagatcagctttgttttgtggtcctaattgaaaggcgtgccaaatgtgcacttcctttagccaccacattcacaactgcaggattttcttctgcttagctggttttctttcttctttccctctgcagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaaggtagctgagtaagctttacccaggagctctcagaacggcattgccagaaccagcagtgcagccacttcaacaaatcacttcttttaatactctttggcagagatcaaatctacagggtaaattctttgccacaaatgattattttgtttttttatatgaatccaatataagaaagttaggaccagcctaatagttcttagttctggcgttgccttcatagtaggctttgttgggtggatctgcacagctattctttaaatttggccaagtttttcaaataaatactaccagtgtttccctgcctataaaatgcccctgccatccttttcaccttacagggccactacattaagtttttcttttcttttgtttttttttttttttgagacggagtctcgttctgtcacctaggctggagtgcagtggtgtgatctcggttcactgcaacctccacctcccagggtcacgcaattctcctgcctcagcctctcgagtagctgggactacaggtgtgtgccgccacagccagctaattttttttgtattattagtagagacggggtttcaccatattggccaggctggtctcgaactcctgaccttgtgatccacctgccttggcctcccaacgtgatgggattacaggtgtgagccactgtgcccggccctaattttttcttttaaaatagaccttatttcttttagagcagttttaggttcacagcaaaattgagcagaaaatagaaagagttctcatctatctccccaacacctcccctactgtcaatatcccacaccagagtagtacatgtactacaatcaatgaacctacttcgacatatcattatcacccaaaggcaatagtttacattaggctcagtcttggtgttgtacattctgtgggtttggacaaatgagtaatgacatgcatctaccattataatattatagagagtagtttcagtgccctaaagatctccgtgttctacctattcatttcccatccccactagcccttggcaatcactgggctttttgctgtgtccttgcatttaccttttccagaactacattttaataatacatttcccgtggagtgctttgaaagcataaagaagccttgagccaggcatggtggctcatgcctctaatcccagtgctttgggaggccaaagtaggaagattggttatgcccaggagtttgagaccagcctggaaaacatagtgagactccgtctctacaaaaaagaaaaaaaaaattagccaggtgtgttggcaggttcgtgtattcccagctacttgagaggctgaggcacatggattacttgaatctgggaagttgaggcttcaatgagccgtgattgcaccactgcagcccagactgggcaacagaacaagaccttgtatcaaaaaaaaaaaaaatgtctcgctatccaggatgaaatgcttttaagagtatgataagttatgggggtaatatgaatacctacttggaatagagtcagtaagatgttttgtgaggggaagcctgaagtgcaaaatgttgatgtgtgtgtctttctgaatttaacatttgagttgctcagatatggtttgaaccatgtatgtggagacagaagcaagggattggggattaaattctgccagggttggtctgtgcagcctccttagatttaacgcttttgaggaaagtctctgatgtggctgttaggtgcattctttttaaaggaaagtccaatgtattattataaaacagccttattattattattattattattactattttgaggcagggtctcactctgttgcctaggctggagagcagtgatgcaatcatggcacgctgcagcctcaaactcctgggctcaagggatcctcctgcctcagcctcccaagtaactaggactatagatgtacacaaccacgcctggctatttttttttttgtcgtttgtttttttttttggagacagagtctcactatgttgcccaggctggtgttgaactgctggcctcaagtattccttctgccttagccccccatagctttatattttatgtaaaagttaattttgattatttcatttcagataatacgaaacagtataaagtatagccatatatagagataaaagttcttcccttctctctttcacctttggctaaaatcttggaatacaaactttcccatttacaaaccttttcttatacagatatttttatatacaaacaaatatgcatattaattatgttaaaaattggtggaacatgaccatacattctattttacaacttgctttttggcttgacttggtatattgtggatatttttccttttaagcagaatttaatctcagggtgagtaatgcctgcctagtgtcccttaaatggctatactgtaataatcaccagtcctcaagtgagaggttagttcataatttaaagggggtaggcgggagacctttcacattagggacaaaaccaaggccatgactgttgacattggacttttggtcactaaggatgtatgtttttattttccaaggcagacgatgcacggcttggggctgctgccaaggtgtcagttttgtgaaatttttattttttggaggctgttaatatattagcatagttgttagttctggctaccatcctttgagcattttgagacacttctatgcccatttaaggtggtgtgaggttgaattagttttaagaggaagtaatgaataacagaaatggaattaggagacagactttattttgtgtatatgtttatttgagggagaaggagatgatggctgtagttaattgctacccctgtgattcttaattatgaaacagggttaaaattgttcagctcagtagtttcctaatgtggttaacagtgagagtcaccagagaagttttccggtatctggtgttggcaatgaatatttgtatttttcttattttataaagtatttatttttagaaaggtaatgtaattaatgtatacaagattaaaaaggcacaaaagagtgtagagtgaaaactaagtctcccttttctgtctcccaagtacccagtggcccttctagaaacagccactgtattaccattttcttgtgtattctttcagtgatttcagagtatatataatatacatgcatataatatacatgcatatattacaatttttcttttacacacatggtaacagtatccacggttttatacgttttcttattgaaataatatttcttggaagttcttccatagtagcgctgcattctttttatttatttatttttttgagacggagtcttgctctgttgcccaggctggagtgcagtggcgccatcttggctcactgcaagctctgcctcctgggttcacgacattctcctgcctcagcctcccaattagctgggactacctacaggtgcccgccaccacgccctgctaattttttgtattttcagtagagacagggtttcaccgtgttagccaggatggtcacgatctcctgacctcaggtggtccacccacctcggcctcccaaagtgctgggattacaggtgtgacccaccgtgtcgggcgcattcatttttagtagatacctggtattccattgtagagatgtgctgtcatttacttaacaatattgatgggtatatagatcatttccagtttttattatcgtgaacaaagctatagggaataactttgaatatacatcatttcaaacgtgtgagtgtatctatgggatccatttctagtagaattgctgggtcaaaggttatacacattataattttggtagaaatttattgccaagttgctctgtttatagaccttgacagattttagatttaacaacgatgggtgagaacagttttctcatgcccttgcctgtcaagtatgactcccaagtgattattttatttatttgccaaagcaataggtaaaaaatggcagtttaatgtgctttaatttgcatttttcttagtttgattgagattgagcatcttttcataagtttaaaagccacttttatttctagttatctttctatgcttgtgttcgttgtctattttgctgtttggttatgatttttattatcaaaatatgacatcaaaattattggtcccccctttttatccttgtgatatgtgctatttatatttttctccgttggccatttgtatagaaataattattactttgttgtgcaggttattacaaattttatatagttaaaatcaccaatttattcaagcaacaattatttattgaatgcctcttgtgtatgagaacttgttctaagcaccaggctatacagtaatgtaaaaaacagaccctaattcttgctccacagcggaagttacattcttacttacattggaggaaatgatcaacatcctagtatcgtagttaaaagacctttcatttttagatttaaaaacttactatctcctggttcattctaatgtcatgtggggtttttttagattgaagtctttgatccatctgaaatattaggtatgaattcaaatgaatttttctctagatgctgtattaattagggttaggttgaattgctgtaaccaagggactgaaatatgctatggttcaaagaacacaaaagtttattttttcttcacttaacagtccctgtgtaagcaaaacaggtcagcagaacctcccacatccactgatcattcagaggcttgagttccttctgtcctgtggttctagtaattgttgctgtgattatctgcatggtcatatctgagttgctgctgtatctgggtcctctccatgggaagggcaaagaagaaagtccagggctagtgatcagaaacggcagacatcactacagatgaaaactatagtgatgagaacttcattatatgggtacatctagccgcaatgcagactgaaaagtgaagtctgtgttggccgccttgtacccaagaagaaggaaagaagggattttagtggaaaattagcagtctctgccatattggctagtcattccaattttactgaacagtcccaacttttctcctttggtttcttttatagtataaattcccatatagattttggtctatttctgggataaccgtttagtttcattaatctgtctgcctattcatgcagcagaatcgcattgttttaacttttgaggcttagtttttttttttctttttcatggggtaagtctccccattttaagtccatttcacagaattttattacttgtgtgtgtgtgtttgtgttttaaaaataggaactttaaaagaatcatacccagttaccaccctctccccccatgaagaaaacctattatttttgggattttgttaaatgtatagacttcattagtgaaggttcactctttatgatgttcatttttcttatttgacaatagtgttgcacaattcctttgaaaaacactgatctgaaccctagactttctatatcctttgagccatgacacttattgaagtacgtgggaggaaggaccactttatatgatgtgttaattttattttaatacatgatttctgattatgaccaggaaacatacttattttgctattctattaaaaataaacttggaacttgtaaaaacaatttcttcagtttgaagataaggaagagttgatatttcagaagtgtattgcacaaacttatttgtaatgtaccaacctgggctaattgtttgcgtatatatgatgcacagtgcttgttacttgcttagtgtatgtgtatgtgtgtatatatttgtaacaacatgtattcagcttttgtcctttcctttttaccttttttaatgtaaaataaaacacgaaaagaagcatacatagtttagttaattacaaggtgaattttttttgtgatcaccatgcaggccaagaaatagtatattatgtagtatatacactatagtaattgcctccttgccttttttttaatgggtccatcaaccaggtgttcagacctacagattggtctcgtattatctctttatgttttgtaagtctcttaaacctggggtttccccctccagccctttctttcccttacagtttctctgttgaagaacctggccatttgacctccagcttctttcttgctagattttggtgattgcatccacatggttcaattcaatttgtttttcttttagtggcatatgttatattaacaccacaatctgggcaccagggatgctcactgctactgagtgggtccttatttctaggcccgtttagtggacagaaccaggaattaaatatttataaaatacttcatgagttcattctgatactttgtgattcaaattcagtttataaggttttaacttaaccttttctatataacatctttatctcctttatttgacacaaaattctagtcctcaaacacaacggggtgatagaatacttcataggtactcatttgctttcttccacattatacacacagtattctcagaagtgccacaatgctaacactatactgctagttatgaaaactgaaaacaatttcttttttgtattctatttccattctccttctttttgttgttgttgttgttgttggagggtgttttagttgttgaaaattgggcagatttaacactgattagctcttagatgatatttgaaggaggaataattttaactttgttgggtgagatgttgggttttagttatgtttagaaaaagtccttatctgtcagagaatttgtgggtgaaatgatatgacatctgtgattctcattaaaatacctcaggaagaaaatgggaatggaggaaataaggctgcttatttttgaaactgggggtagaatgttgcttatttttgaaactagaagattttaaaagaaggcatattacgctttctgtttctatgtaacttgaactatctgtaataaaaaatttaaatattaattttataaacagtgaaaagaaaagaacatatggggaggagggtaataaggaaagaatagacagggagtggggaaatgactaaagaatgggtgatttcattctcaacctggtggtccagcctggtggcctacagtggttcccgagtctaagaaaacgagtaacatcttgagtgaaaagaaaaggctgagctgtggggcctaaaccaagatttaaggcatgagtgacagaagaggaagcttctatgcaaggaaactgagaaggatcaaagcattaaagtaaagatacctgagagtgcagcccacaaatcccagctagggaggaagccaagggaagaaggtggtcacaacaccacatcctacataatcagtgagtgagacctccttgtcattctcagcatcacccgatttgctggagggtgggggattcctaggcctcgtcacagatcaaaatctctagggggtgaggcttgggaatccatattttgaggaagctcccttgtgaacctgaaggataaggtaagactaaaacgacgtagaaccttaacaaggggtatttcactggattgactaaggcagaacactgtggactgaagactggatgggggacatggaggaagcctgtgtagttgctgttctagaaagtgttcggtgaaaggatgaagagggtggatattggagaccttggggctgaggaggtggtggtagttgaaattgttgcttatgatgatgtaagagagattgcctataaatgggaaggatgtgggtggttttcagtgcaggataactgagtagtttggctacacatgtgcttaggccccccactgccagagagattattttttggaaagagagatttttgatggttcagggaaagcttggaaatgttcatcatggattagatgtttctttcacttgttagcattttgaattacatattaagggaggagaggcctcaaagccttctcagtgcctttccttctcaagttcttattgggcctttctggcccatccttgagaaagaaggaaggaatggggcctggcacactggatacagggacccctccctgccacctgtcccccatcatgttcttacagttttctctttctccatttccttgcctcatgttaaatggcagtcttgtatatgtagaacctccttaagggattgcctggtacagagtggtgtttttcagtcattatacttttggactattggaaggattcccacgtttccacaatgatttcataatcacagtgtttgaaggttgtggacaaggactgaggtgagaatactattctcctcttttccactgccttggggtctttgttttatttttagttttaattttacatattttttagagatagggtctcactgtgtcacctagtctggagtacagtggcatgatcatagctcagtgtaaccttgaactcctgggctcaagtaatcttgtcgtcccagcctccagagcagctgggactacaggcccacaccaacacgcttggccaattttctttattttttgtagagatggggtctcactgtgttgcccatgctggtcttgagatcctgggctcaagtgatcctcctgcctcagcctcccaaagtgctgggattacaagcatgaaccactgtgcctgactgcattttatttttaataacagatcaaattcataattttctactctatcggctttctacctttgtgttcttgggcgcatcacctatttttaagatttcattctttctccctacttcatagagtgcatttatttttacttttaacattgttttcttatttaggtcagtgagtgtttctggtcgagtgggtggttttttggttatatccgttctccagtctctctccacccggtatccatccagaacctctccctgcctcctctccctgtctcctccttgttttctgttgtggttacttggatgctaacccattcaacttgtgcactgaccctggtacatggctcgttttctttctcatgatcatatttatacttttgatggatatatttaaatgaacagctgtgtgtttgttgagtcataccacaattatctgattctgctttagctgcttgactggcaaaagcatatttcaagctaaattgtgagagaattccattaatcacattctattcgggggaggggagaggagacagaccactaagagaattcttttccaaggttaatgttaattagtgattccattatttagagtaggttgatctggttgctatttaatgtgtgacttggagaaactttacaaagtttaaataactgtaaaaataactatgaaaggtttaatgataacagccgtgtaggcaaaattccttggaataaattgatgtgcagataaagttagttgctgctgctggtctatttaaatagataaggggtctttcaagagttcctttttgtaaagaccagggttcttgcctcacattgctgtaattcattggctaagtattttgtttgaagcctcctgaaaagataacatctaattcagaaatgttactactttctgtttttttttttttttttaaatgtattactgactgttacctctggtcaagtctttggcttccatcagccggatctatttttctcctgacacttccttggggttctctctgaaggttattaataggcatggaagcatggctttccaaatagcgtcaataaatgttagaagccttcaggggagataatatgtcaatttctgacttgtaggagatgcatattcaagagacagacgctgtctcagaggtcattagggatggctctgggcctatcagctggtgtctgcaactagagatccaagcaatcccttccaactgggatattgtccaccagggagttgtctggtacacccaaggtctgccagccgtctttttgtttggctgcctctcttggatgacacccttgaaaactggaatccaagttacaaatgatatcttttaatttatctcaaatatctgcttgctactatattaaactggggacatacaaacccacccctgccccccatttccttgctaggctatataaaacttaaacttcaccttcctctctccacaccaaagtgtagccaaggctaagatgttaaaatgaatatgttttaatttatattgtgcacctggtaggtgccaagcatgagtatgtagccatgagccaggcagagttcttactctcatgttgcttacattttggtgtgtggaagagggagaaacacaataaaaaatttatttattttattttaaactagtaagtaagtgacaaatctcacctagttgttaagtgctaagaagaagatatggtgggataatatagtttatgggggtgggtgagaaggtctgagacaggaatgggcttggagtgtgggagtgagacggaaggctttggttaggccagtgtataaagggtggtgtttctcactaccacagaaaagtgctccagtgtctctcagtaaagacagagagagagagggagagagagagagagagaaagagagaaatgtacctctctggccttgacattcctttcatcttatacccacccccccccccaaattattatagattaatcacattagcctgagaattgggacagctgtgtcagatgagcagtgcttctaacactgtaagtcatgggagggaaagaaaggtctgcactgttaggttagaggggaaacgtcaggtcaggcacagctagaaatgagacagaggactgagacagtgtctacctgaggactttgggaagaagcgggatttgaaatgaacttcagaattacatatctagaagagctttatgggaagggataatggggcttttcctaccaataggtaaaaaaaaaaaaatggtccagtcacagtttgcaaacaagggatagggagtgagctgtgagctgcgttggagaatgtagcaaaatagcagggagatgatggagtcctagcagttgaaacaaagcaggtggaccgtggctatttgaaacaaaggaatgaagtggaaaacgagggacagtctccatatagtcaagcctggtgaaataacacctagttttgaggtacgagtaaggcacgcagcaagtgatcaaaacactggattctcagaaatttagtgtaggtattctgtgtatatctggaaggggtgtaacaaagtcaatttcattctgtgtacagttaaaataaatttactggggagcctttgattcttacatagtagcctaagctagacctttcacttcctttcacattaagccttatctttttttcatcttttttcattttacagatcatattgtttgcttcccttccttcccaaaccatatctagggtccatctgttacagctggaatgtttatagtgtaactcagtcaaaacccattctttcctgaaataatccataattatttcctctaactacaggataaacggatccagggcctggttttcagttctataggacttgtccaagaagctatttgtattcatctatcatgaaagatcaaattacatgctaatattctgaaagtaacaccccgccagaaaccctccagcagcagtgaagtctatataaaaccaagccttggcaatttgcacattgccagttccgacagagtgtggtgttaaaaatatttaacaggtcatttttgaaccgtagaaaagaccctgacttaacttacatggtatgatagcttcggtttaacctttctttgcagctattactgacagcccatgtctcatttcactcctcccaaaggcccaggtagtttggcacaagctgcctttgggttagctcattgccttttgagcatagaagagatatgactgttcttgtattatctaatcagttacagtggctgattttggcccctcttcgtggtggttgatgtaagtctattttccttcaaagtttcatgtctacaatttcccttgctgggcctaactttgcccctaaatatgccttacactaatttccgtttttattttgaggggtgagtttacaagagaactgaagagtagggatggaggatgggggctagaaaccactgatgcactatcaaagaggcttgtttttttctatgatatcaacatcttttctgggggcagtgggagggaggagatgattgggggtcacagagtaatatgaaattgtttaaggttagggaaatggaaagaaggcatgattgaatggtgtattaaataaccatgagtaaaggttgttctttaagaggaaaataaagattttcagttgaagttcagaagaattgaggcttgaataaaatgttaaggatggcggagcatggtagctcccacctgtaatcccagcactttgggaggccgaggcagggggattgattaagcccaggagttcgagaccagactgagaaacatggtgaaaccccacctctaccaaaaaatacaaaaataattagtcagacatggtggcatgtgcctgtagtccccactacttgaggggctgaggcagcaggatcatttgagccgaggaggttgaggctgcagtaagctgaggttatcccactgcactccagcctgggccacagagcaagacctcgtctcaaaaaaaaaaaaaaaaaaaaagaaaaaagaaaaaaaaaacccaaacaaacaaacaaacaaaaaactgttaaggatgacagaacaagattgctaaactgtggctagctagttaagtgaaagttgtgtagagtggtggtgggttaagacctgaatgttctgatctggtggtttgcggtttgacctgtgtccttaggcaagtttcttctaccttcccagaagactaagaaaaagcaggattccataaattatttttccacattgcctctgccttttatattaaagagaattattattttttccttatggaaggcatagtacagaatgcctaaagatatataaagaaaaaaactgtgatggaatcatagtgagagcccttaccaatggtgagcaagcgtaggttagaaagtgtcttcacgtggatgatgtaaaagtcattcaaaataggggtgggtgattgtatgacctgtcttccaagattctttctaattcacagattgttagaaattgaattgagaagagtatcaggaatgtccttattgaatgaaggtactcactaaagtatgtgttgaagaatgagtttaggccatcaggcaagataaatgaacattttgtcaaattttccaatgggaaagaattttagagttcatcttacaactttcccctcatcctcaatattatagttaactgtatgctacccataagtctagttttcagaaacatgctgtattatagattagcacttagattgcctgatatgggttctgaaagttgcatatagaagtgtattatattctcagttattctgtgaccaataccacagtaaaattttgggtagtacattgtggggtatctgtggctttatctagctgtaaaattgtgatgagcaaaaaaagtgccaaacttggtttcaagcccacatacattagaaattgagctaagcgctagcttcttaactacatacagtctgatctttaagtggaatttgaaaagtaacatgggatttggaaagtcgttttgtactaccctggtgatgtgtctgtttttagtagaatatcatgggaatgttctgtcttctaagaaagtaggcctgagacattgtaagaaacagtattgatttaaagagggtaccttagttaaggcaggaggtctctaaccattttctgaatagcgatttttcttgtgtctgacatactaaaatcagttaccagggatagacggtcttatccaagaacagaagggagatgtgcgtacacgagaggcacggattcatactctgaacccttcagataatattttgcagtccccagtagcctgtgatttttcagttagagattttggcattacagccttgcacaaggatttagttgaacccaagcaagatatgcagctatgactaccttcatacaagtttatatcccatttcaaaaatatttagctgtattcataaaatattattccaacattaaaaaaaattaaagctttcttccttgactgttggacttgttgacgtctgtgatgttagagaggttaatgaaatttctaaaactgtagaacagtgtcatttttgtcaggtatccgctaagtgctcagtctaaaatatctggtaccatctggttatctgatatagtacaaagactgagcatttaaggactaaggcagttacttgaagtgttgtccaagaactccaaaggcgcctgagactttctcaggggtttcacaaggtcctccttcttccaatgatatgtgtgatactggattttctatatatagttcagccagtacatgttgtaacagaatgaatgtagatcatatatgagaatccagctgtgttttattgaacagagattttctaaaaagcaggaaaacaatgccacttttctcataacatgttttttaaaaatacatcatagctcttttaaaataaaaaaaaaataaggtagtatgttattgttattttattatgaatataatattttaaaaattctgtttaaatttttaacactgtaaatatcaagagatgtagcctacatacacacgcttctcagtaattttcaagagtttaaagagattctgagaccaaaaacatttaaaaaatactggagtaaggcaatcccagaactattgaattattgccactcccattttccactactagtttctctttcttgccaacttacatatgaacgctccttagccaaaaatatttgagagcaggagagttgaaattttacttttaaaaatgcaattttctttttagtatattttaaaattaaaaatagatccttgggacttcgggttgagattttagcgtattgatgtttcttataattgaaatatggtcaggaaataccagaacattcccctttccacattctttttttctttccttttgggggtgctgtttttaatagctgagtttactggtcaggataagcactgcagaccctgaacaaaatggcaaccagtaagttgacttttttcccaaagatttttggcagattttgagctgtctttaaacactagagacggaattagtccctactgtttgagggtctgaatttataattctttttctgtcttctatttatgagcctaaattattgttttaattttgttcgcacaatgataatctgttaataggtatttgggacgtgggcttttgctggctttgtgacgtggaaaatatgccagtggtgattgtttcttagatttttttttttaatagtaaaaggagtcttgatttgaagcttgttaactgttgacttttactattacttgagctaaattctacagattaaagttatagagatgataaatctcttaatcttgccattcctttgcaggtctctctgtgtgtgtctgtgtgcatggtggggaagggatgctactaattctttagaatttaaacttaaattgagttgattaattcaggaaaaattctaattaaactgttattaaatgtgcacctacttggctctggcagtgatgaacaagatagactatagattttcctcccgtggaattcacagtctagtgacagagacagatgttcaaaagcacacacagttatgaatacataattattaattaggatgatttgtatgagtgaaacttaaagtgatctatgagaatgagcagagagtacttaagggtttagacaggcttctagaaggtggtagcctttagagaagccattgagacttacgggatgagtaggaattcagtaggttgggccctgaaagaagggcccaatcatagggagcatcacgtacagatgtccagagatagacagaaagtggctggtgggggtgataataatgggtagtggggactgaggaactatggaatgatggtgagagccaagggggcaatgaagataggtgagtagagtgcctagagtgccttacctccgttctgacctttgccttcctctctagccttcttgggtattcgccgactctttgtgactcttccagaccctttgtgtcctggccattcttgcgttttttcaatcctgaggtttgccctaagtcctcaggacacaccatgcttgctctggccacaggcacctcaatagaagtgccttttcccttaaatattaccctatctgtgtcctgtattcaccctctcccaccacacctcccaacacacttacccttttcctagtacctctactcatccttctgattcctgattcttttcagatgttacctccccagggaacctctgcaccctccagaaagtctcaagttgttttgttaacacagttattttaactatgtttcttcccaactcttattcagtttttaattatggaatcttggatgattatttgattaccaccatagacatatcttgtaagtgccacgatagcaaggaccctgtttatatttactattttaggttcctaatatgtagcacatagtaggttttgagtagttcttgaatgcatgaatgcattaatgaaggactgggaattcagataagactgagataagaaatagtttagttcagcaattttcaatggtttgtgatgacatatcccataaaaagttttctgatgcaccctcaatgtgtaaattggccatacattttatataaaataaataagtacatattataaaacatacataaaatagcaattaaataaggataaaatatttaaggtgttgctaatggcagtggaatcatactatcatcaatgaaagtctcaagccactcaggataatgtttactatctatgacagtagttgcaaatccgtttttcaaatattttcaaattttgaatttggggagattgtttcatgtcagattgaactgaatattactacttttctctagtaaagtggttaaggaagaaccagtagaaataagcgatgttaagtctactgttttcttactcttctttggtgcttgcattaataatatgtgcaatctctagtttctgtaatggttttagaacacttgtcatttgggaaggctcatttcactgtaagtagccaatataacctgtaattccacttgaacggaccttcagaactacaagtacatggttgtactctgtaaataaatcatgtccacgctaacattatgtaactcctagtctttctgaaagatacctcctgtactagactgtcatagagaactgagatagagaccagattaagtctcaagttattttctactttattagattaaaacattcttatgaaaaaacagtttaataatttcattccatagctcaatgaatgacccttgcttggtccttggatgtgcatacctgttttggagatgagtggaccagtgctggagactgccctagacagatgattatgattccatgccgggggctgatatcactgctgagggagaggtttttcaccaagggcttacctttgagccggaatcatgtatgacaggaggaggcaatggggttggagaggggtggaggagggggctcagggcagttcaagcagaggggaacaaaaagcatattcatgtccaaaggtacagagatgtgttggaggagtcacattctggttgtgaggggccaagatgaaggatttgtatatccccaaaaggatccactataggaaagatctatgtgaacatggaaataataaaaacaacaacagtagtaggatcttcctcaagtttcatatgcttttaaaaatagaaaaggaaggtaaataaaaatcccctttacctcctcccttaccttgcttttaggaaagggattgactgaactataattatggaaccaaagagaaataaatttaagtgaagggtggtaagatatgatggaggtatggtttgtaaacagaccgccagccaaaaaaattgatttttttttaattttaaaaataattaaaaacaaatagagatggggtctcactgtgttgcccaggctggtctcaaactcctgggctcaagtgatcatcccacctcggcctccgaaagtactgggattacagctgtgagccaccgcacccagcctaaataatttgattttaaaggtcaacactccagacatgctagatagcaatgggcttccactctttgctttaaagctgaaagagtacaagcacactaacctatcattaaagaactttaccagctttttgtttattttaccatccagaaaattgcaactaaccaaactcccatcacattcctgatgtttcacattattcaaatggaaaagtttgtttttatttttacatgattttagttgttgtctatccttgttaaatttgtttaatgcagaaatgcattgctttgccttagatggggtaaaagtttgtatttttttgttctttgtttttgctgtaggtctgtatgttgatgtaggttgctctgcctccagtccttttaaaggagaagtaagactctaacatagtaatttggcttgaattattcagtcgtttaatccttaacatcatgttaaaatagtctattcatgcttctcaggttttttaatttagtaccaattttgcattcaatggggtaagataaaattcaaacctaaaatcttttgggactgcctcactttgtagctgaaaattttttgtttccttattgatttctttgtaagagagtagacttagaaactatccttggagtgactaccagttagaagtgaatatgactaactctttaaagtgatatgtttaggtccacataaaaggtatgtgtttaaatgtagtaagaagtaaggcaatatatctgagggtgattagtaagaagggccttgaatggcagtttgaaggtggtatgcttaatttgtcttcctgcagttagatatttatgctttacttacatctcttcttttccctttacagttgtacaatggtagatggagtgatgattcttcctgtgcttatcatgattgctctcccctcccctagtatggaaggtaagtgactcacatctttttgggttaagataagtatactgtgattttttttttttggcttactataaactacttcttaagcctatcaaacttaaaacactctttttataataaatatttggtgattattgactattttgaaggaaattcttatatacattatatctgaatatttacatacacctatttttttaaaaaattcaacctaattttctacttaaaataaatatagggccaagcatggtgcctcacgcctgtaatcccagcactttgggaggtcgaggcaggtggatcacctgaggtcaggagttcgagatcagccagacaacatggtgaaaccctgtctctactaaaaatgcaaaaattagccaggcatggtggcgggcacctgtaatcccagctacttgggaggctgaggcaggagaattgcttgaatctgggaggcggaggttgtagtgagccaagatcacgacattgaactccagcccgggcaacagagcgagactctgtctcaaaaataaataaataaataaaaatataaaggagaaataagagaaaattctgtaattaacaataaaacatgtgtttaaacaaatgcgaggctgggtgccgtggctcatgcctgtaatcccagcacttttggaggccaatgcaggtggatcacttgaggtcaagagttcgagaccaacctggccaacatggtgaaaccccatctctactaaaaatacaaaaattagctgggtgtggtggtgtgtacctgtaatcccagatacttgggaggctgaggtgggaggatcgcttgaacctgggaggcggaggttgcagtgagctgaaatcacaccactgcactccagcctgggcaacagagcaagattccatctcaaacccccaccccccaccccctccaaaaaagcccaaatgtgatatattatggtgtagttgggcatgagtctacaagaagacatgatgaagtaatacatgcttgcacctatataggtaataatcttcaacatcttcgaaaatagattggtactggtgtgttatattggtggcttagttgtcataagtggtctcttaccttcagtgattgaattttctgaattggtgaacagattttggtagaattaaaaaaaaccagaaccgttggcccttgatttatatactagttatatgtttggaatatttagtatacatgaaggcagtgtaagacatacatactttgtgtttttatgtatgacagggttaggtgctggtttcaattctacaaagattattcatgaaaatgaatgctcggtgggatagttgatacttgtagtgcaacggccatgtcttggcctatttgggatgttacaacaaaaataccagaaactgggtggatcaaaaactaaacatttatttctcatagtcctggaggctgggaagtctaagttcaaggtgctggcagattcagtgtctggtaagggctcgttcctcatagacggcaccttctctgtgttgtctcatggtagaaggggctagctagccctctgggatctcttttatatcagcacaaatcccaatcctgaggggtctgccctaataccctcaccttggcagttaagatactcgcatgaattttggggagacacaaacattcaggccctaggagtctaattcttagttgtgtggcaccacccaggcatttcagtgcctttggcatctctgacccttgcttacttactttcattactcactttcccatcccctcatttccaaaaagttgctcagggatggtcctgcccttgttgaaaaggacaaaatagataatcaagagagaaagatagtaaaagttactcatcattcccttcacttacatgtaattgcttttaacatgttgttatatatctttctagatagagaaagcctaaactctactctattgcacattgagcagtgcccactttattttacaagtgttcctccatgaagagtggtgcttattgtaggaatctcaacctctttatgatcagatgggacagtaagactaatgcccttgttacaggttctttggggtatggtcttctttatataaatgatgagtttccaaggaggcatataatttgacaagttagtatagccaacaatgtgaaaaaatcagtacttagaatattatacatctatttcattatatattaggttcataatatttgatctgttcctatctccttctcatacttaatgacatatattatacttctccattgtcctatatggtagctgatagtcacatatagcatttgaaatgtggctaatatgagtggaaatatgctgtaaatgtaagatacaagctggattttgaagacaataaaaatgtaaatttcacctgttttttcctactgctgtgataaaacttaaattacattaggtggctcacattttgtttctgttggccagtgctgttatagaccattttagatatctagtttatattccactctaagcagtgttgttaaagatattcccataatatggcagttgtgtcagttagtgccaagaaggtatggggaagggatcctgagtggcaatgttgaaggaattaatacgaggaaatgggcttatattaaagctgggaggatttggtgagttaacagtgatttttcaattggggtagttttatcccccaggggatacttgataattgctggagacatttctaacagtcaagtttctaggactttttttttttttacctcttttaaattggtaaataatgattattatttaaaaatctaaggaatattgagaactaaagtccctccaaatttcactgccttccttagttaccatatcaattctatatgatatttttgttgttacggttttgttgttgttgttgtttgaaacggggtctctttcacccaggttggggtgcaatggtgtgatatcagctcactgcaaccttctcctcccaggctcaagtgatcctcctacgtcagcctcctgagtagctgggaccacaggcttgtgccaccacaactagctaattgttttgcatttttagtagagacagagttttgccgtgttgcccaggctggtctccgactcctgagctcaagtgatccacccacctcggcctcccaaagtgctgagattataggcttgagccaccttggccggctatcgattctgtatgatattttgccttttaatttttttttttttttttttgaggcagagtctcactctgtcaccagggctggagtgcagtggcacgatcctggcttactgtggtctcaacctcctgggctcaagcattcctcctgtctcagcctcccaagtagctgggaccacaggcagggaaccatgcctggctaacttttgtattttttgtagagctggggtctcactgtgttgcctaggctggtgtccaactcctgggctcaagcagtccgcccacctctatctcccagtgtgctgggattacaggcgtgagccaccacactctgcctctgtggtatggggcagttcagatgatatcatgggtggacctgtgatgtaggcaaggtatgaaaaaagagagaagagacaaagaagtggaaatgtagtatgaggagagaaggagaggtagagagagaatggggaaaagagtggggcggaaaaagggcagttatggagcaatgctaataaccatgccgttggttgtttttttttaatcctgctttcagctcttaagctgaaataacctcttaatgccacagtgaagacatgtaaaacatgtaaaagttagtttaggctgaaatggaaatggaaatagatcgacccttaaggttttgctatttaatataccaccaccattaggatgtttacaagtatggaaaagagcatatcatactttaattgcaattgctgtttttttaaaaaaatggaatatccagtgagtgctatagcctagcatactctaatcataatagcagttgccttagtgccgtctttcctctgtgactcaactccctattgtgtttgtgtgtgtgtgtgtgtgtgtgtgtgtgtgtgtgtgtgtgtgtgttctatggaaggcattttgtttttatatatttagtaggaaaattttaaaaaccaaagagaaaccctatttataatacactctagtatcctcaacattggttaaaaagcaaatgttaagtactaatacttaatccaaaagagataaataatggggccgataacagaaatctgtaatagcagtgtagcttgtctactgctgagcaagctttagacgactgcgtttaaaaggaaatagacccatatttgatgtttgtagaacagataggcatcctattaattgtgctgtaatgaagctagatcacattcttgggacataaataagagagtcatagagattttgttctaatacattttgttgggtagtgtactcttcttagtctatttaaaaaaaaaaaacttttacccctttgtctccgaaatgtctaataaatattgattagaaatagtggtaacatttcaaatattagttctaaacagtgatttttttttttttggtagagtttgagtgtacttcagaacatttctcaagttctatggaatcctaaatgctctgggcaataaaagattttttcaccacttatatttggaaaatgctttccaatataatggcctgtttgatgattataggtaatatttaatgagtgcttaaaatgcaccagatattgggctagctttcatgcataatttcctataatcctcacaagtgccctcataagatacattgtttttggatgtgcttttggattagttaaagctcttgcttaaggttacacagccaacaaaaggcatcatatactttgaggaatggtgttcaagagctccagtcattatcagtcctcttcaaaatttttcatttttttttgccctaaattagctacatccacattcatattatgtctggtgcatgctagaatccagctcgatccagtctgtttgagagcgtgagaagagagtttgtaatagcaaatgatgaggccccttcacctggggttgtgtttcttacttttcttgtctctcctaccagtaatcatttttcatgttcattatatatacaactctagctgcaggaagagttttatttgctctcatagagaagagcacttgagtcctaattacctgtatatccttccctttccttcccattaataagactaatcatgctctaatactactattataccaccagggtgaaggcagaacctccatgtttggcttttcttttgtccctgtacacatttgcaggtgaagactatgacacaattactttaaagggaatattgctcctttggaaatatttcaaagctgagacgacccacattttattaaatttgtaagccacagttagattttattatagccaggaaggccagacttatgcagaattttttcgcaagagatttcggcctgttctagagaagactgctaggtactaaattattttctgagttatcttgattttagtatttacaaagccatcactactcagactttccagccccactacccaatgatggaaggaaggagataacttcaatggactttttgttagggttacaaaggtgcccctctttgctgctggggggaagaatagaataagcctttctttgattttctcattattagggattcaggaagttcttgaaggggtgaatgaatggaagagaaatgtcttagtattacatttgtttcttcttcttcttagtattacatttgtatctcttgttcagaataaaatctttttctttggcatatcatcaaacggaagatgtttttagggaaagggatgacatactaaggcatttgctactactgggacctagaatgtaaatatctgatgaagcatcatacttttaagacactgcttctttattatcaagttttcttattttacaaaatgatcctatactagttgatgcaaggtgagctgtgacaaagcatccttttagcctttccttcctgggaagtgtttgtttcagccatgagtagttaaactagtgccacattcttttctttcttgttttttttttagtggacagtataagaggggtatggatagcagtagggtgtgggaggatgctaaaaattcattcaaagaaagtcaaatattgaacagatgagaaaacaaattcaacacctaagctcatgaaatgatttccttgtggtcaacagtgtgcagtgcagtcacttctaagtgttctcttttataaagacaggtctccagagtgagaggatgaatgccatctcctctttatggaaaaacttgtaaagcagaaggtttgtaggcatgtcatatatgccactttcactcttgaaaacaccaaggaaaataaaacacacttaaaaattaatttgtaactcttaaaacactgcaaactgtcctgcggaactttcctctgcagcccgggatgaactcaggcaagattccatacagaatgtttattcctaatagccatagtgactcagaactcatgtcattccaagatagtgtaagacacaggcgaggtggctttcaaacttttgactgtgactcacagcaagaaacattttggagtaagacccactgcatagatagtgcccacacacatctgaaatgaaaatttcatgaaacagtaattactcttactatgtttaatgtgcacctatttcttgtctttttaaattttattcagttttatttcacttgaaaagacagaaagaaaccttgtcttaaactactgagttgattttgctacccaatagtgggtcataccccatattgaaattaaaaaagacaacaccagtctgcttcaagggttcactgtgcaggtgttcctactgccctcatgtgacagctctgacacctgaccataggtcatctggtgtattcctcaacaaagctggtctagaaccttttattttttcacaactccatgtagcctgaccatcctttctctttaagtcagtgatttgggaggaagagggaagtttacatttgcaccttctcagcctgggtcataacactggagcagctgcggcctgattctcatcagctgaatctgagccctgcaagcagggtgtttcctagagccatggttaatgctacatctaattctttgttacgggctagaacagaacatggactttgctgagaatatgtatatgggatgtggggaggagagttgtgggaaggagagaaacaataaaaggaagaatgagaaattcctcttgggcacatgatggtgacattcaccttaaaaaaaaaaacctgccagtattttttaaattggtgatttgggggattggggtggggatgactccttcgttttatttcttgctgcatttgttttgtcttctgaattatggtacctacaccaaattagttttagttgaaaaacaacagcaaaacagattcattcagaaaagttacaaagaatgggtagaaaaaaaattaccaacagtccagtttagaatttgacttctctgatatatataatactgtagcatgccatgtagagttacagtaatgacttctttttatccttaacttcacgtcccagttcatatgcttcaaatttcagttttgcagagggttaggatcatgtttgacatagtattgatggtcagagtcaaagaatgtgttctgaaaggaaggctttggccatgcataggaatcaagcctttctcaggaaagagacaaggccaaaacaccaccgttagtcatcctctgtttcactatgtctttgcgtatattctccttcgcctctctgtgcttgttgccacctggtacgatggaaacaataacggtacccaccttgttgggaggagtcatgagactacatgccgagtgcccggcacacagtgagccctagagcgtgagaggccagaatgtggaggtattcattgttttatccctagtgtctaagacattacctggtgtgcagttggtgctcaataaatatttgacaaatgaataaataatgttggctagaataataattatggtattagagaaaagataataagagacagtgggactgatctgggctgatcacatgcactctttcaaataatttattatgagtttgggaaaagtgaatcagttataagacaaacttatgttcttttagtcaatttaaacaggagtaccagttgacaacactggtaggcattggtgacgtaaacataagcaagaagtggttcctgcttcaagaagtcatagtccagttggatacagcaaaggtcacagcatagcatgaggcgtatggacaggaaaggcctgcattccacatggagctgggtttggggctggtgatgcagggaagctaagttttgaaggataagtagccattagaccagccgaggagggactaagaaggacattgcaggcaggggaagggtgaagtccagagacgtgagatcatgagatcatgagcggtcaccatgtcatgagacggaattaaggttgagagttgagccctgcaggcatggcagagccttatgctaaggtgtttgtcttctatcctgaaggcaatggagaactgtggagagattaagtaggtgcagtttgtgttttgaaagagtggtgtgtggtgaaagtggatcatagagtgtggcaagatgagaagtaaagggatgggaaaaactaatcctcctgcagtttagggacaggcaggcacacatactccattttcaaaggcatcccaactgtagcaactaaatggtggcaaacaaaacaaaaacaaagccttagtgcgaacgtagaactgttacaggtggctcacaaatgatattaacagtgacaaaacaacaataatctaataataatgctattgctagttttattatgaaagcagaagccagagctgctgacttttctaacaacttttgcaggacatttaaatccctctagctggccctttgttcctgtgttgccatggagtgtcaataagcccagctcagaataacccaggcagtgaaatgagaggtacagcttgctcactggcatgttggctggccaggttacactgttttcattgctcccatcttgggaggagcactgggcagctggttgccctggcagctgtgaaggtgtatgtctcttggctgcccagagttcgaaacggaaccaaaacttgcctgcctactgagcatgtgcagctcctgactgagctgatagcaactgaaaaaagcccactgagcacctgtcccttgtacatcagcccctggccgactgccatttaggacaatgtggacttacttagtagacaggtgaggtgctgagcagattttaatggtctgaggaagatcttgggaactttggccctacttaaaaggaagaaaaaaaaagcagcaggcttctgagcagttccatttggtgcttctgtggttagtgggtggccacactggctacgtatgtacagtatgtgcctgaagacttcatattgttctccttacagcagttcagtaaactaagtaagttttctcttcgagagaaaggctttcctaaaagtctcctagtggtagccatccatggtttatacagcctcagctttagaaagttttggagttaaactattttgtttcattttatacctgctctttaatccctagtgattgttagtcatttctacaaggtgtctctttgctagattattatttctcagtagtccaaatattggcacaagtacaatcacagaatagaatcccagcatgtcaggagctgtctgttcccttttgggatttcttccatttccttctggactttaatctcctcagtaagcttgccattgttggacagacttggtggccagtgtggatggaagcaggctctggaaggaaatgcttctgaaatgactggtggcattaaagctactatttaaaagtgaccctttgtagatacttgggttatctttaggctgtcagtgatctgcagctacaggagccagagggaatctgcggaaactcttgtttgttgctctcgcctggatttgtgtttagatattcttgctccccagccagtggcctcgtgacacatctcagatttagctggctttcttctgccaaagtccaagattattgtggaagctgggaatggtttgccatggcacagattgaaggggagggattgtgtgtttgaaaagccagttcagcttcacagcactcaaatgagatgctttctgtttctacctggagtgtaggcacctggagcctttctgtgggcccaggggtaaaaaaggacaagctcaaaatgactcaaatttaactgtctcattgtgactgtaagatctttattctgtgactgataagccaatcttgttcaatatgttaaacctgagaattaatgaattgttttggactatattaattagactgataggggaaagaagatatgtaaagcaaagatcaagttataaaggctgggatacagaggcacaggcacatcttcctggggttgaagacatgggattcctttcttcattaacctttcatggagttctggacttggtagggccttgggaaatgaatggggaaattggaggatagggaagtagcattatcagaggcttggactctgccccaagtttttacccttttgactgttattttaaaatcgctttggcttcatctaggatggaaagtaaatacagtaaccccctatttatccatggggaatacattccaagacccccggtggacgcctgaaaccacagatagtattgaaccttatctatactacatcttttcctatgtctaggataaagtttaatttataaattaggcacaggaagagatgaacaacaatagcaaagtaaaatagaacaattataacaataggctggcatcaccactcttgtgctttggggcagttattaagtaaaggaagggttccttgaacgcacctgcaataccatggcagtggatctggtaaccaagacatctgctcagtgactagcaggatggtagcatctacagtgtgggtacgctggacaaatggatgattcatgtcctgggcaggatggagctggacaacgtgagattccatcatgctactcaaacagcatataacttagaacttaggaaatgttcatttctggaattttttgcttaatatttttggactgtggttgatggtaggtaaccgaaatagtggaaagtgaaacggtgcataaggggggataagtggggactactgtagtctggaagttactttgttcactctgtgcttttctgtggggcaggataggttgtggagctagggaaggggagtttaactaagtcaggacattttcacctttagctgtgggtgtcacagtgcctaaaggctgcatttcaagacttgttaaacaaattggagccctgcttaacttttgaagggtttgtctctgtagtttgaaagcttccagaaaggctgtaggggtgtggtggaggctcgctgatggtaaccacagctaagattggcaaccttggaggaggcccagtccatgaatcccagagagagaggtagagtaggaggcaagaagagaaattgaagtggagagctaagcacaaaagccacctgctggctttttctccactgttctatctcatctagagcccattgttaaatgtttcctgtaaaaccaaaattctcagtgtagagcccaggtaggaaacccttactgaaatgccatacactctctggttagcccgaggaggtgggggaaacaacaaaaagtgattcctcagaatcaaccattcttcctgtggcgcgaacagagcttccagcctgagacattcaatcgatggaaccacattcctggctctctcctaagactaaacaaggaatgacttctgaagtgtttacaattcactgggactttcttccctgttcctccagattattctactctctgttactctccctataactagagctccacttagacatggccattggcacatacgctgaggagacagtattttttggtttttaaagtattcctcagtaggcagttcccggtaggccttgtaatcctttgtttctccaaagcagagattcaagaagtttgaagacagaatgaagaaaggggtcattattttctcccgtattaaggagttaaaacaactccttaatatgctgtatttgttaaagccaagtctttgcaacattcagagaatcataaaaggcatggaaaagacagacgaatatcgtcttaggtcattacctcacagtgttctttaatttgttagtcacttgaaaacaggctgagttttttggcttctaaatagaaggtgtggctgctgcaataggcttaatttacagggattatttcagagacaaggagtcagcccagacacaaaataaacagatggcacttttttttttttctcagcttcagcagttcaagtgcaggatgacttaggaatccttatcaccttcagcagagcaagaaggggaagatgatgtaattctctcttccccactccctattgaaggtgccattatttcaccgatagggataaaatatggcagcaaagaccagggaaaaaatgacagcaaggagcaggggcagctttttctctactaggcagccaagtcctgcactgacccctccaagctgacgagttgcaggtatgtgttgtgttttgatgattctaatcaccatagcccagagtcctcaaatcaaccatccagagaaggaccacccacagagcccagctgttctattaatgtattaaatagttcctcatttttttaaggaacacttgtattttacctgttcttttaacaaattaacaagcaaacaataaacctaccacaccacaaaatattaatcttctatattcgtgagcccaagtaggtgaacagatgtgatggtatggcaagctcttctaggaagaaatggtttgctcaggcatgccggcttggtgactaagccctgccttaagatctgtgctgacatttaaagactttatgggctcagcctgctctgaaaaccagcatcaggtctctttccacctctaaatcctttctgtgaagggaaaattcattctgaagcaaatattcgtcaggcttgcactcctgccaaccactgacgctgttgtggggtatgtaatgaacggtgagcaaagtattaatagatgcaactcaccctcatggtgcttacaatctataggaaaggtgacattcaacagccatgcagacacaagtatggctgtagctaaaggggggttcctactttaaatctgggtgtgtgaacaaaggcttctctgaggaagtaacatgtaaggtgaaatctgcacagtagaaaggcactgactaggtggagaggtgttgactggagggagataagcattcaaagtggaaggaattccatacttaaaaggacctgagatccctaagcaggaagaagaggtcttttaagaacttccagtaactgaagaggaaactgaagagcatgcaaggatcaggtcagccagcagttgtaggccaggttaatgactggtctctactttgagtgtgatggaagcccgagagagtcaggcttgtgtatctgaatgaatgggaatgccatttcctgaggcagggaacattggcggaagaatacatctggagttcaaaatcatggaagtttttgttgttgatattcaatttatatgcaatcttctttgaatgcctctatttgcccccataactgctgaaatacattttcttcttggctttacaacaactaggtgtcagtctctcggataaggaaaaaaaatgatttgagttccctaaatgagtgttttataatgagagattatttaggcactgggtgtattttatccctgaacgtatagcctgtcctcttgtcagaggatcaaatgcccctcactaggcattccagacggacctttgtgtctctgtcttaggagctggcttgctggcagtgatacctagcattgcaaaatccttcttaaagcctttgtttaatgccagagatctcaaatgctttcaattctggagaggtgccaaactgtgctcccggattaggagacgatggaaggactcctataatctataaacctcatataagcttgccatttcaaatgaatgaattgtttagagtgttggaaggagtccagggatacttgagttccttttttagctatacaaattttgagctattggacttttataattacagtctaatttctgcattatgatttgtactactttgaggtgaacttgtaaaaaattcagcctgttccttttgctgccctctaggacaaatcatggccatgggccggtttgtttacttgtagcattttcttatttgtcttttatgtcaaagacattagtgggaaatgttggtttttgtgcaccatttagagtaatactcagtttcaatgccttaaagcattgcagagtgcatgactgggcaggcgtgaataggtaagtccacagtgttgtgattgctaaagtcccacttaaacataaatgtgaatacttttaccatgaagtacaagattataccaaattgtggacagtttttaaaagtccacgatgttctttggtctgcctctctctctgctagtccggcattagactcggaggaggtgtgcccaggtggtgaactgaggatcatagagagcaggaaaaatctttttaaagagctggccatggtgaactcctgggattcccagcctgcaccgctggtttgtggagccagccccgtattctccctggcggttccgaagcagtccctgtttgtggtcagaactccctgctgttcccagccagcccaggctgcgagtgttttcacacggctctggctctggtgatacaaagggcacgcagtgccagccataacactgagtaatgccgggaggtgccttctagaacaaacaatgtgggtgagctctgcagagagggaatacctctggcttgacatttaaattactgaattattcaaatgaatgtcaattaggtggagtagactttctgccttctgccagggcacttcctggatattcgcacaggcaagtgtaaaatactttacatcagatacggtgcttcctgtcagtactgttgaaaatcagtcacagaatctgattatctgttccttggtgttccttgatgtgtactgtatttatatcacagcctgaaagattaggagtccacacacccatacctgtggccctgaaaggggttttgtgatcattctcgaaccccacccccactcccacaccaaataaaatatcacaggcccacacatgttatgcttattcctaaatttgacaagactgaaaaagtgagtcatggacatttggagtcccgctgtcttccttagaattgtggatattaagatccgagaatgctattactaccttgctttaaaccttctttgttgacttcataattctagttcagaaaatacttccatctactccactctgtcagatgaaattgccaaggtggcacgtagcgaatgtgagtgtgtgcatgcatgtgtgtgcacctgtgtggtcatcctgtcattcttatgaatttagggtcttcatttatatttgggtatatataaaaaataaatacatgatgaaggactttgctaattagttatatgggaatatacaaagtaagaagatttcacagtggatgaggaacagaataggaaagagaagttagtgaaggttttgtacttccctgttagctgttagactcagctcagggttctttcatatcagagattgagttaattattacgtatcattaacagttgtctttccttgcctttttccccagttgtggagggtaggttatgaaaaccctggtatttcacatcttactgaaaagaatcaccaacttacaggcagttaatccctggttgtccacatacaactacaggaagtatataaagaatttaaggagagtgcttaataaacagatgaatctctttgatttagtttgtgaccctgcaggattaaagcctaggtacaccacagagttaggtataatgagttaaattttactgaaggtgatatttacttgaggctgtcacgtctggcaaactctttaggttatagtccaaacgtctgccaggctccctgcacagcctgtcaaaaactagagaccttggaaaagcagtgccccttcctgcatctgtgtacttagaatttagtttgggatggaactttaaaaacagtttattttgagagcacattagagaaatgattgttgttgttactttatttttttaaaatttggcatttttaaattacaagcatgggtgtccttaatcctttggttccctggactgtccgtttaggaccatttaggaccaatgatgagcaggctctcttctagtctagcgttgctggtttattgttattcttagcagcccatacgttcagcgagctgagtaaatcatactcgtcaattcattgtcagtccatgaacagctctctcctactttatttttattttgctccttcatcccagcgctaaccccttatccccaaaccagtgtcaacaggcacatactcttcaatgggttaggtatatatcctggggtatctatgatcttttaaaagtactcgggatgttaaaatacatgtttgtgtttcaaatttacataaattgcattatttcaggtttaagcatagtcttttcaattctctgccatagatcacaagcaaattagtctgacgccatgaactctccccctcactccacccatccacttccctccaaagaatcatcacctgttgggcagcatagttggcagccctcagcctgctttgtgccattcaagagtggcaagcatgtctagactccctggaaatattatccttcagctctcttttggcaagtgtaaactttttgctggattatgtcaacagatatacatgtttctcatcctcatagaaatagattggtgctggaatttccttcggatttctccaggcaaggaacataaagactatctctttgctcattaaaacttttgctcattaagaatgtttgagggctcttgattctcaggggtgagactggtgacatacatagactgtcagcggctattttggattttctgctttcaggcatgtctttgctcttggatgagccccttgtggttttcaaaggaactagcaagtcaattataaatagaaggctgtgtctgtgtgtctgcatgcacttactctgtgggacgaggcacccacattacagtgggcagtgaactatttttccacttctttgaagagggaagaagaaagattaagaatgcttttctctttttgagataacccacatctctacacacacccacacaaatctgtgtaaatgaacttgacattttcaaagaccttaccttaaggtctcctctggaaagcacagccacccaacctgttattttaagaaagaagcatttatctcctagacccactactgagggttcagggattagaaggcagcctctatgtgccatagacctttggagggagctcggaaagctgaatttcctaatatgaacagtgcttcggcaaaagtggcctcagctaactaatcagtggcctctaggacttggctgtttacattttatcctctgtttccttccccactagtagaaactgtgggaccagcaagtctaaactaatcatactgacaagggaagagaaaagggtaatgtgaaaatgcagatgcaaataagtattctcagaaagagacaattaagcagagtgattagatgtgcttccctgatcatccgtttctgcctctttccattgcaccttgaactccctaggtgtgtattcttccagtggtcccacctgtcaccttactgttcaaacattattcggttctcttggtctccttgtgccctcattctccatatttggcaccatttttttcctgccagccaaaaattcttaagcaggtgttaattcccactataatctatgtaaactttagtgttaccactagtgaaaaagttagtctaggcatctagctggaaatattggtaccatggattgtaattatagattgtacagccttgcaaactcttattatattacaggttgaacatctcaaatcccaaaacctgatacttgaactgctctggaatccaaaccttttttagcattgacccaatgctcaatagaaatgctcattggagcattttgaattctggatttttggatttgagatgctcagccaggataaatacaactattccccaatccagaaaaatttttaaatttgaaacttttctggtctcaaacatttcgagtaagggatactcagtttgtagtatatttctgccatgtacctgcaagaatgtcagcattccttgttttacgagttgatggggatttgtacagagctagcaaaaattagtattaatagctgccatatatttaggagctttttttttggaatagaataaaggtgataaacattatgttccagtaaaacattttattttgatgcagtaattgggatctgagagccaatcacgctgaaggttatatgaacaccacagggggagaagctcattttcagaagtctgtggacagatgatagccagtctttgtcctaatatgatctaaaagggtgcacagcttatataaatgaatcgctatgttgagaggcaattattatttgttggttggttaggtgacaaggtgacagaatgtggacctcatggttgatggtgatgcttagcttgactttctgttgatagaggtgtttggaatggtcattccctcaatgaaggtgaaactcatacggtaattcctctttttttttttttcccccttcctttctctcctttgcagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggttcccatggacttttctatttctagatcaaggggttttgttagtgttgtcctgggtccgtgtgggttaaagatctaagtagctatgaggcattccacctacattttgaatcagaggcgaagagctacaaggaaggtcaccctgggtgaagaagagaaaggaacagccttttggcatctaaaagaaggatgggcattttggggaatgtaagcaaggtgatgtccatcttggggacagcttagctgaccagttagctttctcttggttgctgtgactcaggtgaacagctcccaatacctttttatgttactgacccatgatgtcattcataatttctggaacaattctgctagtaaatactcatctctgtgtcaagtgtgtagggaggaaaacagaacggactggtgactgagtggaatgcctttcctgttttatgaggaaggagataaaagaaggctcactgacctcttctcccatatctgatgcccagtgaccctatcactgaaacttgaagcaggatgagatttcacacaaaccctgtagtttttgtggaatcttctctctaccatcagtacagattgcatatgctaaggaaaccagtccagctctgaaactgtttccctattaaatgagccctaaattgcaatcttaaagtctctgcaaacatttatgtaaactcattctaagccaaatttattctcttaccatatagtacatttttaataggtttagttatttaattttgcactcagaaaaaagaaacaaaccaaaaagtggaggagaggtaacgacgagcatccaaaactagaaatgtcagccagcaagaaaggaggcagaagaacaaaaaagctgatgcaagatcatgttctagtaattttgaagttatggtgatgactttaaggcatatggaaaaggttaaattctgacaagcaaataggattgaataatcaaagagggttttaaaagagatcaagtatttacatggttaaaactaaaagggtccttgatggaataaaatttactgttatactttgtgagttaaatttttattaattgggtggatggacataaacaaatgtctgaattcatacaaacattattataccaactgtgaagtttctaatctgcagatcactctgctagaccttgagttttaatagaagatttttttttttgaatttaaggacattctaatctgattagcgtggccacagtatttataattcagcgttgcattttgttagttttacactttctcatgcaaatgacatatgccatggagtatgatgtatgccaagctgttgattagttgggcttggaaagttaaacaaatacgtaaaggaagttaagcttgtgattggatggctgaagagaccagtaatatggaaatgggtaaggcctctgtagggaagaacagggcctgatgacataatgtcatggagaggtctgaacccagggagtgaatcagtgaatgaatgtctgaataagcgagtaaatgaagagaggaatgaatgggttcctaggcagaaattgtgatgtaaaaaaatcagtgagaaaccagcagtagacacccaggatatattaaagacagagaccacagatgggtaatttggttttagctcaggtagccctttctcttaaggatagtacagtgtctgtaagggcttgatggcgaaacataccaaatccaagttaatgagagtaatatcaaagatttgtacagtactttatattttaaaagcactctcacattcatacattaatgcaattgattctcagtggaattttttcaaattctagttgtgtctaattgaatgatggttaaaatgtctgggccattggccaggcattaggaagtgttttagttttaatacttcgtgagttgtgagactgtgtggtcaggatcaggagctacttgttaggatattggttatgctaataataagtaagcagtgatccttacaactaattcccccttttccctccaactccaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagtaagtcatgaccccacaggaaatcccaagcataaggaaggtgtctggagacacgttcttatttcgagcatgaaacgctaaccagtaatgagtgactgaacagtgtacacacatgctgttggttacttatgtcctaaacaagcacatgctggcacctgtgtagtcttcccatatcagaacagccattttagatagacatttaaataagggatgggatttattttagtagtgttggtagttagttacttttctctgaggggtaaagcaaaagagacagagaatggttgcctacagttttggagggttggaatttgtggtcttcagttactctatttttagccataaaagtgctcttttaaaaaggcaccttttgctgaatattaaatattaatttcctttctagattatttcagcatcctgtaatttaaggcttaaaaacttgacatccaaaaaagcagcttttaaattttgtatgctcctgtggtgccctcttgtggagtgcagtcatttggttaaaccggtgttgtccaatagaaacatgtgcatcacatgtaatttaaaattttcaagtagccaccttaaaaacaaacacatgaaaaaacccaaaaagtttcgtaaaagtagatttaattttaacagatattcaaccaaatacataccatctttgtcatttcaacgtataatcgattaaaaaattattaatgtaaattttacattctttttgcttttgaagtaaattttcaaaatcttgtgtgtattttacacctatagcatatatcaattcacaccagccacagtttacttgctcatggcaatgtgtggctagtgattaacccgttggactgcacagtgttagaaactattgtatttatacattaaaaaattattcttttgcatatttttaaatgataaaatcacattaaaaaatgactatctccttctatttaccttttaaaattgcttaccaagtgttcattttaaagacgctttgaactttaagtggggaaagggtatcacttgctctaaatagaaggttatcataaagtgcaaaagaaaaaataataacattctgcatggatattatgctgagtctgatgcctactctgaaaaatttgagatttgtgggtgttaagtgagtgcaagagacatgccaataccaatttgagactccttgtcacaatccgattaattgaaagacaatcaaagtaataactttctaatgtgattcagtgttacttaatgccattgcccatgtgtatttgaaatcattttgcagtaagtcttgttctgctagacagcaagcttcaaagtgtctgatagttctgcagttacacttgccctgcagctccccttatgctggagaagacttcccctcaccagtgaccatctgggtagcacagatgctacacctggacaattgcaggacccacctgtggcaggttgtcacagacatttggtagtgcctgatatgggctgggaaacatcccattctactgcctgccccatccatcactgggccactttttggtatgtaaaagggggaagtaaccttctgtagcttccatttacctactgtttaaactgtggtacagtggaactggggaaagagaatgcagtataaggacatttcatttcaaaaagtagagaaatacaatttttttttgttagatatatacttagaagtctatttcaagctttaaggaaaattaaatgagtttattgagttagtagcaagaagatgtgaggatgaatcctgacaaagctttagcaaagcaagattctaaaataggttagttagaacttcattcctcagagctgctaacataactaattaccaagggcaataataggaatatctggtataaattactgtttaaatggcttttagaattttgagagaggaatggagcatatgccaaaatagtcctttaaactcaaccatgtcatgtgacagtgtatcatgatataataacacagtaaagaacactatttaaaacaagttgtcattattggtctacatacttgcttatttaagcaatatgctcatttgtatgtttcaacaaagcatgcccttactaaacagcacgtctacattgaaaaacaagccttggccatgcatggtggctcatgcctgcagtcccagcactttgggagcccaagggggaagatcacttgagaccaggggttagagaccagcctgggcaatatagtgaaactctgtcttgaactaaagaaaagaaaagaacaaaaagaaggcttggcatctgagagttgggatatacgtttgttagtcttgggttgattttttatttttctttccttaggtctgtgaacagggtttagaagcaggatcatacattatggaaaaaataacacattagtttaattttcagaattattcttctcgaaaaagaatgaatgaataaggagcaaaaagaaccgcaagagagaaaatggttagggagatatgaaactctgcttcatctacactcattttcttgttgattatcccttttgtggtttttaagggttctaaatttcttccgttggatgctcagcttttggtaattttgccgatcaacagtacttcacagtggtgctcagaagaagtgaaagaagatgaaattcacacaaatcaatgtattgctttagtaggccagccaaaatgtttgggaaaggatgagctttggggaatattaagtcaatattactgcaactctacctttatcacccatcggcacaatattgtttattacagataatctatgcctgatacctgcttcttggcttatgctgagagtaagaaggaaaaccttatcaatgaactaactgggaatctttttgccaacaccttcatttgtagacattgacttggggcactggttttatgttttcaatgaaagctttatttgttttcttttctgatttgtgagtgattcacattaagaaatgataagtaggtgttgatatagttttgctcctcacctgcctaaaaggaaacctccatccaggcagcccgttgctgcctgcgcttaccaatttaatgatccacatggtcattggagtcttttcgttacaaatcacattagagttgtttgttccttattcctagtttgtttgttcctaattagagttccttagttggtatggcaactaaagtgaatcatttgacagatacttagtgagaatagcaaaatatgtaaattatacccagttcttgaagttgaaaggaccccccccacccttttctgttccacctgctattctctctactgctttccttgagatcatatctgcttcttgggctttctgatttacaccttcaactttgtctgctcagcttctttcattatatattttatttggaaactctgtgtataagaaaggactacttatccttcgggaaaacctatcatatattaggtgaagtgctagcttctagtattccgaagaaataaaacttttcctggccaggcgtggtggctcatgcctgtaatcccagtgctttgggaggccaaggcaggcagatcacctgaggtcaggagtttgagaccagcctgaccaacatggagaaaccccgtctctactaaaaatacaaaattagccgggcgtggtggcgcgtgcctgtaaccccagctacttgggaggctgaggcaggagaatcacttgaacccgggaggtggaggttgcagtgaacccagattgcgccattgaactgcagcctgggcaacaagagtgaaactccgtctcaaaaaaaataaaaaatacaaaacaataaaaccagtccttcttccttcttccagaggagctttacatgtacactaacaggccacgtgtcccggattgctgcccttcatgtgagttacaatgtcatgcatgctaatactccaaagtgggagctatattgctcaatcgtttcttttcccccttgtcttaaaccacaggatttattggatcattcgtgtacatcaggaagtggctctggtcttccttttctggtacaaagaacagtggctcgccagattacactgttggagtgtgtcggtaattcttttttttcctttctttgtgggtaatatgcaatgttagttttgtttttgaagtaaaagatggaacttggaaaatctgctttttgttacctgttgtttccttattaaacttatgagatgtggtctctattctgtatgactaatgttggagcacctgaacttgtttaagctcttatcaaaggagtccatcactaatgagtacagagaatgcagagtcaaaagctttcagttgtaagtggaccctttgggatgatgagagaatgcccaaaaaatgaattgatatggttgctccttaccataggtattggatactctgaagtaagtaggcttttggacaatgaacttctttattgcaattctttaattcctctcattcttttcttctttttaatggcaataattaatgaacataattaatgaaaccaattctagcaaagggatctttataactcctttatttaaatatgagctatatacatttctccatggcctctcacattttcccaatacatgaacatatttgtatgtagacataatcatgttgtatatataatttatgtcccttttttcagttttaagctcataaacatttcatgtgtttgtacacatcacaaatatttttgaagattatgtagcagtccgtggaatgatagtgtaactataaccatactgcttgaaaaagattttgcacacattgcttctttcttttgagttctcagaaaaaattcccaggaactgggggttcctgggtcaaaatttgtaaatgttttttacagcttgttttatatgctgctgattggctctctaggaagatggtacaaagtgcctatttcctgatttttgttagctttacttttatgtggtaggtatttgcaagttccataatcattttcctaagtttctcttttagacggcttgcagggatggctgcagtagcaataatgggttggcaacctctccacaccctcctcctagtgctcatggtttccgagggctggattttgcagctcctgccgttgcatcttttgcttttgggaggtgacctataagctgcccccaccacttggctgctgttctccagattttcttcttgttttcatggaaagagggacacccccagtctgagtagtagaaacggggaagggcagaggtaggaagagcagtggctgctgccccaaggcacaggagtaaccagcgggagcttggttgtcctttctctaggtctacggctattgtcactgtttgctgcttctcgcttctcctccacggcagattgtgaatggagaaaataaagatggaaaagccccaaatgtgctcattaatttcaaccagagttgtcctcttgtactaactagtatcttatttgattatgaacaagattatctggatagtggtgggaagacattgaaggggtacatttccctgtctcatctcccctctccactactattccatgcaagctatctcaagattagtcttcagagattggctccagagtccaaatggcaaaatagtaatgcacctttaaaatatgtagtttctggttctatagatattcctcagcattcttttgaaacagtataaatatcattattgcattttcttgggttaggactaaagactttaataaaagcagtgcctttcattagcttgtagttagtgtgttcatgtggtacagcttttagtaaaaatatatgtgatgaactgcatggatggtatgttatttttggttcaaaaacatgggaagttgggttaggggagtcatttctggatgacgatcagtgaaactacaaatttcaggtgccttaagggagcctttttgtggggctccatggccagggctttcgggcagctctgcttttgttttaggggcttctgcataatgatgaatttgcaaaaagcatttaacaacttaaaagcatttgaaaaccattgaacaatatttctattttaatttacctacctcgacattcatcttctgttttctttaaaacaacaaccaaaaaaaggatttgaggtaattttgtatccataattccctgggatattttgctctcatccctaatgacaaaatgaggacaaagggaaaataaagatacaaaacagaaccaaaggcaggaaaagattagcataccattttctggcagccagtatttgtagtatcttagcactaggcctcatcttgagctataaatgctggcaaattgctatggctttattaaaaggaatcgtgtactaaattatatttgtgtgacccaacagtggcccacaatgagcacttgttagccacattgaacatccttttgggttagttgttggtatttaatagggacatgatattcttgtcaggtaatctagatttagtggttgtgattatgattcaggtgtgtctcctggacagaactgcttctctctccatgtttgggttttcagtgacttagtgttccagcaaagaactgtattcctgtatatgcaggtggtgctgcagctgcttattagaagctgtgtgattccagcagtcacttgcctgggtagaaagccccactgccctgcaagttatatctcttgccttgttatctaggctgattataccccttgttgatcctcatagtcttgtggtaattacctcctcctccaacctccctgatcacccctacctataattaaagagaagaatggaagagggagcatgtagttgacaagctgacaagtgtgttgctgctgcaagagggggccatgcaccaaacagattagatcacaagtagagttgccacgttttccaaaatgtattctccaagtagccttttcagtgtagcccacttgtagcatcacaggagctgtctgacaaacaaatacccatgaccagtatcagaagaagtcagaactcttctgggattatgtatttaagactttgcaaatcctctttttgaaatacatcttccgccaagaaatctttatggatgcagtggctgcatgtcgatcttctagcagcattgtgttttggtttgtttttgttttttaatccttagaacacacattttaaacttaattgttctcctttgtggaaaaaatgcatatctaaattcaccaatttggacagtgcctatgttgatcctgtgtgaagggaaggaaccaaggaaggaattcagtttactgatgtacacttttttggctttcagaacacaattgaaatttaataatctgtaccatttcctaagttttactttcatgtgttttaaaagtcatatgcattttatacctttcaacagaggaatttaaatgtaaactgagtaattagcagctaattatacaatgcagatacagaaggcagtttgttatcacaatatggtagatgagaggggcagcttccaccttatttttgtatgtctttataggccaaaaaaaataaaaaataaaggttgtgatatttatattcccaagctgagtttctccagtaagcaatggagggattaagagttgcatgcactaaattaattattcttaatgatgggctggctgcctccaaaatgactactgttctgtgtcacctatgttttgcttttcatagggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtaagtacaaggataaccccctcattaattgtatctagggagaaacaattgtctgcctttgctctctccgttttggtgaatgtgaattcgagagtgtctcctaaaaagcaatatagggatccttagcatttatatgctgtttaattttctcaaacaccagtttcttatttaaatctgcaaataagtttaagactctctggatgatgaaaaggaaatccactagtgctaattcttattcctacatctgcagatcgttatttaaataacaaaaatttgccccatattgttcacttcaaggctcattggttgttctactcaccccaccctttttgaatatttattacttgaatcaaactaagaaagatctttggactatttcctagagattcacagctcccagggatatcgtaattaaatgcacattccctcaaactaggcatcatttttaaaacccagatttgcagagggattcaggatacattttaatttagaaactaaagcttagcaacatttgtgaaatatgtaaagtgcccgttgaaatactgctatggcagtataaagggtgagcacactccttaggcccattgacttctgtatttttgaaaagtttctctaagtgtgtttatactgatacatgtatggtgaatgctgcctggagtgcttcttcaatagtggatataaagtttatatagaatttaactctgtataggatagtgttggccaccttatggctattggattaggtctggctcataggaaggccattgccaaaatttatttctattttagcactgccaatttagtatttaaatgagtcaagttgtctgcaaataatgatttgacagttgtccaaagcttcaaagctttgcttccgtggtgtggtggtgatgttccatctcaaaattttttcagtttctgtagttgatttctcacttttgcttacccatcgggtcctagtcatcacttaatcctcctcacctcagctgtcagctttccctttccaattcatctctccacttggagttgtcttccactggggagcagagatcattctgttcagtgtctttgatggctcccaaatttcctgcaacacttgtgactggtattcaagactccctggtttggggctcccaggaatcacttaaccatcctttacaagtatgccccattcagttactactaatactgaccattccttgagatcgccacaaacatttaggtctcactgtcctttctcaggttgctcttgatcactcactatccttttcacatcctccaaccattccttcctccgtcaaaacctcttggccccttttagttttgcccagtggaattaattgtgcttttctgcattccccgactttgtacctctgctctaactcttaccacacactgccttgtgttgcagttaaacgtctctgtgtaacaagaatagcaacagtagtaacaataaacatgcaatggatcattactacgcggtaaccacaggtgcattatgtgcattttgttacagaatcttcaccatgaccataagagaataggtactctcattttcccagttttaaatgttgaggtaaccaatatacagagaggttaaatagtggaggtggaaattacatcaggcagcctaactcttaaccacagttttgtactcaaaacacaaacattctataaaagtactctagaatcatgaagcaaaggtagttatataattcacgcttaagagataaacagttaaaaagaaaaccctgcttatttaaaagtaatttttttcctgatggtctagagcataattaatgggacagataaacttcttccctaagacctaaggggcttagtgaaggtgagataataaaaatgtattcgtttattatttatttatttaatcagaagctcctttttcttgggagaggaaatcagtagaggctacacagatatataacagtaatttaatttcttttgagtggtgctgttagagtttggggtattttttaagaaaatcattaaagattagtattatttggttcaaactgttaaagcagaaacattttctttattaagaataactaatgtccaagaacacattttgatgcatattgtggccagctaagggctccaagagaagcagcatcgaggggaaaagcagactggggagcagggaaggagtgggagactcagggctggccatgggaataggcttagaggaagagagagaaagaagtagagggtgaaggtgctaaaatattattcagtttgctttgcatatgtcccataggtgaaaatgtgaaattattttttctctgagtagaaatcagtttgtttggggacagtatggcatagtcagtaagagtctgggttctagaatcagacctacaggaacctaatatcaattatgcgatctacttacttcatgtggtttttggaggattgcatataaagttccaggcatgtagtactcaataattattagctgcctctgttgtggttgccgatgatgatgatgatcaaataggggacctttcttggctcacagagccttcctatgcaaggtatcaggacagctagcactaaattcagagttgatagcaacttaaatagctgtgtgatccttggcatctcccagcaccaactttattatctgtaaaatgagcataatgatgtctttcttaccagcttgttgggaaaaatctcatgagaaaatatatgtgaaagtgacataaattttatataaagtactatgcaagtataaagcattttaatgtattttctcttacattttcataagtcatttaattcttcctcaagccatatccgtcttaaaaaattttttttctcacctctttttaagtcccaaacttcactgtctaccagcgtggttcatatatgtgagaataatcctagaaaggcacctctgtagcagaaaaggcaagcacacgtcacaatttatttcataagataggaagtgcccctaacttccagacagtcttctgcatgctcaaaagttccctccagatgtctagaaaaatctcttccgggctgatcgcgatgtctcacgcttgtaatcccagcactttgggaggccaaggcaggtggatcacctgaaggtcaggagtttgagaccagcgtggccaacgtggggaaacctcatctctacttaaaatataaaaaattagcccggcgtgatggtgggcccctgtaatcccagctactcgggaggctgaggcaggagaatcacttgaacccaggaggcggtggttgcagtgaaccgagatcgcgccattgcactccagcctgggcaacaagagggaaacttcgtctcaaaaaaaaagaaaaagaaaaagaaaaatcttctccaacctcttcatccacatttgtcagtcactcactttacttcaagaccagttgagttgccacttcctaatggaagcctattgtaacacctagtctgaattactataatttcctgctctgggctcatgttgccctttgaagatatatattatagtacttttcgtattttattgtagtgttttcgtttttacatctgtcttctttagccagcaaacactatcatcttggtttttctgtgtgtgactgacagatagcatcataaatactcatatatttggttggtttctttttttatttcgtgaatcagtcaatcatttaatgtaaacttgccccctttattttacatctgagcagatataggctaaggagcctaactgagttgcccagtattagacaagtaaatcacaggcagagtcaggactagaatacagtactcaggttttagatttgatgttcttttaggatggttgatgaatggtctgttcctaaaatatcaacatgctgaagggcttggcactatcattatgggtgagcacaaagatattattgctatctgaaacttaaggaatgtaaaatatcttttaaagtattacttataatgaaatgaatatgaaattttcctattagcagtgcccttttaaggaataaatgctattatttttctctgttgatgcttctgtaaacctcctcttagggcaattggtcagtttaattactttttgttacagatgacatttactgtgtaggtcgctatttctaaatactttaagttataatgtggaatcctcatgtatattaatttttttcttgctctctccaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggtaaatttctaaaaatatttttttcctcaccagttttatttttgtttcaatggttaggtgagttgcatctctcccccacaacatgttatgcaaaatttcaaacatgcagaaaagttgaacatttacaatgaacacctttatacccaccacatagattctcacattaacattttactatccttaagcattattatgtatttattcatctattcatctccccatccatcagtccatatcaacctttgatagagttgaaagtaaattgcagacaaaggaattctttcttctgatgatttcagcatgtacactagtatatcattgacaagaatgcattatttgctttttctttttttcaggtaaaatttatatactgtgagatatacaaatcttaagagttttgacaaatgttgtaaaacccaaatccctgtcgagatacagagtttcccattactcttgacagttacctcaggctcattcagtcagtccctgccacaccccacctcagaagtaaccagtactgttgcattttggtttcactaaccttcacataaagtaggtgcacaataaatactctatagaattagtttatcttaaaagtggtctctaaaatcattctgtaaccaaggcaaaagaatcaagttaagaaataggaaaataatccccgaactgattcactcttttccctgttaggatagctcattcttatggtgttagagtagtactcagtgtagctttagttgcattataaataagagtattttcatttatagtggcattttatataaaaccatgttcttcctggattcctagaatattggctaaataattgtgctaatgagaattcagggccctctacttgattaaacatggtttatatgatatttatattattgcaattattgttagcctgataaaggtttagacaaaaatagctttagttatgtaaataacaaagtttatttttgtttgtttttaaacataagggatttgacatgttaggaaaatttatttcctttgaatccctttaaagtctttgcttttacattgagaaattacaatgtttcccaagtaggagacgaaagattttaggataagcattgaaagagcatggccctaaagttttttgcaggcatttttagttgtggtgtagaggacttttatggcttattccatggctcttagagccagggcgatttgggtttaaattctggctttctcaattaccctgtatttttgtgcaagtctatttatctatttacctggcccaagtgctgacactgctttcactcagtgagacagggacagtgagggcgaaggcggatggggttgggagttagccaagaggaactccagggcttgacgctgtgccctgtacttctgcgttgttagaaacttgcataacagtgtgatcgtggccgggcgcggtggctcacgcttgtaatcccagcactttgggaggccgaggcggaaggatcacttgaggtcaggagttcaagatgagcctggcgaacgtgatgaaaccccatctctactaaaaatacaaaaaaaaaaaaaaaagaaaaataataataatagccgggcgtggtagcgtgcgtctggaatctcagctactggggaggctgaggcagcagaattgcttgaacccaggaggcggaggttgcagtgagccgaggtcgcgctattgcactccagcctgggcgacagagcgagacttcgtctaaaaaaaaatatatatatagtgtgatcatatattactcatgtaactaaaaaataagcccacctcaccggattctggtaaggcccagaagtattataaatgtctggtaaacaataaggattcaagttgtagcttctgttataatccagtggtctggggagggtggacaaattgaggtggctcttggttttggtttatgggacttggtagggaaggagttgaggggaactttgcagtaagtccagctaattaattcttcaactacatttcttttggcttgtaaccttccaattagatatatgggtttgtataaaaatctgttaaggcgttattattcaggatatggtaaaacaatgcagtgcaggaaacaactcttataagaccataatttgtatataacttaccagtatatacctagcaattaaggatcatgtattagaaatagtgttctatgattaatcctgcaaaaagatcagtattatattgattaattgattgagagaggatcttattctgttgcccaggctgatcataggtcactgcagcctcgatctactgggcttaagcaatcttcctgcctcagcgttccaaaacagctgggactacaggtgtgtaccaccacacctggctaacttttttttgttcttagtagaaatgaggtctcactatgttgctcaggctgatcttgaacacctgagctcaagtgacaatcccatctcggcctcccaaaatgttgagattacagatgtgagccactgtgcctcgtctgtttttctttttattattaaaaaattcaaatgttataatgatcacttaaatcccgaacacctagattcaataattgttaaaactttgtgatgtttgctttatcaatctgtgaccatgtgtatatttttgccaatccatttgaaaataaagtgttacaggcatcacaacactttacccctcaatacttcaaaattcatcccttgaaaatacttaaaaatgcatcttcttcataatcagtttttcatatctacagattattgataattctctagtatcattttatattcattttcagatgttttcagttttttcaaagaggaactcagccaaagtttacaaattgcatccggttgttttgtcatctttagtgtaaaaattacttattactaagaacaaatcacctgtaaaatttagcatcttaaaacaacacagatttgttatctcacacagtctcttgagagtcaggaatcttggaatgacttagcggtgtggttctggctcagggtctcgtggaggttgcaatcatctgaacgctcaaccagagctggagtttccaactctgtgaggacacacttaaagccatgattggcggcaggtctcagctccttgcagggggacctctccacagggttgcttgagtgtctttataacatggtgcatggtgagctgagagggacaaacaggaagccttttataattttataacatctgttatatcctaactgtgaagatacccactgtcacttatgccatagtctattcaatagtccagcatacactcaagggatggggaattatgcctcacctggagatcctagcagtggtggctttaaaatatgtccacaagttctttgaagcttctcccatcttcagaatatctccatgttctatttaacctgcaccttttaaatattctgatattttgactgtttggttctgcaaatggtggaggggcatacagtagtcccctcttttccctgagaaataccttccaatactcccagtggattcctgaaactcaggatagtaccagattctatatatactatgttttttcctattacatacctattatagtttaatttatagattagctacagtaaaagatgaacattagtaacactaaaatggaacaatgatagcagtatgctataataaaatttatgtgaatatggtatctctctcaaaatacttaattgtactgtacttacctatttttggactgtagttgactgcgggtaactgaaggataagtggggggactattgcataggatttgggaaatgttcacagtgtccatagaatcttggggttgattataaaaataggtgaaagaggaacctgtctgttttagtgtaatgcagttgccagtatctttgctaattattaaggatgagataaggtgtgctagctccctgatgttatatgaaattgtcatcccccacattcaaagccgtggagtggaaggtgaagcattctctgtagatggcttgagagatcaacaagggatatttgcattgcagtggtttacagggactgcttgctccaatttggcacttttcattacaacaaatgttataggaatcattttcagtcagtctgcatatgcatcagtaacataaaatcatccacaaataaagcatgcatgtatgtgtctccccactggccagtgaagaaagcctgtctccctaattgactgaggaattctggaatgagtcatggtttaagaaagcatttgaaagccatttaacctgagagttgtgctttcaattgaggtccagttaaatgctgtctgtttccatgattctagagaaaaggcctgtgggtttggtcagcattactgctcagataagcagctcttcctttaggaataaagcagtgcttatagcaatctgccctttatgtagtgataaattactttaaatgctctatctcacactgttggaaatttgtgtttggagactagtgagagcagtggtggagcttgagagcttaatttgcttcttgttaagccacttagaggctcacatttaacatgtgagcctgttttcctgtggacctcaaacacaggccacattggtttagtgcattggtctacaatttacccaaaactttttgtctctttgaggttcatatattaacctgatagccttagaatgtttctgacatttagtcccttttctgctctcaccccggaaataatcacaaagggcattctagggatcattctgagtgtattgcaacagtgaccctggatccacaagagggcacttttgattggggttggtttaaaatccttcagcagcctcttatgagaaaggaagtgggttgattacattgttatcttcttcctttcaggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtaggtatctaatctaatataatattgtcttaatccaagttctcttgatccagctacctttaaaagggctgaagggactattgaaattcacattgttctttgaatcgtacgtgtcgagttataggcattcatatttgatttatggctggtagatggagtgtaatggcttttatgtttgaaatataccacagtaagtgatggttgaaaaccagtatttctggaagagaccagccattccttggtttttctttggatttgttccagatttcttttcttttaaatttttaaaattgatacgtaatacttgcgtttatggggtacatgtgatattttgataaatgtatgtaatatgtagtgctcaaatcaggacatttaggctgtacatcaccctgaacttttatctttgtgttgggaacatttcaaatagtctcttctagctattttgaaatacatagtatattattgtcaactatagtcatgctactgtgctattgaacattagaacctattttttccatccagctcttatgtttatagccattaaccaacgtctcttcatcccactgctatcctcacccctattccccaaccttctcagcttctggtaactatgattctactctctaccaccatgagatcaacttttttagctcccacatatgagtgataactggctgtatttatctttctagataaaagattatgtcacctgcaaagagggacaatttgacttccctttttccacattgaatgtattttatttctttgtcttgcttgattgctctgcctaggacttctagtactattttgaataagaatggtgaaagtaggcattcttgtctttgttccagttcttagagaaaaggctttcagcttttccccattcagtataaatttacctgtgagtttgttgcatatggcccttattatgttgaagtatgtatattccttctgtacctgctttgttgagagtttatatcatgaagggatgttgaatagacacagaactttttctgcatatattgagatgatcatgaggtttttgtctttgattctgttgatgtgatgtatcgcattaattaatttgcatgtgttgaaccttccttgcatcccaagaataaatcccacttaatcatgatgtgttatcttttttatgtgttgttggattcagtttgcttgtattgtgtttaagatttttgcatctgtgttcattaaggatattggcctgtagttttctttttttgttgtggtttccttgtctcgtttggtatcagggtgattctggactcagaatgagttagggacaattcagtcctcttcaattttttggaatagttcaagaagaagttctatttaagtttggaagaattcagcagtaaagccatccaatcctgaggttttctttgtgggaatactttttattaccgactccatcttgttattcatggtctgttcagattttaaattttcttttggttccatcttggtagattatatccatttcctctaggttttccaatttgtttgtaataatctctgatgatttttgtattcttgtggtatcagctgtaatgtcttcttttttgtttctgattttatttatttgagtcttctctccttgtttcttggttagtgtagttaacagtttatcagttttctttacctttccaacaaactaactttttatttcattaatcctttgtatgattactttttggtctctattttgtttagttttgctatgacctttcttattctattaattttgggtttggtttgttcttgcttttctagttccttgaggcccatctttagattctttatttggaatctttcagcttttctgatgtaggtatttattgttacagacttccctgttaccaattcttttgttgtatccgattgactttggtatgttatgtttccgtttttatttgtttcaagaattttttttatttccttcttaatttcttcattgacccagtggttgttcaggagtgtgttttt

SEQ ID NO: 14969 - DNA, 8911 bp, Human
caggagtttaagaccagcctggccaacatggtgaaaccctgtctctactaaatattacaaaaattagttggacatggtggcacacgcctgtattcccagctacttgggaggctgaggcaggagaatcacttgaacccgggaggtggaggttgcagtgagccaagatcgcgccactgcacactccagcctggcaacagagcgagactctgtctcaaaaaaaaaaaaaaaaaaaaaaattaaaaagaaatataccttctagataacctacatttttgcatttataggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtattgttgttaattttgcattagtgaaaaatccagttttccattattcttccatatctttaatgatcaatgacattgctaactaagttataaatgagtgaatctcaagtctttttccttatcaagttgaactggtttaggagattagtgcctagagttaagagacaaatgtttacaatacttttccttttgtagccactttgagtctgcagttgtcagtaagcctttttaaagatagaatttgtttacattctctggaccttttaaaattcagaatagtaatatgattataataaacttcaaagtcaagttatagaaatagatgtgagaaattgatctgtaaatatctgaaaatgtctttagtaaacgggtattgcttttgtaactgttttcaactgtgtttgttggagagtggaattaatgaagccaagatgtgcctggtttggtattcataaaggtcaactcactttgcattgaggcaaaagttccatagtgcctgccccttacagatgcatgtatacagagattcacagagctgccaaatgcaaatctatcgctgttcctgaaatgtcaataacccaacatttgtacatatcttacatagaatagctagttattactctaacatgccaagatttaatgaacaaaatttaataccacagccaagcagtgatgattccattgacagactctccaggagcttataatctagtaattcagtaaagtgacgtatctcagatagttttcacaaaatatagtgaagacacacaatacagaatggtttatttgcaaggtgttgagaaatggttcacgcaagtcaaatcacttttgagccgtgttttgaaaaatgagtagatatttactggcaattgggtttgggagaggcgaacagaccattccagatgttatttcacttttattctttagatactgatttaacacctctgtaccaactactatgatacagatgctagagatatgctaaatgaaacagcacatccataaaatgtatagtgtgatggagtggagcacatcgtaaacaaaagtctagaggaaactgaaagtaagggaagaggtacagaaaattgaggctacagaaggggcaaggcccaaatcatgaggttttccatatgcagtaaggagtttggaatccatcttagcaatagcacttgaggtgtagtggaaataatcaagattagagacagggacttggaataactcaggcaataaataatgagagcctaaactaaaatgatagcataagggtgtgaaaaggttgggggggcagggggtgggacatgttaatgatacttaaaaggacagaaccaactgggcacagtggctcacacctgtacttccagctgctctggaggctaaggcaggagtatcacttgagtctggagttggaaaccagcctaggcaatgtagtaagaccgtatctctataaaaagggtggaaccaacaggactgggtcattgatttaatatgggggttgaaagtaaagtgaaatatgatgggtgctcaggattctgatttgggtgggtgactacctttcactgaggtaagttatataggaaatggtttctggaaaacattagtaaggtcagtttttaaacactgaatccaaggttgtcttctggaatatccaaattggttatgaccagaatgtgattcattatactaagctaaaggaatagattaaagaattagcaacagtggccgggtgcagtggctcatgcctgtaaccccagcactttgggggaggcccaggtgggtggatcatttgaggtcaggagtttgagaccagcctggccaacatggtgaaacctaaaaatacaaaaattagccaggtgtggtggcaggtgcttgtaatcccagctgcttgggaggctgaagcaggagaattgcttgaacccggaggcaggggttgcagtgagccaagatcacaccattgcactccagcctgggtggcagagtgagactctgtctcaaaaattaaaaagcaacagtgtatatgcaatagttgcaagatgtaagatcacccaaagagtatgcagagggaaatgagggacagaacccagaaatattaatacccagggagtgaacaggaggaggaccccaagaagttactgagtcagatttttcccactcatccaggtgaaagtttaggtcaataatgtgaaataccagagggattaaatgtctacagaaataaaaccatgtctcacattaagacaaacaagtaggttggagggatattttgaaaggcaaggtgatattaaactttattctgaaagtagtttgttagagaaagaggcatgataagagttgcagttaactgattggaaactatgcagcagatgaaactggaataaaggaaactcatcaggaaatgattatagtaataagggccagaaataagggcttgcttgcctgaactaaaaacaaagaggatacaaaggttctagaaatatttcaaaggaattagctttaattcagcaatactcattgagaatcacctatgcacctggctctgaagatgaagtgctgagtaaacttagacatggaccctgctatcatggagatggcagattattggtcagaatgctcttacctgtcattgtagcaattttgttagatccttaatacctctgaattgctaataaacttgttttggctgaaaaaatagtcctgtgaattttaccatgcagttaaataagaaactaaaagcaaacctaaataccaccaaaaaggttagtagtctgttatatgcattagccttaatctaaggaaatattttattataggtctccttgaagaaaatgatattttcaggaatgctcaagcaggtgttctcatcagcactaatagtcatccaatcttaaggaaaaacagaatatttgatggatttgccgcaggtttgtattttcttttcttacctgtggcttatatatagttctgcaaagtgtttgatgtggagtatattcattttgttttgcttattaactaaaatgtgcaaagtgtgctgaagtggctgaatgcctgttcattcacttacaagagcacctaatcaagttctggattcttctactctaagccagactcctaagaaatattgctcttattgcttagtcgtgattatgaaacatttattgggatagaataaatgcaggcttgtattaccactaggaatacagatagattcaattcctcagatgaatttaccagtttaaatctgcaacagaaaaagagatgttaaaatggatgcaaatgaaatccaagtatcatgtatttaaactttaagacagttaggttggtgcgaaagttaattgcagttttgaccatagtcattgataagtgaatgttactgttggtggttgaaataggtatctacattttattcagtagacattaagagggttaatgtacttctataaaagaagcagtttacatttgcttgctaatttcaggtttttaagaagcagtataaagtgatgtatctacttgtttgtaaattttacttcaggtattgaaattacaaatcacgcaactgcaacactagaaggcaatcagatttttaacaaccggtttggaggcttatttttagcatctggtgttaatgtgacaatgaaaggtatgttggagtctgctatacctataaatatatgcaatatgccatgaaagataatcagaagccgttttataacttgattccttatgtcactctccaagttagcaacagtttaagatagattttgaaagaaacagagctttggttctaaatggttggagtatcttatacaaggaaaattctattcttagctgatttcttacaattacttcattggttagcttcatttaaagctcttaaaaatagtggctcttctgttagaataatcctataatctttggtttttaaaatattaacattcctctgaatttttacttattctttcttttattacagataacaaaataatgaacaatcaagatgccatagaaaaggctgttagtagaggccaatgtttatataaaatatcaagttataccagctatcccatgcatgatttctacaggtaacttagaaatatatttgagtcctgaaaagaggaagactgatttcctttttaaattagcaatgcctagcatttttggctatttgccggtgttgagactataactaactgaaaattttatcatcaatctacttgaagatcgtgtttaagactgtaactgtgggtaggcgtggtggcttatgcctgtaatcctagcactttgggaggctgaagtgggaggatcactggagcccaggagttctaaaccagcctgggcaacatagggagaccctgtctctacaaaacaaaacaaagaccataactatggaaaaacctaatgctacagtaactgatgtcattcatgtaactcatgttgtgtaatgttttcctagaaatttcaaggtaaagatgtcggggttaagtgtttgatatatcccagtcactgtgacagttttgactcttcacgcctccaaaaattgttttcagcccagaaacatttgagaggcttttaaagtggaaagaactgcctttatacaatttacaaatcatttctcttccctccgaagacacagatgacaggaaaatcacttactccattaaagttccttttcagaattaatctgggctggagccacaaagaattttgttttggtcctcttaaagccaaaggtcatagtaatatataaacagaatggaatgttttgcattaatgacatgtttgagaaaagtaatttaagcttttgctttttagatgtcatacttgtaacaccacagatcgaaatgccatatgtgtgaactgcattaagaagtgccatcagggacatgatgtagagtttattagacatgataggtatgtagcacacttgcttgatatattacccaattactttccccctcacttttctaatatttgggtttcattttgctttaggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataatgttgtctgaatttaccacctttgtcagaagtcaactcaaagcttccaatgtagtcagtctataattccttaatcaaagtcagcaatttatggacagcttcagcatctacagttgacctttcactagccaggcaaacttcccttaaaattaaaaaaaaaaaaaaaaaagtttttttgttttttcatagtgcatcatcccttccccttttactgtttctttgaaacttaaggtcagttagttataattccattatagttagttagttaccgaaataatcgtagtgactgattcatcttctcaaattctcttgcttttctatgtcccttttgaataacttcctctgggagattagcaagccttgctgcattaaagccatagcttttaggacaagctcccttaatgaatttatagaggaacgtaatagtctcctggctggggtcttcacattcattttctaccatgcatgccttaagaaagaaaaatattagcgatacatgtgctagcaagagaagtgccctctcaaaaaaccgaatttgtggaaaaaaacaatttgcacataccatatgtcctaggcgcacagcaacattttgagaataatcttctactaatgaatggtagtgagttgaaaataatgtacgacattttatagtctcagcaagttctttaacaactgcatttgctattgccgtcccatcaaatgttgcagtacctcttcctgttaaagtaaaatatgcataaggaagtaactcaaaggaattaaaacaaaaaaggaattaaaacaaaaatgctaggacagaaaagcaacatcggttagtacatccacgtctaaaagcattctataaataggccttgtttagctacacgagtctgcttagcagcccatggggagtgaggtttcttttaaagaaaatacagtatcgctcaaggtcataaacttcctgagtcctcctattagtgttctcatccccgtagtataacaaatgttttattacaactaaacagtgtaaggcctaataattaatgggtaatcaaaaacctttcacaatatcaccttttatctccaactatcggtctgtgccacaatggtgagtgcgtgctctaaaaacattcatattgtttaaatgtacttcagataatcttctataaaaatagttatttgtacaaatgtttttaagatagatagtcttcaaatgagaagtttaatgtcttacctaattcatccacaagcaccagagaatgtgctgttgcatgcatgagtatgctggcagtttcacttaattcaacaaaaaatgtactttcaccttaaaaaaaaaaaaatcacaaatgaatactcattttgcaaatcatattacataaattcatcttctaggttatatagctatcatgagctacacatattggtataaaagattaaatctcattaagagactatgcaattattggccgggcacggtggctcacgcctgtaatcccagcactttgggaggccgaggcaagcagatcacctgaggtcaggagttaagagaccagcctaacatggtgaaaccccgcttctactaaaaatacaaaaaattagctgggcgtgatggcatgcgcctgtaatcccagctactcgagaggctgaggcaggagaatcacttgaacctggaagcagaggttgcagtgagccaagatcgtgccattgcactccagcttgggcaacaagagggaaactccatctcaaaaaaaaaaaaaagagagagagactatgcagttcttaaaaagtgatgtttttaaagtaacaccagaaaaatcaaatattagatttaaaaggctcatatacaagaagcaaatatcttttatcacatctaaatgactgaatgagaacttaagtgggaaacaaaaaactcacctgacattattctgtctgaggcaccaagtctagtaaacactctatcaattggtgtgagcctgcacacttcagcagggacgtaacaacccatctgggccattacagctaataagccagcctgtgaatgagggaggaaaaggtcttttatgactggtagtaacagtttcataaacttttgtctttcttatgaacccttacgtaagagctaggcactctaaaacaactttcacaatcacatgtacgttggttctgttctgaaatccatttgctaacatgg

SEQ ID NO: 14970 - DNA, 6664 bp, Human
agggggtggacccaagtctagcctgggcctgagaaggtggcagccgcagtgggccaagccaagaaggaaggaagaggcccaggcaccccctgtggacgcattccacctgtgtggccccctgctgccccgtggctgacagcccaggcaatcctcagatgttgggccagaggaaacctgggcctgagtggcaggaagggggctgagaaagaggagtatcttctctacaccatagcccccagcccaggagttccagctctaaagaccctggcccctggtggcctcatgccctggcctggagcgcaagctggctgttctcccattgcgcagaggcttgatgtatggagagtcaggcctccaagctgggggcatctgctggtgcctggagtctgaacttcaagccagagcagcgcttgttgtcaagaatttcgcactgggggtggatgagaaaaggaggacttctccttcagcttgagccagggcaggccctggcgactgccagcactggagccttgtgggagagtgggttggtggattcctttgtgtgtccctgtaacttccccgggctcatccacagctgtgagaacatctccttcctatgggtcctggtggttcctctccactaccccaggatcccagcccttagagagcagccttcatgatggaggagagcaggggtgggagctctgactttggggctagagactggaatccgggagcagcagaaaggtctgggaaccccacttccctaccgctccactccctaggctcctgttccagaggcagctgtgtggatgacctcaatcccacaaacatgctttgttcctgagaaaatggaaagtgtctgaggtttggtcgggggctgggtgtctccagcagcagctctcagggctcccccttgtcctactccccacccaagatggggcctgattggggagaaaatgtcttcagtggctcttgctctctctcctttcagctccctagtcccaaaccctgagaaatcggaaaaggtgggagagaccttctctcccagaggcagtaggagggaaatcatgaccccaggggatggaaagatcctggggttttgccagatgttagcaggaggtggcagggggtacactgcactcccagtctgtctccagttcccctctgcctcccccgacacttcattttccttttttctccccattgctggcaaaacctgacatctggccatctgtgccgccacagctgctgcagatgttacaggccaaggctgtccaagctggtgtgacacagcgggggtggggggatgagggcagagggtctagctagggaagactggctgtgtccagcttgcaggatttccttcctgcttgaacctaagctgagcctctgaagttcccattgcttggctgattccccgggagggaaggcccaacctctcacactggcctcttctaccattcattagtccagcacctctctagcattccactgttttctggatcaggaggggcaggcacagcccattcccgtctctaagttctgtactccagagctctggttaagggttcctttatccatattcctaaagtcccttcctgggagtcaggagagggtgggagtactgctcataaggagtagagtggggtggctccctgcccctgcttctcccacgctggggacagtcgggacagtggaggctagacgctggctgggacaggaaatgagtcactgacccaggaaaagccccctccccctagatctgctagggcctagataagaaaacaacttctgcttcctggttttttttctgacctcttcctaccccgagttaaatacagaaagaaacatgtgggattcctggtttcccagaagcaccccttccccatccccacctactctgaactggcatttcctatgccgggtctcttggctgtgttttgaatgcagaggcctctttgccaggagccaagccacagcctctctgtgtgaccccagttccaccttgtgctcctaacagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggtaaggagagggccaggccaggcaggaggtgggtggtgaccagtggaagggggcaaaggatgggtccatgaggcctgggtgccagtgcccctgctgtgttccccacaggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctggtatgtcttcaggggctcatcttgtgtgagaactggcatctgcgtagggtctttgcatgtgtctgtctgatacatggagacttggtctgtgtaaagacctgcatacacagcatgtttctggaaatttagtatatacgggatctgtttgcctggtatactcctgggggctactatgtacaggcagattgacacatgtgatacatacttgggggcttagcatgtgtgaatatctgcatgtttagtacaggtaggaactagaggtgtgctgagactgtcatgcttgttgcattgggtcttaatgtatgcagaagcagataaacagagggcttaacatgtgtggggacctgcatgcctaatagaaatgctgggactcagcacctatggagaatggtgtgccgaggagatgcgagggcttagcatgtaccgaacctgtcatgcccagggcattagaactttgtgtgggcagatacttacttgcctggtacatgtggggtcccatgtgagtgctaaaatcatcacatctgttatatgagggcttagctcttagtgagacttcatgactgttacatggaggcttgatgtgtgctgaaattgtcatctctgggacatatgggggcttaacataggccaaaaccctcgtgtctagctgggtcatcatgtccggtgtctggggagaggttagcatgtgtaatatacatagggcgggggggttcttgctgcatgtgcacggacaccaccctgctcacgctgagagaggagtggagactcctggggaagttacagagggtggccctcaggagcatgggacacaacctctaaatgggacccctgttccccacagggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaaggtgggggctgggccagccaggtgggggtgagtgaggcctgttgtggggtgggaatccccactcatacctactaatggatgctgcccccacagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggtgggacaagggtcaaagaacggagtgggtagggtgcaggcaagggagtgggatgtggtattgggtgaggttgagggccggaccatccccacatctgcatagctaacttccagcctccctccaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaagcaggggcctccgtgtgtgtgtgtgtgtgtgtgtgtgtgtgtgtgtgtgtgtgtgtgttcagggtataatggggaaggaagggtttttgcagactgggaggctcagaatctctgctagacctcatccttgcagggtggggtggaggggggccgggccatggggtgggaagtctctccccatgaaggggatccccgccacagctaccctccctctggagctcgtcctgcctccctgctggcagagggctttttccctcatgtagggaagggaggggtttgggggaggttccagatgaaagccagggtggcggtggggttccttaattggctggtacgaatagtctcctccgccaacagccctgcccaaagcccgcagagcaaggacctggttccgatccccagtctgggcccagaccctctcagcccccttccccctcttcccaaggattagcaagggcggcccaggatcctctcgcggccgcacgttttttgccaaaaaaggcaaggatgcagctgcacacgccgcgggaacatctggatccgattcccggcatgaatgggtcacgccccgtcccccgccaacagtgattcaagtcaagggtggaggcgggaatgagcgaggggggctgtcccccaaagtggggagatgggcggggcgacgctcccctcgcccgcccggcgtccgacgtcccttgtccctgaccctggctgccgcggtctgggctcggccgaccgtccggctgtcggggcaggtatgcgcacacagtggcgcccacagctgcctgcagcgaggcccggccctgggcaggcggaccctcggcgccctggagtgggagagcccctccggcccggcggaaaccgccagattgtatgtatctcatattaattcctcccgtcctgtgggcgggcattattacttccattacacagaggtggagacgcctgcagtcagctgccccaagtcacataggtagtcactggtagatcctggactctaaccgctttctgaagccatggttgacattttctttttttttttttttttttattttactttaagtttcaagatacgtgtgcagaacgtgtaggtttgttacataggtatacgtgtgcacggtggtttgctgcaactattgacccgccctcttaagttccctccccgacattttcaacaaacttttacgaatgcctaccacgtgtgtttataattaataattaccacatatgcttacggttttatttgtttctctctcccaccagcctaaggactgagatcctgcctgccttgctccccgctctcgttctcagctcccggcacttactatgtgttcagtaaatacttgttgaggaagagcagtccaagcatagaaaacaactggcgcaaaggcctggaggcctgagaacatacggtgctttggggaagtagcaagtaattccatttggaggaagtgccaggagagtaaaatggcaggcagagcccaggtcctaaaaagccgaatgccaagttgcacagacctcaccctgcaggaaatgcagcctatggaactgtttaagcaggggcctgtgatgagcagagttgtagacagatcatgctggctgcagcatgaataatggagtggaggggtaagatgagcaggctggttcggaggctagtgtagtgtggtccgggtgagacatcttgcagcaggtagcagctcgagtggaaaaggcaagacttgctgcctggagtggggatgaagaaacatttaggggcaggaaggcatcaggtttgagacacagtgactggaggatggtggtggtaaggcggtccacccacctaacaggaagtgagagatgtgcagctacaaaattgtttgatttatttcaatacaaacatttttcagacttaacatcttagaaacccagacatataatcaaggccaggcgcagtggctcacgcctgtcatcccagcactttgggaggccgaggcgggtggatcacctgaggtcaggagtttga

SEQ ID NO: 14971 - DNA, 10149 bp, Human
gattgcaccactgcactccagcctgggcgacagaacaaaagcctgttactcccctcccaacccctccccccaaaaaaagcaaaaaccatgagttttttaaggctgccaagtggccgtgttaatcagtgttcaaagaatgttaaatgccacttttaggaccattagctattacacttcatgcttcataatgaggtgtctcacttactgtgcgtttaattaaatacatagacaaatttagggatggggacatatccatgggcaaggcctgcttactacccgctgaagcaaaggcaagaggagaaacacatcctgcagagaaaaagaaagccatataaaatggaagtcccacccctgatgcctgggggcatagacagactgaatttaacatggtaaatggcgcagctggtgtagaaaaaaaaaatcatccatttggagatgaagagcaacgcagactcagtcatggttctctataaaacttatgtttttagatttgcaggtaatacaaagaaaggatacctataaatccaagttataattattttttgttgctttttatttgtctcaaaattacttttcagttaagtctggtgatttgatttaaatatttgagacttatggccgggcgcagtggctcacgcctgtaatcccagcactttgggaggccgaggcgggcggatcacgaggtcaggagttcgagaccaacctggccaacatgatgaagccctgtctctactaaaaatacgaaaattagccgggtgtggtggagggcgcctgtcatcccagctacttgggaggctgaggcaggagaatcgcttgaacctgggaggtagaggttgcggtgagccaagatcgcaccattgctctccagcctgggggacaagagccagactccgtctcaaaaaaacaaaaaaacaacaacaaagaaagagacttactatccctccctacctcatgagttgtttcttttctctctctttctctttttttttgaacccaggctggagttcagtggcacagtcatggctcatggtagccctgacctccttggttcaagtgatcctcccaccttagcctcctgagtagctgggaccacaggtgcgcgccatcatgcccggctaattttttagtttttttgtagaaaccaagtcccactgtgttacctaggctggtctgaaactcctgggctcaagcaagcctcccacctcagcttcccaaagtgctgagattatacctgtgagctactgtgcccagctataagttgtttctttagtagtgggcatgcagtttaccatttgggattggtccagatgcccagactgagtttgtttatttcatttgatgtggttggagcatctgcttttttcagtcagtggcctggcattctcagaattgttcgttggtttcaacaattaggaatgacaaaagagcacctatgctttgcctttgcagtgcttgcaaaatttttttttattttaaatttttgtgcgttcatcgtatgtgtgtatatatatattgggtatatgggatattttgatacaggcatacaatgtgtaataatcacatcagggtaaatggggtatctctcacctcaatcatttctcctttgtgtgacagacaacccaattatactcttttagttattttaaaatatacagttaagctattattaactatagtcactctgttttgctatcaaatactttttgaagaagtgcttttatacaggttctcatccatagactttaagaagatggcagctttttcatataccttaaagtgctccaaatgcccttcctttcaaagagaacaagctgacgtcccttgacctgttaccatactccaggtcctctagatttccctacatttttactttcattgtgatttactcagttgctgctaatattttctttctcatgaagagtcagaatattctcatttgccatgggaagagatgttggtgttctgctttagttatcactttgccatatcttttctttgcagaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgagtaagtattaatactctagggagggagcagtggcagagccctgccctcagctgcttcccaggtttgtccactcttggagttgggtggccagggcttgaataggatggatcctaagaagcataaccaggttcccctctggaagctgcactcttctgtcagtcagtagggtcttccaaaagctgatgtaagttctattttttgccattcaaaatgagatagtacatatctctagagctgggttttgttttgaaggaggattggaatagatgtcacagtgaataaaacatttttattgggttctaaaatccttcatttctaagagttcaagttttttcacttattttgctttgcctagatttttggcatctcagtaaagaatgagtgggtaaagcaagtagctgtatatttgtttggaacttgcaaggatgaacaggtccccagcatgacaactgaaggtttctttgcttaaacatcaaagctttctaaggctacaaatctgagccttcccttggttgtcacctaatggctgcctcctcttgaaagaaaaagccgtcgctctacttgtccgtaaagcgtcagtttggcaaaacttcagatacagggatgcttttttaaaattttattttttaattgacaaataataattgtacatatattcatagagtacatcatgatgtttcaatacatgtaatgtaaacagatcatggtagttagtatattgatcatctcaaacatttatcattttgtgttgggaacatttagtatcctccttctagctatttgaaactatatattgttagccatagtaattttacagtggtatagaacaatagaacttattcctctgtctatccataattttctatcttttttttttttttgaggcagagtctccctctgtcgcccaggctggagtgcagtggagtgatctcggctcacagcaacctccgcctcccaggttcaagcaattctcgtgcctcagcctcccaagtagatgggattacaggcgtgtgccaccacgcctggctagtttttgtattttttgtagagatggggtttcaccatgttggccaggctggtccagaactcctgacttcaagtgatccacccgccttgccctcccaaagtgttgggattacaggcgtgagccaccgtgtcctgccaatttcgtatcttttaacaaatgtcccccatcccttacagaggatttctcagcctctagtatcctctattctactttttacttctatgagatcagcttttttagcttctacatatgagtgagaacgtgcagtgttttaactttgttcttggcttatttcacttagcagaataccgtccagttccattcatgttgaatgacagtatttccttttttatggatgaatagtatttcatggtgtatatataccacattttctttatccattgatctgttctcggacacctaggttggttccatatcttggctattgtgaatagtgttgcagtaaacactggggtgcaatatttccccagtgatataatgatttcatccaatataatgatttcctttcttttggataaattcccagtagtgggattgccagatcatatggtagttctatttgtagttttttgagggaccgccatactgtcctccctagtggctatactagtttgcattcctaccaacagtgtataaagaatttccttttctctacatccttgccagcatttgttgttttttgtctttttgataatagctattcctaactgggatgaggtgttacctcattgtggttttgatttgcatttctgtgatgattagtgatgttgagaattttttccatatatttgttggccatttgtatgtcttttgaaatgtctgttgagatgatatgcccattttttaatgaatttttgttctctattgagatatttcggttccttatattttctggatattaactccctgttggatgagtagtttgcatgtattttctcccattctgtaggttgccttttcactcttgtttcctttgctgtgcagaagcattttagtttgatgtaatcctgtttgtttatttttgcttttgttgcctgtgttcatgagattattcataaaatctttttccagatcagtgtcctgaggctttttccctgtgttttcttctagtttctggtcttaaattgaggtctttgatccattttgagttgaattttgtatagggtaagaggtgagggtctggtttcattcttctgtgtatggatatccagtttttctagcaccatttattgaagagacagactgtcctttccccaatgagtgttcttggtaccttcatcaaaagtcaaatgtagatatgtggcttaatttcttaatttctctattctgtttaattggtctatgtgtctatttttatgccagtagcatactgttttggttactacaactttgtgatatattttgaagtctggtagtggtatcaactaccagatttgttctttttgttcaggattgctttagctattcagagtcttttgtggttccttacaaatcttaggatttttttccataattctgtgaggcatgtcattggcattttgatagggattgcattgaatatataaatttctttgggtagtgttgtcatcttcataatattaattcttctgatccatgagcatgagatgtatttccattcgcttgtatcctcttcagcttatttcatcagtgttttatagttttcgttatagaggtctttcatctccttggttaaatttattcctaggtattttattttctttgatttttgtgtctattgtaaatgggattgccttcttgatttctttttcagctagtttgtgtatagaaatactgatttttgtatattaattttgtatcctgcaactttatggaattcatttatcagatgtgagagttttctggtggggtctttaggtttttctatatagaagatcatgtcatctgcaaatagggacatttgacttcctgctttccaattggggtactctatttcctccccttgcctaagtgctctggttaggacttcctagacacagggatgcttttgtgctaagttccatcttctgaccccagtcctaacctcgactttagcctctgtgggcagtgggtactttggaattcttagcttttacagactatagatgaagcacagataaccacttctctccttacattccattcttcactgtcagtatcgtaagaatctggcatgttcattcttttttggtgctgccctctcgctcaaccttagccacgctagagctccaggccacatcctgaaaagaattagcctggcctcccagtgactttcttgatttggcatctgtcagtaatacagctgatttgcccaccaaaataactactagccacccctgaagcctgagtgcataacatgtcgtcccagtttgccacgcccacagacagttcctttggctcctatttggggagagtctcagccccatcctatgaattctcttcccattgttaaacagagacccagctgggaaaacaaggctgaaattctgaccccatcgtctctttccctgatttgcagctgactggggcagatggaattgattcaaaccctggactaagggggagtgaaaggggtgggttatgataaagagagacaggctgctggacttcttcagaggtgggccctggccaggggaggcagaattccttcatgctcaccctttactgtagcaaatcaatttgcaatggcttatagctgctggagcactgggtctggggcccccccagctgcatgtggagtaagttgattgcaggctagaaggcaaagcattttttgccttttacgtttgtgtggcactgagacctgaagaagccagatttggaacttaatcaaaagcttctgagagttggatataatgacagcaccggaagtatttggtctctgtgttctctttcagctatctcacgtgagagggcagtggaactccttaggaaatgtctggaggaggtgagtagttcccataggatcctgaaaggaatgtttgtctctctgtttgccagtgttgttcctgttcctcagttatattttttcagatttttgccagaaggtgtaatacatacccactaaccagatgtgaagttgctaccagggatagagtttggtgtggatagcaagctcacttttctctcacagattacctcctcaatgtcagttttataatttaattctttctggtttatccaaaccagtggttctcaaattttagtgtgtgtaagtatcacctgggaaacctgttaaacagattgccatctctgccccaaccctcaattctgagtccactgttctgaggtacaaactgggaagctctgctttaactggcagtcccaggtgattttcctacaggtggtaactgaggctgtacttgaagaacttctgctctagactttatttttttatttgagacggagtttcgcttttgttgcccaggctggagtgcagtggcacgatttcagctcactgcaacctccgcctctgggttcaagcaattctcttgccttagcctcccgagtagctgggattacagttgcccaccaccatgcccggctagttttttgtatttttagtagagacagggtttcaccatgttggccaggctggtcttgaactcctgacctcaggtgatccgcctgcctcggcctcccaaagtgctgggattacaggcatgagccaccacgcccatccctgccctagactttatacctgctctgttcttgtgccacctgtaattgccatactgcctgctcccttaatagtgctcgagtctttgtaatctgtgagaaaaagcctcccctaagaattcaggaggaccatagaaagcaactaggaagctttgggcagaaggggagagtagactttggcttgcgaggacaggattacagaacacaccctttctaacactactccttagagtctaaggctttgggtatagatggagaatgggggaatggggaggtcaaaaaccagccacattagtttttttcattcttttactgttcctgtggcttaaggatgaacttgacctcgtggtttagtaagagagtaggaagataagagcaggagcgttgggagtaatgtcagtttgcttcttacacaaaccttttgttttcagtccacagtgcccaccccaccccccgctttttttttttttttttaagagatggatctcactttgttgcccaggctggagtggagtgcagtggcaccatcatagctcactgcagcctggatttctggaactcaagcgatcctcccaagtagctgagactacagacaggcaccaccatgcccagctcattttatttttaagagatggggtcttgctatgttacctaggctggtcttgaactcctgggctcaagatattcttccacctcaacctcccaattacaggcctgagccacagctcctggcctctgcttcgttctgaggacaatcactctttgttagcttattatcttgagacattttaagagagacgtctgtgtttaccagactgatgggtaacagactatggggaacagaacactggattgtctcattctttcgtcagctgactgaccagagacaggctcttagttgcacctcccagttcagcctccctgcctcccagtcatcctccagctgctgtttgggtaccctctaccactagagtactagtgccctactgccaactgcctccagtagaatatcagttccacaaaagcagggatttttgtttgcttgtatccccagtgtctagaacagagcctggcacatagaacttagtaatcatttgttgactgatttcctccatgtctctctgcagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtaaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctaggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacattagatttgggtgtcttatacactatttaatacgccaatgataaatgccttacaccataagaagaaagctaatcattgagtaaatgggagaaaagagatgattcacgtcactacagttgattcaacctccaacaccaccatgaatatgcataggtttgagcttttagctagattcctgagtgtaaggcatctattttaaaagtgccacaggttggccgggtgcggtggctcatgcctgtaatcccagcactttggccgcccgccgaggcgggcggatcacctgaggtcaggagttcaagaccagcctggccaacatggtgaaaccc

SEQ ID NO: 14972 - DNA, 7331 bp, Human
aacaaggtgacattctgccttcccctttcagctctaatgctataaacatgttctattggaggtctacttggtgccatgtttttctcatttcttgctttttgctggggatttgctgtttgaaatggccccgagtacagtgctgaagtgccatctagtgtttctaagcacacgaaggctacgatgagccttatggaaaaaatatgtgtgttagacaagcttcattcagtcatgagttatagtggtgttggctatgagtccaatattaatgagtcaacaatatatattaaacaaggtgtcttcagaaacacacataaaacagacttctgtattgatcagttgataaccacattgtaaacagaagcttgcaggaacctaacctcatatgtcctctaggaagaatgcttcaatattcactaacttggtgctcatggtgactcatagactataactaccttgaataatgagaatcaaatgtaccaatctgaccatgtctcttcctttttcctgcctcagcacaatacaaaatgtaaaaatagaaaaaagaaaagaattccctcatgcctccctctgcacccaagataaattcaaactccttagcatgacattccaggtccttcatggtctggaaggtctttgctgaccttccaggctccttgccatgtggtgtccccaccactacccagcccactctccaatgctcttccattatttttcacaaaggtcctctgcacgctatgtgcccactgcctcaaaggcccctcctcagcatctcttcttggtaaactcctatacatccttcaagacccagcttaaatgttaccttctccggctctccctctggcagaacttaaaactcccttctctctctgtgtcttttctaggacttctcacaatgttgtaactgatctctttatatgcctcctctctcctgtacttggcaacagctttttggaaagagcatggagtatagaaatgtgtgactctctgcagggtgtgtgcatttcacacatcattcattcaataaatataaattgaagcctaactggacaagacaccaggcaccatactaggcacaagggatagagcagtgaataaaataaagccactgctgcatgtgtgtgcaacactgtgcccataattgtggcctgtgtgtaagagtatgctcatgtgaagctacattgtgtttgcttgtggacatgaggtgtttgtggctcctggatgctttgtctgttgaatcctgaccccaagtgacctgctgatacagggcaccttggaagtcaattaggccaaaagaccgtgtctgtgcactaatgagaagctttccccaggtgcccctgcccaccttctccacctctcctgtggttcctgcctggcttgggtttggcctttttaacccaaagacaacatgcatccaaatgagattttctctagtgcatacgtctctctctccctcccttctcctctgccttccctgtatctcagaaagaaaaggcctaggaataaggaaaaggaggaggaagaaacatttttttgaggacataccatgcggcaggcctgtgctgggcagtatacacgcattataggcaattgtagacagggcttcccttgtgtcaggcactgttctaagcacttcacccctaaggctgggttaatccacgtatccaccctatgaggtaggtgttgttcttttcccactttcacagagaaggcaagaaatcacacagtgagaaagtggcagagctgggattcaggcctcagcttctcccacacaagcccacagatgggaggatgaacaaggagtcagagtggacctgtggctctcccctgagaggataccaggattcgaggctcagcgccctgggaggagtgaacccctcagtttcctgagcctcatcagaagcagtctggggaggctggggcccagccaatggcagtgcaggtcccagctcctcctcctcccaggctgggccagcacacccggcaggctctgtcctggaaacaggcttcaacgggcttccccgaaaaccttccccgcttctggatatgaaattcaagctgcttgctgagtcctattgccggctgctgggagccaggagagccctgaggagtagtcactcaggtaagggcatctgtgtccgcatgtgccctgccccttggcatacgtggcaggaggacacttctctgctggggagtggtgggatgtggcctggacacatctgccaccctgggtcctgatggtggaggaataaggggctctgggttctttcaggtctccccagccgggcaaaggtaggagcaggggccaggccggaagctcagcaggcagggtagctctgcctgggcctgcaaagccctgccccactcctccccaagtagggatgggctgggtgagagcccctggggctaagggcggggccttcctgggtgttccctgagaagctgcaggagtcctaccttagacaggactgagcatgcaagatggtgattcaaaacagagctccccccaaccccggcccccacctccacccatcccccgtccaagtggcgcaggtggtgtggagacagggtggtgggcaaaggttcccccagccaccctcatccaggatccacacacaaggggaaggacagaatccgtctgcacacaaacaggcaggcagctcattgaaacttgaggaaagggtctgaggcctaaggctgggcagttcccggagggtgggctctagagccagcctgcctgggttcaaatcctagctctgccacttattagctgtgtgacgttgagcaagttaattaatccctctgtgttcctctttcctcatctgtaaattgggaataaaaaatatgccctttcctaaggttgctgtgaaggaataatgtactgattcatacaaagaacttagagcggtgcctggcacggcatgaatgcttcatggatattggctgttatcactactctgctttgcagttgatcatgcagaggctccagagagcctggtgagcttcagcctggaccagcatgggaaggccatcatgagccctttagtggctaggcagacaggttccttggggtcccagggtgcacagttggttgaaaccacagtgcatgggtcttaatggacacacccccatctccaggaatcaggcagaggactcgcgggtgaggaagtggggaccccttactctgcctagcagtcacagtccttacgcggaggtgaatctgattctgtgagttcatcaggccaaattcaccagcagaactgacaggagcagcatttcccacttgatgtcttgacaaggctgttccacaagatgataaatgttatgtcaggaggaaaagggcttctgtgggcaaatgagtttgggcaatgccacatatttcatacctcttttggtgaatttattagtgagtttattagcacggttgagcaaaagaaccctatttaactttactaaacccaatgtttgccaacttttcttgacacagaatcctcttctctcacttctcctattgccaacctatgggacagggttccagggaacactgtttgggaaacactggaataccaggttactctaggaaacctactgtatgaagagaatttattgctgcctgctttagctttcagctggattgcattgagtggcacttgagcaggactctgcctggctaattacagagtgttagaccagatgggggcttggggacaaggttccagcctcctttccagtcccatccctgagccaagaaaaggacaaagagcaggttcccctggggaaggggctgtctgagaagaggcagcagtgctcagaaaggagagaaccatctcaaggctcagcccccctgaggaggagggccagggttgaaacagagggagcaggcagaatgtcccagctccaccagtcttcactctgcagaacctcaagaccagagcctcaggcccggggaggaatgagtggctccctggacctgcccttatccactggtattggtaagagctgggttctggacttaattacctatgctcaaatcccagccctgcacctaatagttgtgtaaccttgtatataatgccactaaacctcagctccctccctctacaaaatggggacagtagtagaacccagctcctctagtgatggtaaggatgaaatgtgatgacatatttctacaaagtgctcagagcaagtctgtgataaatgtaggaaatgattgttcttgtttccctgcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggttccaggtgccctctggttgtgcggccttcgtgaccctcacacgttcatggtgtcaatctctctgcccccgtgaagagctgcacttgatccagcctgtgaggggcatcctctcttccagaaagggggcccccagtactccaggggacgtgctacttgctcatgctcccatctagcctttatcccccatggcaagtttagtcctgtgggttgtctgcagagagaatggagcttagtccatgttgcagtgggaagttcatgaacttagaatgcctgtgtcgaatccaagttccaccgggactctgggaaagtaacttaagcttctctccaaaatgggttaataatacctagcctgtggggttgtgctgaggactgatgagctcatggctgtggacagggctagccagctgtaaaaggacacataaatgttaatcattggtattaggaagtgcttgataatgcctgtgagaaacgaggcagaaggcccctccctagctgcacattaaccttcatcatcccagccagaacacaggtcccaggccccccaccagcatatgtgaggtcacactccagcctccctggaggccttccccaggacccacagaggatggacagcgatgctgtgcctggccctgtgctaactggggcatttcatgctgctgacctgcattccttgcctccaccaaggctatgggtgccctggtctagaaaagtcatagttgacccctcccatttcctacacaatccaagagcttccagactccagtcccagaaatatcccaccaccagaatgggatgcgttcctgcactaaattaaggttgcccctttccgtagatgtcagctgctgagacctcagtatcaggcttcccaggaaaagggcaggagagagggcaaggaggcagggtaaggaggcaatgggaaggggacagggtcaatcccactggtgctgtcctaggcctaggcataatgatatcaggctcctgaaccccacacagcagtctcacccacatacctgcctgcctgggagccaggctcagccatacccagccaggctagagaggaggcgtgggccaggagagaagagccgcaggtgtttgctctgagtatgtgcccggggaagtccgccctcctgcctgcccacccaatcactctcgcttggctcattggcccagaaagccccacccagcaagggagagaggaacaaaagctgcctccgggaggtcctgaggcaaacagacaagcccaaggacaaggaagcagctactggacccaagaagggtgaggaccgaatagggcaggaggctggccaggaagcaagcaaccagctgagctgaggatatccaagggacctcaggctgtgggctgggcttcagggagggagccagagggtcagtgtccctagaggatccccagggaagtgccaaggaggagaaggaatgtcctggctgacctaagggacgacagaagattggggaagagggggtatcaggaagaaatgggtttcagttcagtttaacaaacatctattgtgtgttcactgggccaggccagtgctaggtgctagggagacagaggtgaagagcctgccctctagcagctgacagcctggcaaaaaaataagacaggtaaatagaccatttgggtacaggcgatgcctcttgctctgaaagtgtcccaggcacacgatgtctgaagaggctgagagcagagtcagggattggggatggggaaggaggagggtaggaggaggggagggttggacatggggcctgatggggactccagacaagggggtgtggaggtcagagtccacaggagaggggcctgagaggaaataatggaaatgcggctagcaaacagccactaaatggacagaggagggggtgcccccagagaa

SEQ ID NO: 14973 - DNA, 7620 bp, Human
ccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaagtgctggacggggcggggcgaggctgggcgggaccctcaggggcgccaagcgctcctggcgaccccctgcggcagggctggggcttgagcctgccagtgcgctgggatggggcgcgaagcgggggtgcggggagcccgccaccccgtacctctcaatcctccctctcgcctctcaattctgggcccattaggggtcccggctgcgggaaggttccgagacaccccctccccaagtccgcaagctcccaagctgcctaggatggagggaaactgggaaggaaagggagctttatccttcagggacattgtggggcgggaggtagggctgggcacagtacagtctgggggtcagggaaaaaacggttgcgctgggagctggctttggagggcagctgggggaaccagaaccggctccaccagtccccagcctagacttgggaaggaaattctttgccagtgaagctcctccctggggtgtgtcaggagggactgggcagacagcacccaagggtagaagatgggggcccaggagggagctgcaccctggtgggcagccatgggagtgtgtcaggtggaagcagccgtcagggtccctctctgctctctgtccggacagacagggctccaaccttcacttcagttcttgtgaactcccaccaggtgagtagcagcctgggagggaagagtctcaggattctaccagaaagtaggaattatttccctttagagattagtaaatagggtcaatgagattagggaattcttggaagtcgcccagctactaagtggccaagctgaggtttgaatccaggtggaactccgtgttccatgctatcccactcccttcccccaccacgagggcttagaaggagcagagtaggggagaagaggagggtttccaagaatgaggtcttcccaatcaccccatcctgcccagactgtgattcccagaggaaacgcagccaggagagccaggtgctgagaaggaactgtgctctctccctctctccagtgtagggaagtctttcccccaatccccctgaccaggctgccccctgaccaggatcctgcccaccctcctgtcccctccctccaagctgccttgctgaaaactcagcattcatttgtttacccattcagcgctgagtgcctactatgtgccaagcactgggcactaaatataaagcagtgagcaagaccaagttgacattctagagggggagccagataattaataagaccaaaaaaaaaggacaaattctttaatttcagatagtgactaagtgctataaagaaaacagagggggctggaaaaattaggtgggcatagtggtgtgcacctgtggtcccagctacgtgggaggctgaggtaggaggctcccttgagcctgggaagcagaggttgcagtgagccaaggtcgcaccactgcactccagcctgggcgacacagcaaggccttgtctcaaaaaaaaaaaagaaaggggacaggaacagagtgacagaagcaggggctctttcagacccagggtaatctggagaggcctctaaagagatgaggtttgagcagaggcctctgtgatgagaaggatccacccatgtgaggttctggaggaagagcattccaggcagaaggaatcagtaaaaagcccccaaggcccttattccagggtggcagggtgaaaatgtcgaatctggggttttgctaagcctagcgagaagctagtagagtcttaaacaagggagtggcatgaactgatttaatggactctaggggcacagggggaaggtgaaaagccagtaaagaggccataatacaggccagaataatagtggtttggggcagggtggtggcctcgcaggcatcacgcatgctcagaggtgcaagtcagctccagggggactcacatgcacataggcccacacacacacgtggacaggcaggcgggtgctctcacacccacagcagcacagaaacaaggcacactcaggcagacccacccgtccacaccctctgagtcactccaggactgggaggaagatgtgtgagttaaggcctgaacaaagcacatctttccaccacaaggccctggcaactagtgtggctgggggtggctgggcttccccaggcccagcacagggagcagggagttttctctagatattccctggatctagtgtcctcccaggagtcagatcataaggctccatgcaccccccacctgaactggtctcccctcttcaccacccagcagctgtgagaccttgagctggttatttctcctctctgagcctcagtttccctgctgtagaatgggactcataactgcaacttcacagtatagtagtgaggcatccacaaagtaaacgtttcaagaatctggtctagggcaggagtccagcggagaagggaagaggaggtggtggagagcacaggctctggtacccaacagcctggccttgaatccacctcttgttttaagtgagtgacttgacctctctaaatttcacagtaatgagtagccagcatttatggggcacttactatgtactacttgctttgcaatcgttcaatgatcagtttcatctgtaagtgaggagcactgtaataactaccttatggggtcattctaagagattaaatgaggttctgctcataaagtgtttaacttcatgcctgactctgagtaaacactcaataaatggtgattgttattatcagccaaagcatatttgcttccttccagcatactagctctgttgcctttggttaagttatataaccttgctgtgcctcagtttcctatctgcagcttgggaggaataacagttctgaactcagagggtcgttgtgagtattgaacaagtcagaactcagaacactgcctggtacatagtaaatgctcaataaagtcacctattcattcatacgatggtttttcctctaattctctcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggttggctctgtctctggttctcccacactcccacccactgacagaaccctgaaggtagggaaaggtaagccctcagaaagggaaagagttccatggctcggggtggagctagggtgggggctgtggctgtggctgcagctggggcttgagctggagctcggttaggctggggctgatgttgacagccgggagctgggtttgtaccagaggaggaggctggggtggaacctactgatacatatgttgggattctagctgtggccacaagagtgcgctgtgctccctctgcaacggtgcttccagccttcgtaattagacttcaccctgagtacacacacaatcactgccactctcactatagacaaaccacactccctcctctgtcacccagtcactgccatctcaacacacatccccaccctgtgtacacacaatctctgttattcatactctcactccttatgcgcactctcaacagggcatgtagtctgcactcaagcatgccatcccagcctcaccctgcattttattcggctcatcccattttccctgaacattttcgctgaactagggccctggcaggatgctgggactgtgcaaggaggtaggacctatgcccacggagctaagagacaggaacacaggctcatctcccgcactaaccaacccctgggatggctcacagccctgctcccagtgctgtgtcatgacctgaaatttaggggacaccaacacccaaggccagacccaaatggaaagcaaaagaggatgcaaggctatattaacccagtggaacacttagtgactatcacagccgaggccgggagtcagaaattcaggagccagtgagccaagcgccacagccagcaaagacaggtggggtcatcacggaaacagaacagccagtggttcacctgtgctctcacaagtagccatttgaaggtggataagccagccaagtttaaaggacccagggccggctgacactgtccctacacccccatgactgattcatagcttgaccattcctgagcacagcttccccgcactacatcttgggcaggcctttagaacctcagtcttgccatcggtacaatgggaattggatcaatcagggtcctagcagaaaacagatggcacattcaaaccaagtaactttaaagggagtttcctagagagactgttttcaaaggtatggctactgcagcaccctggggctagtaccagggtaacaatggacaggatgcatccaatgccagcaaccaagtaaatcccccaacttcactctcccatctgctcgcctgccagtggctcccactgacctaacccaaccggaagtcagagggcaagtcagcctcccagtgtacagggcagggtggagagtagacctgagggacacagggaatacggtcagcatgacacccagttgttcctacacagaggatttttgtagaggtagaaggagacactgcaggtaaaacattagcacagcactaatgtatctgataaattcccaggtatgactgtgctcaggagagtctctgcctgatgcactggaggtcagcctctgcttgggctggagggttgcaaaggtctcagggaggggtggtcgccacctacttgccgacatgcattccagcatcttcctgggtggttctggctgcctggccaagggtggcttggaggtcagagtaaccagagaacatcactggctattcctgcagagaattaacgctcagcaaggactgagcttctagtcctggccccttttctccaggctgtgggccaggaccatggaggaggggacattccagccctgcacagcctgcctttggcctggagctgttctgagcagtgcagttcactgatctcatccagtatgtattgggtgactactattcaccaccaagagccagggcacattaagtcaccacaaggtggccctcacgtccccttgacgttctcagggtacgttcctctacctccgccttccccacccatgaggattcactgcaaactccctccaatcatgcatatgagattaggatttcatatagtcttcaaatccacatctactgtgtaaggtcacagccaccctgcagcccaagataaacaggacattcctttgtattcattcaccctggtccaagtccccatatggactgaatgtttgtgtcttcccaaaattcatatgctgaagctctaccccccagtgtgatggtattaggaggtggggccttcagggatcattaagtcatgggatggagccctcctgaatgggattagtgcccttataagaagagataagaacgagatgatctctctctctctcctccatgtgaggatacaaagagaaaatggccctcaccaagaacttgaccatgctggcacctggatctcggacttctgtgctccccagctgtgagaaatgaatgtttgttgtttaaactactcagtcttacagcagcccaaactgacaaatctctccccgggatgactgcttccatcttctcgcttcctgcccctgactctgggaagtggactctgaggaagggctaagtgggtacattggggagtgactcctataagtgtaaaaggggaggaagcaggattgagcaacaagatgtgtcccagggagctcagaagcagagactgtccatgcgggcagctctgcaccggacagcaatggcgaggccttgaccaccccctggttcagtcatggcctgaggccaccccaagaagaacatggccacttagacagcagaagcacacctggaagtgctgataggtgaaggcagtcagctggccagtctccacaccgctacacagcaagtcctacattgaagggggatgtctgtctgtcacccacccctgtagtctat

SEQ ID NO: 14974 - DNA, 20852 bp, Human
  misc_feature (1)...(20852): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtagtacctgcatccttgcatcggacctgtaaggacaacagctgcttcagtgtatccactgagcatcttctctgtgcagctttaagcttttggtggagaggcaggtggaaagaaagccccacctttagcaggcatggtgtggatagaaaaaatgcaaataatagtattattgatttttccactgttatgaatgaaatggagaaaggaatgctttgggtggatcagggagggctctgaggaggaggtaactcctgaactggttctgaatgatggtgcaatctgcagaaacaggctgatggtgaggaatgtctcttttaggcacttactactaataaagacgatgataatattctcttcagagattctgcaaatgcgacaagcctcccaggtaaggactgggtattttcatattcccagggtccgagggacagaagatttgtctctgcagaaagtcctttcttatttggacatgtcgtcagaggatcaatcacagatcaatcgcagaaatgttctgtgtgtgtgtgtgtgtgtgtgtgtgtgtgtgtgtgtgtgtgtgtgtgtgttggagagagtcttgctcggttgcccaggctggagtgccgtggcatgatctcggctcaccacaacctctgtctcctgagttcaagcgattctcctgcctcagcctcccaagtagctgggattacaggcgcatgccaccatgcccagctaatttttgtatttttactagagacagggtttcactatgttggccaggctggtcttgaactcctgacgttgtgatccacccacctcggcctcccaaagtgctgacattacaggcatgagccaccgtgcctggccagaaatgttcttttattactttatatgttgaactttgatattgttagctaagatataatgaggagaccgtaagaaaagtgggacaaatcacttcgagatatttgaaaagtgagatatttcacagttggcccacaatacaaatgaatgtgctgcaaacaagattattggagtctgaaatggaatacctgttgagggaaatctttattttgggagcccttgatttcaatgcttttgattccctatccctgcaagaccaggaaagcttaccagtatttgaatcaagaaagatcacaagtcctgtgtttgactaggtatatgggacttatggaatccagactccagaggttcagtagttgagcagctcccctgatgactcttgggcttcgtgaggcagtccttgccctcgttccccatccctgggtggattcctgcctgcactgatgctggctgcctctgctacaacagcccaggtacaaagccctaccatggtgcagtgcacctgtggaggacctgctaaatacctggggctgagctctgcacagttggggactcggagaggattagagccatccctgttctcaaggaggctacagtccaggctctgacaaagagtaaattggtaactgtgacaaagaccagcatgtgagatgggccaaaagggaggcacagataaagcaaagtggaatttagagatttgaaagagtatatcaagctgagcagtcacagaaagctcatggaggaagtgccatttgaaatgggctttgaatggtatgggtgggatgcaagaggttgggtgttcaaaggttgctatgggccgggcgcggtggcttacgcctgtaatcccagcactttgggaggccgaggtaggagaatcacctgaggtcaggagttcaagactagcctggccaacatggtgaaaccccatctctactaaaaatacaaaaattagccaggcgtgatggcaggtgcctataatcccagctacttgggaggctgaggcaagagaatcacttgaacctgggaggcagaggttgcagtgagctgagatcgagccactgcactctagcctgggccacagagtgagattccatgtcaaaaaaacaaaacaacaacaacaaaaacaaaagctgctatggaggaggggaacctccagtcctcttcgtccaccctcactgatgattttttttcttttttttgagacggagtctcgtcaagcgattctcctgcctcagcctcccgagtagctgagattacaggcatgcaccaccacgcctggctaattttgtatttttagtagaaacggggtttctccatgttagtcaggctggactcgaactccccacctcaggtgatctgcctgcctcggtctcccaaagtgctgggattacaggtgtgagccaccgcgcctggccagcattctcaaatttaacatgtctaaaagagaacacctgacgcctccccacctattcaacccagatctgttcttctccatcttccctatctcagtaactggtaccgcatttgctcaggtgcgggggatcgggcaggcttcctccctactcctcatcctgtgtccagtccctcagcaagcgttgtccttgtgctttgagacgtatctaggaattgaccactcctcaccatctccagtgccaacacccagtccagcccctgccgcctctcatccagcagggcttcctgggctgccaactggtctaccaacttctagtcttaacccccaaccaactcttttccaaccagcacttagagtatcccttaaaacacaaatccaagctctctctggctcagtaccatctcccccagagtaaaagtcaaagtcttgacaaagtccccagtttctacgaggagtcccagcaaagccatgtggtcccctatctttagacgttgcctctccattctccctttcctcgctctgccccagccacactgccctccttgctcctccacacatgctctacctcagggcctttgcacttgctgtgtgctctgcctggacacgcttcctctgacattcactttgccagctccttcctattactcaagtctctgctcagatgcacccttctccgggaggcttttcctgataatttttttaaaaaacatttgtttggccgggcgcggtggctcacgcctgtaatcccagcactttgggagccgaggcaggtggatcacgaggtcaggagatcaggaccatcctggctaacacggtgaaaccccgtctctactaaaaatacaaaaaattagccgggtgtggtggcgggtgcctgtagtcccagctcctcgggaggctgaggcaggagaatagggtgaacccgggaggcggaggttgcagtgagccgagacagcgccactgagcaagactccgtctcaaaaaaaaaaaaaattcatttgtctgtctcccttgattggatgtaagatccatttagatacatgataggcactcaaagaatatttgttggatgaaagaaggaacaaatatatggccaggcgccgtggctcatgcctgtaatcccagcactttgggaggccgaggtgggcggatcacctaaggtcaggagttggagaccagcttgggcaacatggcaaaacctcatctctacaaaaaatacaaaaattagccgggcatggtggcatgtgcctattgtcccaggtacttgggaggctgaggtaggagaattgcttgaacccgggaggcggaggctgcagtgagcggagatcacaccactgcactccagcctgggtgacaagagcgagactccatttcaaaaaaaaagaaggaacaaatagaaaagatgatgaaatgttaataaatgagcaagccaagcatactgctttcattacacagctgcatctctcaagagacatgggacatgcttggagaaacttgtctttgcagccagcgcccgctcaccagtctgggctctctgcgctgcctgactctagtaggcatctgaagtgatggctggcaggcagcctcttcgtcagcagtggattgcattttgggtagaagagcctgaatgctgggtccatacaactgtgactgcattcccagcagaaggagatggttttgtttagatgtgccctctgtctagtccagggactctggcagtggtaggaagagcctttctgtgggaagacatggctgcttgcaaagctggtttgttctttccttcattcaaagaaatattttggcgatcctactttgtattcggcactgtgtaagctgctggcagtgttacagtgaaaaagacacatgtggtccctgccttcagagaactcagtctagaggtggaaatggagaaatactgggaggggcacttgctcagcttggagtggggtcaattctcaaaggaaatgacatcacctcatctgagatccaaaggccaagtagggactagaccacaaaagggtgcagcaaaggtagagaaaacagacaggagagaagagggaacgtgtgtggagagccctggaggaaaaagatcatggcttgttggagaactgaatgaagttcatatggctggggcttgagtaccaaatgcagggacaggcaagagatgacacccccatggagaaaactgcttccaaacacttgatttaaagcatccaatcctctctgacattgtcctcaaaggaactgccatcaaggaggtccccaaagccttccgtttgttgtaccctctttgtgccttgtgggagcaggtggaatgtcaccagaaaagccactctgaaagtgagtaggagtctgtggctagccacaggcgctcagaaaccctgagcttgaggtgtctctcttgccaagtggtggaatcctggaatctagagtgggctttgttaagaaacaaacaaacaaacaaacaaaaaacagttaagcttgtcaaatggcctgttggttggcagagctgtttcattttctgggaggggggttggaggggaaggttccctttgaggcttttgacagcaccagctaagtggttttcttctcctcctattcctttttctccatattctcctcttcctcctctatcttcaattttttttttaacctagtgcaagattcttcttcagtaccactgcccacattcctggttgctggagggagcctggccttcggaacgctcctctgcattgccattgttctgaggtgagatgggtcccaggggatggccctgtggtgttctcatatttcttatctagctttcctttgcccattctgaaatttatggtgcatttattcattcatttatccattcatcaaatgaatgcacacaccacaacacacacaacacctactattatgccaagccgtgttttaggtgctgcaggagacaatgctgggcaggacagatacagtctcaggaagaagtcagacacgaagaggtaatcactactgtggtaagagctacaaaaagcatgccatggtgaggagaactgacctggcattaaggaggaagaggaattggtctgagaaagaagagggttctttttttttgagtcagcatctcactctgtcacccaggctggagtgctgtggtgcaatctcgcctcacaggacaacctctgcctcctaggttcaagtgatcctcccacctcagcctctggaatagctgggactgcaggtgcacaccaccctgcctagctaatttttctattttttgttgagatgaggtttcatgttgcccaggctggtctcaaactcccagggtcaagtgatccgcctgccttggcctcccaatgtgttgggattacaggtgtgaactaccatgcccggcccaaagagggttcttaggagagaagcccagcatgtaatatggttgacagcgtgtgcatgcacgtgtctgtgaagggggcgcagcacggttggggcaatatggggcaggaagagtggacaggtaggctggcaccaggtcataaaaggccttgaaagaggtgggaggattttaggccttctcttgaggctaaggagtgtctgttggagtttttttctttttctttttctttctctttcttttcttttcttttttttttttttttgagacagagtcttgctctgtcgcccaggctggagtgcagtggtgcgatctcagctcactgcaaccccaccttctgggttcacaccattctcctgcctcagcctcctgagtagctgggaccacaggtgcccgctaccatgcccggctaatattttgtgtttttagtagagacagggtttcaccgtgtcagccaggatggtctcgatctcctgacctcgtgatccgcctgcctcagcctcccaaagtgctgggattacaggcgtgagccaccgcgcccagcctggggagttttaagannnnnnnnnnnnnnnnnnnnnnnnnnnnnnnnnnnnnnnnnnnnnnnnnnnnnnnnnnnnnnnnnnnnnnnnnnnnaaatttgctgggcatggtagtgcttgactgtaatcccagctactcgggaaactgaggcaggagaatcacttgaacctgggaagcggaggttgcagtgagccaagattgcgccactgcaatccagcctgggtgacagaatgagactcatctcaaacaaagaaaaccaaaaagtcactctcaatgcagtttggagactggatggggtgagtgaaaatggatgcagtagcccagggtctgggcaagagataataataaactgttttaggatggtggcaatgggttggagagccatgaatagattcttttttttttttttttgagatggagtttcgcttttgttgcccaggctggagtgcagtggtgcaatctcagctcactgcaacttccgcctcccgggttcaagcgattcttgtgcctcagcctcctgagtagctgggattgcaggtgaatgtcactacgcccggctaattttttgtattttcagtagaaatgggatttcatcatgttggccaggctggtcttgatctcctgacctcagatgatccgcccgcctccgcctcccaaagtgctgggattacaggcgtgagccactgcacccggcctcaagatatattttagaggtagaattgacaaggcttgacaacagattagatgaggaggatgaaggagagggaggagtccgggatgaccctcccatttctggcttcagcagttgggcagatgatactgtcattcactaagactggaaacacctgaggatagacaagtctcagtgaaaagtggtgattccactttgggacccacttgagtttgagatgccccgagaacctcaagcggacacgcttggcaggcaacacagatcgtcaccagcaagtagatggcaataagagtcattgggtgggggttggggatagggctgaaccctgtggggatccaaggtgaaaagttctgtagagaaggaagtgttgggaaaggggctgagaggaaccacaagattctggtgttgtaagaacgagagggagggagtgtgcattagacactgaagaaacacagtaggtgttggaattacaacatgaatatgacctttcctcccttccgagaaccacatactcaaatgatgaaaataccatgtgaaggtattttcatggtagctaacgcctgtaatcccaacactttgggaggccgaggcaggtggatcacttcatgtcaggagttcaagaccagcctgaccaacatggtgaaactccgtctctactaaaaacacaaaaattagctgggcatagtggcacatgcctgtaatctcagctacttgggaggctgaagcaggagaattgcttgaacccaggaggcagaggttgcagtgagccaagattgcaccactgcactccagcctggacaacagagcaagactccgtctcaaaaaaaaaaaaaaaaaaaaagaaaagaaaagaagaaagaaagtaacattggagaagcaccacacagttaaatccaaggcgcccaagcaggacctccttaggaatattccatgtatcaatccaggaacttaaaggtcacctttaaatgctctgccctagtgttcttttccagccatggttaggaaatactcattcaggctgagttgcaccctggctgctgtctcatcatgcccatttcatcccaatcatcttcgctccatttggtcattggttttgtcattcatttccaagtctgcagaaaagtcagccaatagtgccttcagtgaacaagcaataatgaaatttttcggtgttcacaattttactgcaggaaccggctttttttcataagctgaaaccctaaaagatgtcaggctgggtcttctaggcagtggttaatcgcgatgatctacaagtggaggagacattgcactctgtcctttctacatgtagagagctttctacacgttagctcatcagaccctgccagtagccctgacctagcttgactaccaagtgtggtgtgggttgaaagattagcaagatgactactcaaattgggttcagggttgttttcactttttttctttttctttttctttttcttttctttttttttttttttgagacggagtctcgctttgtcgcccaggctggagtgcagtggcgcgatcttggctcactgcaacctccgcctcccgggttcacgccattctcccgcctcagcctcccgagtaggtgggactacaggcgcccaccaccacgcctggctaattttttgtatttttttttagtagagacggggtttcaccgtgttagccaggatggtttcgatctcctgacctcgtgatccacccgccttggcctcccaaagtgctgggattacaggcgtgagccaccgtgcccggccttcactttgctttttcaatgaagtagattacaagccgtctgaagggtgcgtggaagataagattcttaatgagtagaggtagctccttggaggatgcaaagcctgttatattttttggccagtgaggggccatgtcagcatccacgggttcacctcctgcctaccaaaggattccttgcctcaccctaggtataccctcctgtgttctggctctgtgtctacgttagggcttcaacagacttttctcataacccaccacaggccctatagagtagagtagatatgatatacatttgacgggaggaaactgaagctaaaagagatggtgcgataacagctagtaagaataggccaggcgcggtggctcacgcctgtgatcccagcactttgggaggccaaggcaagtggatcacctgaggtcaggagttcgagaccagcctggccaacgtggagaaaccctgtctctactaaaaatacaaaaattagctgggcatggtggtgcacacctgtaatcccagctacttgggaggctgaggtaggagaatcgcttgaacccgggaggcagaggttgcagtgagcccgagatcgcgccactgcactccagcctgggcagcagaaggagactccatctcaaaaaaaaaaaaaagatgaagaagaaggccaagaatcaaaccaaaaactcctgctatttctatagggccttaagggtcatctagtcaaactctttcattttataaatgaggaaacagcccccaaaggtaaaatgacttgcccaaggacaagcaagaacacacaccctgagagtccctgcccatggtccccacctgctattggctaagagctgggcccagctggtcccattggcccaccactggcccttaacatgcagcaccatcttggtgtgttgtaatggctaatagaggagcattaggttgggaacagacctggtttgctattctgctgatgatgcttggacactggctggttgctaaacaaccagagtccctgcaggcacagacagggccagtgccctgtgctgagaacatgccaggaatttattttctagcctagtgagtttccattttcttctgtataaggcaaatttgtttggaaagaggccagttatttcaagtgatgaagaagccttctattccccaaatcccctctgtctagcaaagagtataaacttagaaatactgtggggctctgggctgccaaaatggctgaaccatggttaccatgggatggccacatttacagtaggtgaagtgtgagaggttgacttcatcctgccagtctatactatatttttttgtatggccctaaatctttttccagcaatatcagtgatttttttctttgttttttattactcattctttttttctgaatcatagatgattttttaaaatttaaatatgctatcgaaaaggcttgccatcttacaggggccaattcctcccaccctattctctgtcccccactgattctctgtattttaggttatcaggcactgggaaaatagaattctcctagtagagaattatttttctgcatatttatctagaatgagcttacatcattaagtgaggacttcctatgtgtatgcctatgacttaaacatcatttcgttttgaatgtagtgtatcattccggtattttaaaatcagagcttttgctacctccacagctgggggacgggcagagggactttcatggtgttccgggccatggaggtggctgggtgcagtgggcactgtctgtggcctttggggtaaaaggggtggcaacttggtttctacatatctttctaaaaaagagtgagagttttgagcattttaaaaaacttcttttagctacagaatcttttctttaaatgaaactttttgaagcccaaatatgtaaaatagataaaaggtggaggtcaaggtgcaaaagaaggcagcagagagctcatctgtttcttctttctgcccaccctgtgtcctctccagcccccaggccctgctcacacccatccaggccagctctggacaccctcaggttggctggtttcaaagtcctctttgagtttagtgattttcagaaaagaattcatactcgccttagaatatttcaaaaggaaagctcacgtttctttgttacccattcagttacttcgaaaaaaaactgaggacagagattgcttccatattaggtcaacagggacttgaaaaatatatacatacacacatacatatgtatgtgatatgtgattattactggtgatttgctaaataatgacaaatggaaaaaaatatatgtcatccaaagagagccactgttaattttcaaaatgtaaatgtgattgaagtctaacaaacatacagaaaagttcccacatcatgtgtacagcgccatgaagtgtacacacccatgtcattataatgagatgcacgtggcaagtcaagatgccaagacaccaggttgcagcagagaaagaggtttaatcagagggtcaccaaaggaggagatgggaggaaacctctgtagggtccagccgtacggagcttagcgggtgttctccccgtgtgtggagacgagagattgtaataaataaagacacaagacaaagagataaagagaaagcacctgggcctgcgggaccactactatcaagatacagagactggtagtggccccgaacgtctgggctcgctgatattttttgcatacaagacaaggaggcagggtaaggaaggtaaatcttctaagtgattgacaaggtgaagcaagtcatgtgattacaggatcgggggcccttcccttttaggtagctgaagcagagagcaggcagcatatgtcagggttttcttctctgcacttataagaaagatcaaagacttttaagactttcactatttcttctactgctatctactatgagcttcgaagaggaaccaggagtgcgggaggagcatgaaagtggacaaggagcatgacccttgaagcacagcaccacagggaggggtttaggcctctggatgactgcgggcaggcctggataatatccagccttccacaagaagctggtggaggacagtgttccctgactcctccaaggaaaggagactcccttttgccggtctgctaagtaacaggtgccttcccagacactggagttactgcttgaccaaggagcgctccagcggcccttatgccggcatgacagagggttcacctcttgccttctaggtcacttctcccaatgtcccttcagcacctgaccctatacccgccggttattcctaggttatattagtaatggaacaaagagtaatattaaaagctaatgattaataatgtttataataatgattgataattgttcatgatcatctctgtatctaatttgtattatgactattcttattctattttctttattatactgaaacagtttgtgccttcagtgtcttgcctcggcacctaggtaatcctctgcccacacctcaaatccatctccccaaggaatttggggctagggttgtaaaaatgttggactgggccaaagtgtggagatggttgactggttgcagggtgtagggtgaggtcctgggacaaggagatgaagaagctgtcttctcatgccaatcccgttcctctgtgagggtcttcaaactggttgccggaattaggggtccgtaaaacatcttaagtgatccttaaacaaaagtcttaggatcctaatgtcagaaatcctatctacagaaacaacggggatgcagatggtcagtgtctagggctacgtgactttttgcaataaggaaatgggccaaagtgcagcctgattactgcttcattataactattaatatatttctgtccagaacccagcatgcaatttttgtcaaccctgtggagatggttttacaatcaacacccagatcaagaacacttaatatttagacaaatctcctgagtctttttcctctgcctagtttcttgtttgtttttacacagccatgattattctgtatcctcagctctgcatcctgcctttcacacttagcactataacacaggcattctttcacattagtacaaattcttgtaaatctcagactttttttttttttttttgagacggagtttcattcttattgcccaggctggaatgcaatggtgcgatctcagctcactgcagcctccacctcctgggttcaagcagttctcctgcctcggtctcctgagtagctgggattacaggcgcctgctaccatgcctggctaatttttgtattttttaatagaggtggggtttcacaatgttggtcaggctggtctcgaactcctgacctcgttatctgcccgcctaggcctcccaaagtgctgggattacaggcgtgagccaccgtgcctggccataaatctcactttcattagctgtagtattaggtggatataccaatttctcttaatcaacctcctattactcctaattggtggcacccaaacattaccaattatttgggtgttattttgcttttatttaattaattaattaatttatttatttattgagacacatcactctgtcacccaggctggagtgcagtggcataatctcagcacactgcaacctctgcttcctgggttcaagcaattctcctgcgtcagcctcccaagtagctgggattacaggcatgcgccacgacacccggctaattcttttttagtagagacagggttttgccacattggccaggctggtcttgaactcctgacctcaagtaatccacccaccttggcctcccaaagtgctgggattacaggcatgagccaccacacccggccttattttgcttttataaaaaacactgtgttgaacatctttgtgcataaagggttttttttttttatagctatgttctttcttttcccagaagtagaattcctgggtcagagagtctgaattctttgaaatccagagtgtaatgattctctcctcagtcctttcttacaggagaactccattcaatgactcagcatagctccagtcagcagccctgctgggctctcttcctgtgtggtgtccacatggtgaagccctaaataatattctgcagattgtttatttcatttggataccaagctaaaagccagtggcagatttggagccaactattaattatttatcataacaaggacaggaataacctgtcgatataaaaagaaacccaaggaaaatccccaaatcttgtttttgacattggtttcccctcctctttcccagcccttcctggagtaactgatcttccatggaattgagggaggccaccttgttcccactttggggttaggaggcatgtcagtcacaaagtgggaagcaagagggaggggctgaggcttggggcactggccaccctggcacagttgaagggcccctttaggaaggggacgtgactgtgtttttgaagatccatgtcaccatttcatctttctttgagctgtcaagtgacttttctcagttactgagccctggctttgggcccagagtggagcactgtgaaccaagctgtgatcagaaagatgtctatctccttcctgtgtagcattgactttcctgtcagatgagtcaaattgtgcccagtggtgcccacagttgagtctgtgggaagtcaccagcatggtgggagtggaccgagaggcgtagggagaactggggaggtcagcaacattaggagcaagaggaacaggaaggcagttgagggagcagtgggacccttttcctgctattacatggcggttgcaaattatctgcctcctgccagccttactttgaccgagaggcccattttctttccctactaaaagaatgctttctttttttattttctttccttttcttttttttttttttgagacagagtttcactcttgttgccccaggctgaagtgcaatggcacgatctcagctcactgcaacctctgcctcccgtgttcaagcgattctcctgcctcagcctcccaagtagctgggattacaggtgcctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtttgtgtgaaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggagg

SEQ ID NO: 14975 - DNA, 12424 bp, Human
cctacacccaatcacctggacttccagtaggcaatctcctttctccctatgtaaatttcaagagtcatacgtctttcttttcttccgaacgcccacacccgttggtccttccctggctctggatactgtaggctcccacagaacatcatctctacagatgagggacatcctagtgtgtgtttgtgtgttttgggggtgtgaggctatggtggaatcctttcctcattctctctatgcccgagagctggctggaaatgaagtgataaaattccttctcaggattggctggcagagtgacaaagctcttctggaatgagcactaaggggagatgtaagagttaagcacagcatctaacacacttcaagtgttaatgttgttaatcaggataattatctatctatattttaattctctgaagtaaatctaagggtaattccaaggtgagctggggggaatacgtatttttttttttttgagacggagttttgctcttgtcacctaggctggagtgcaatggctcgatctcggctcactgcaacctccgcctcctgggttcgagcgattctcctgcctcagcctcctgagctgggattacaggtgcccgccaccacgcccagctaatttttgtatttttagtagagacagggtttcaccatgttgaccaggctggtctcgaactcctgacttcaggtgatccacccgcctcagcctcccaaagtgctggtatcacaggtgtgagccaccgcgcccggtaggaatacgtatctttgtttttttttttttggtcactttccagctttgcctgtggcattctccggaagagcagtggcaggaagccgtgggtggcaggaatgggtttgggactgttccctgtgtccagcttcaacccatcttctcctgacacccctttctcctgtacttatttttctcctgtccttattgacgcagatgtgtcttctgatctctctgtcccttcctggcctgtagtttctacttctcttggagaactgtttcttccacctcctccagccaggctccttccctggtgtgaaggatgctgtgctctttggtggggcttagggccctgtaagaggagggatgtgaattggggtggtttggagtgggagtggggacctgattgcctcattctcacccttgacagtgtgctgtgttaacaagccctgtggaaaggggagacaggacagtgcttggctatgagccatcggtcttggtgtggtagatggcatacgtagagaacaagccgtgaccagcatgtcctcttgttcccttcttgcctggtagcttcctgatgtatcatccaggttgaactttattccccttttttcaccagctttgctcttcctcttggccctgctctgcatccattgggaccacttacttcccatccccacttcgctagctccagtccacagctgctgtagcagaggatgctaatggcccaggcttactgtatggggtagcggttgggggtggcctgggctggggccagccagctttcgggcatagagagggtgggggaattcgagtgtccaaccaggacaggaagggaaatgctgagctctgagatctcctcccttttccacccccagctgcctctgtttcctccctcattcccctgtactcctgcctggcttcctgccccctttggcctgcgtgtgtccggttttgagtgacccagacctcctatctccttcctttccgtcccactcttccatccttccctcccacccccactttacttctccccagattactagttgtttgtatagggcaggggagaggggcttggatagccctaccccctgctccagttcgaggttggggcggggtgggggctcagcccctctgagcctgtgagtcagcactgtcctcacgattggtctctccccttagctccccgcccctggggaggagccagaagcgctgggtccagcctgttctcttctcagccagagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcgggtgagtgaacatcctcctctccattcccccgcagaccccctccagttctaatgctcactccagcttggccggaatctcttttttcctgctgttccccaacaaccccgtttcagtgtcctatttcctaaacctttctcatcccttccccgattctgtagccccttcccttccagctttgcctgggcccccttccttcttttcactcccccacccccaccctggcatgcttagcacaatgcccagcatggcagaagctcttaataagtgttggaatgaatgacttcttgatctttcctccattctcctcccgctttctggagttgtcactccatcccagccaatgcctgtcggtcccctccaaactctctccccagtgtgtgaggtccttctagcctgccttttctttttctcctcattccctgttgtctttcaccttggttgtgggatgtagccacgggaagtgggcagaacttcttcctctttacttcccttagggaccatatgggtaaagtcctagggccctttgtgaaggggctggggtgggggagccgctgacctgctgtcctcttctccctccccttagtacatgggttgtgtggaggtcctccagtcaatgcgtgccctggacttcaacacccggactcaggtcaccaggttagtggggagggagtggattgtgggagtcctgggattagtgaggccatgggaaacagaggaggggagtgggtcacttgggtgctgctgctgggggctgatctttgcgtagtaaaggggattgagagaaagctgaggtagtgattccgcctcttactgaaaggaggcccctttggcccggatcctccttacctatccagccttgggagttgtggggaaggtggcagaagcagctggcaggtggagctggagtagaaaaggggggtagatggaaggttgctgctgcctttgggaagggaatgggacatttggtagctggaagggggtggggctatacccattgaggccctaacccaatcagccaggaagtggcctctcagtgtcatcaaatattaaaggcccttaattcaatccaccatgacaaagagcctggagtgccctgggagtctggcctggctttcccctcccccagccctgtggcagccccagttgagtgggaggcaggcaggcaggcgctgggtctgagtacccctctttccccagggaggccatcagtctggtgtgtgaggctgtgccgggtgctaagggggcgacaaggaggagaaaggtacttggggtccttggggatagggatgctgctgggaaatgtggaggggcagtggggaggcaagtgtggggcatgtggggagagggccaggaggcaaaagtgtggtttgcctgtgctgggaaccctcaccttctgagaccctgggccctaccttagccctgtagccgcccgctcagctctatcctggggaggagtaacctgaaatttgctggaatgccaatcactctcaccgtctccaccagcagcctcaacctcatggccgcagactgcaaacaggttggtgaaggtgggcagacggaccagaaacactgatgggggtgctaaggggagatctagttaggaggccaaaatctaggaagagggcttgagagcaggagaccagtagggaaggaggaaatgaggatatgggataaggaacccagagaatgagactggggcaccagggttctgggccctgaggctgcctgacacatggcattcccttccttcttcatcccctgccctaattctcagatcatcgccaaccaccacatgcaatctatctcatttgcatccggcggggatccggtgagttggggaacagagcaaaggcggtgggagaagagcaaggggctagggattgggaagacattgattagagaagtgggggtgctaggattgtggggatatctgaaaaggactgggttttaggggtcaggagtaaagtagaactgtaaaattttttgaccttcctccccaggacacagccgagtatgtcgcctatgttgccaaagaccctgtgaatcagagaggtgaggcatggtggggagcactgggtgggtctggctgtttgaggaggtgagtaggacctttggtcatctgtacccactctaagtagatctcagtgggggttcctgcagaggaagatgagggcccctgtctgtgcctcctcccagtgggctcagctcactgacagcctctgctgtgccctcagcctgccacattctggagtgtcccgaagggcttgcccaggatgtcatcagcaccattggccaggccttcgagttgcgcttcaaacaatacctcaggaacccacccaaactggtcacccctcatgacaggtgagcaggtggggagagtgtggagcagctcttggattaggattaggaaaggagggctgctcttcctacacttgagttgagaggttcagggagggaataacctgtgtgcctctgcttcccacttcctgctattcttctgtttcctgtggcccaggaggaaagacttttgaggccctgcttgccgcaggaccagcttttcttgtttgctcatggtggagttgtagtccggggcctccaagttacatctctctctggctaggtgggattttctactcccatccctctttcttgctcatttctctgcttggcattatgtgttttcctgcctctagaagccatcaagaatttgggtttgggaggatatctcttttccctgagattacaacctttcccacctcaggccttgagggataagcagtggagccagtagggattgaatatttaggagaggttaaaatattctggagctggagtgcctcccccggccccccacccccctacatggtgcttcccttccttgttgggagatagcacagagatcaagagcaagagcattacttatttgagacagtcttgctctgtagcccaggctggagttcagtggtacaatcacagctcactgtagcctccatatcctgggcttgagtgatcctcccaccttagcctcctgagtagctggggctacaggtgcatgccaccacacctggctgagtagtagtatttttattctggtagagataaggtctcgctatgttgtcctggctggtcttgaactcctaggctcaaacaaccctccctccttggcctctgaaagtgttgggattataggcgtgagccattgcacctggccaaggggatgagctttaaagtcaaacctgaatttaaatctgagctcggccgccttttagttgtgagaccttgggcagatcttttcacctctgaccctcattttcctcatctgtaaaagtggggaaggaaacaatacctaccttacggggttgccaggagaatgaaatgattatgtatataaaacactcagcctcaggcttaatccatagtaaatacccaatagatggctgctgttctattctgtccttccctcctcctgcccaccacacatttacagccacagcttcactgtcctgtccctcaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagatgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatgttctttatagtcctggcacagggccaggcgtggtggctcacacctgtaatcccagcgctttgggaggctgaggcaggtgaatcacctgaggtcaggagttcgagaccagcctgaccaatatggtgaaaccctgtctctactaaaaatacaaaaattagccgggtgtggtggcaggcacctgtagtcccagctactcaggaggctgaggcaggagaattgcttgaatctgggatgcagaggttgcaatgagctgagatcacaccactgcactccagcctgggtgacagagtgagactctgtctgaaaaaacaaaacaaaacaaatacagtcctggcccgtcctcaaatccccaagccttaagcttatcagagctagaaggcagtcatctcatctgtgcccctcttttgacaaataaggaaaccaccctgaagaggttgtgatgcccaatgtcagatggttagaggctagacactgcaagtttccttttgtaagaagatccaagggcttctccagctccccagactcaggactcagaccactgtgctttctcttatctgcactgcctcactgttcttcaaaactttccttgtttagccaggtgtggtggttcatgcctgtaatcccaacattttgcgaagctgaggtgggaggattgcttgaggccaggagttcaagaccagcctgggcaacatagcgagaccttgtctctagtcaggaatggtgacacatgcctgtagtcctacctacccaggaggctgaggcctgaggatcgcttgagcccaggagttcgaggttacagtgagccatgattgcgccactgtactctagcctgggtgacagagaccctgtctggaaacaaaaaaacttttgtttgttttctacagtaatctcagcttcctttctttttttttgagatagggttttgctttgtcactcaggctgcggtgtggtggcacacctggctaatttttgtattttttttttggtagagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtgagcgcgctgcgaggggcgggggctgaagaggcccaggacttgggaacctcagaggggagggatggtgggcggggggtgtttcacagtctgaaggcttgaagggaggctcaggtgaaaaggatgggtgggtgtaatcctccaggggttgggggcaggtgtcacacattgaggactctagggtttggagccacatggaattcagtactcacttggagcttgaggatatcgaaagatgggatatctttcatttaaaggaagacgtagctgagagtatgatcatcttcacaatctatttttcatattgcaccccttgttagcatttgttgaataaataagcaagtatgtattgacgttaaaggagttcctcagagcatggctgagagaaaagaggttggggaaacctcagggaaacttgtctgcgtcttccttttgccgctcttccaggtctgcaaatgaagagtccagaaaagaagcgaaggaagtcaaatactcaggtgaatggtggttggtggtgggtttggttcccagcagccccttggcggcacactgtctactctgccattccagtatctgtttgtatcttgtatcagctgcagggaggagagagaaaactgtctttcttgctttgcttcttgttctttcgctgaaccttataacaagtttaggggaaagtatcctctcctaagagatgattcgaccaaagttcttaccacgcagggttccagtctcctccatgtttcctgtcctggtttcctcctgatgataacgtaacacctaccacttactgatcctttttttagtgccagggattgcgctaacatgctttaacagtttggggagataggcattatccctattttacagatgagaaatctgggggttaaaaatgttaaatacatgctccacagtcttgaggttgtttttcagggtcagagctgggattccatcctagttctgcctgtttttaaaacatagttactgcactatgttggttccactctccaccctctttttcttgtctttttttttttcttttttcttttcttttcttttctttttttttttttgtagtaacagagacttgctgtgttactactcaaactcatgggctcaagggatcctcctgcctcggcttcccaaaatgttagcattacaggtgtgacccactgtgcct

SEQ ID NO: 14976 - DNA, 8511 bp, Human
gcttcgcagcccaactgggaggaggggacaggggcgggaagtggcaggaaatggcgaaagcctcaggaatgtttccagcagggaaggctgggcaaacggggccaggaggaatgcccagacaagaactctggttagggggaggggaagagacagagaagtagcgactgaactgtcccttaaaaaaaaaaaaatcaaacaacaaaaagagcactattatctacccccactccaaactaccgttcttctggtagtagaaaacttttgctcatgtcacacccacatgccacacaccaacaaatccatggtcttatccacttatgtctaggaaggcctagagctacttctgggatgaggttggtcctgggaagggaaagccaggaagtgaggctgggagtctgagggcaagtctctctctccctctcgtgccaaaccccacgttcagccctttcaaatagttctacccttggaggaggttaagaaagaggaaaacggggacgggcgcagtggctaacgcctgtaatcctaacacttaaggaggctgataagggtggagcacctgaggtcaggagttcgaggctagcctagccaacatggggaaaccccgtctctactaaaaatacaaaaattagccgggcgtggtggtgggcgcctgtaatcccagctactcaggaggctgaggcaggagaatcacttgaactcaggaggcggaggttgcagtgagccgagatcgcaccattgcactccagcctggacgataagagcgaaactccgtcttaaaaaaaaaaaaaaaaaaaaaaaagatagaaaggaaaacggaaaacggctgcctttaatctcactccttacagccagagatgggaactttgacttcccacctgggggagcacgagagtgctcggaaaactgatcccaaggcccaaaaagagaaaggacaggaaaatataagcaggtggagtttcagggattgacgacaaggcttttcagctgatgacccaggtcccacaaagataaagctcctaagggggcgtggtcccctaaggacgcgaacttcagacttctgggcggggaggctttctggacagtcagacgtggattacggagggggcgtggcttcggaggggcggagcttcaacaaattcgaatcgttctttgaagagcagggttttgcccttttgggagataggccttttgacaggagttagccgaggatcgttgctaggaggcggagtttcggagaatggaaggagtaacgaagggtttctcgtagtagggcttggaacgtgtcggggggtggggacttccagaaaaactgggcgacagggtggggtcggagacaaaaaataaaaatcaagtcggggttcgggggagccccctgaagttgggaggtgggacttccggggagaggggtctcaggggcgggacttataaatgaagaccggaagtggggtcccgggagaggggttccggggtgaaagagtgagtcacctaaggagaaaaaagtcaagactcaccagggcctcatggagtctccgcaccgcaccgcgggccgatttggtgccggatcacgccactgccagcttaggttaccgctccaactttctccccgggccctgcctccctggagaaactttattacactcacttccggcctcactaacccctgaccctctacctcagggtccctccttcacgcttcccactttcccgagttagccaatggcagcgcgagatcgcgcacaaaggcagtggtggccaataagacgcctacttttgacccacgctcgttcttgagaagcgtgagaactgccctccaataaggatccgaagagaagtaaatctaagccaatcggaggcttgaaagtagaggtgtcccgcctcgagccaaacggaccaataggaagtgcgggcggcgtgtttgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgaggtgcgaacgggcaatggtgtgatattgtggaaggcgtaaggcgcatgcgcggaggtgggaggcgctcgtaaaacaaagtggttgcgaatttggagtcgcctctcagtagagaggagagaggggtgggcgtggttagggtactgaccaccctcacccatgaggctttctggatcattctctgaactttatcgggcaaacttaacttgccttgtagagactgtttcacagtaatcttgtcgaatccagtgggagaacgtagcaaaagcggagctggaagtttcctggcgtccctaacaggagagtagcgctgagagagttgaatattgcttattaactcgtgaaaaagacaaggggcgtggttgtctggcttgtgtaaggaaggggatcgcttgggactgcaatggaataaaactggctaggagcattgagaaaatacttaatatgggtctaatagatgccctttaaatatcaaagggaacagttacggaatacttaacaggtttcaggtgttctgctaaagtgcaaggataacacatggtctctgctgttcacaaatttaaaaatctgtgggtggtaccgacagacaccagaaaggtgacacacgctatgcaaggagccattacagggtgtgatgggagcacacaagacttgctaaggagagggaactggcgacccgaaggctgcggcttcctagctgtgagcgggggttgaggtggggctagaaagtcagtcccctacttttgctaactccaggacgctcccccatcccacgcttcgagaacgccccccgccccgccaccgccttggaggctgacctcttactttcggtcggtcttcttccctgggcttggtttgggggcgggggagtgtcctaagggccaattcagcgtgatgtctctttcaccaccattgaaaacgaaaccagtagtaaactacgcgtgttttcatttatatgtcggagataaaaacacagggacagaaagaggggaacaacagacattggggcctgcttgagggaggagggtgggaggaggtagaggttcaggaaaaaaaaaaactgtcgggtactatgcttagtacctgggtgatgaaataacctgtacaccgaacccccgagtcaggattttacctatataacaaacctgcacatgtacccttgaacatgaaacttaaaatactgagaggaaaaacggaagagggaatgttggggaaagcttcctagagggcagagcctgagatgagactctaagaaaaaggtatgtgggaggaagcacctcttgactgaaattgtttagaagacactggatagccatctgccaaggatggtgatgatggaatcctggcactggatgtggcattcgggcttgataaattttaagtgcataatctagattgggaataagggaagacacaggattccacaaatgttggcattatgctaatctgtattaattgtaataattaagaccacttcctggtttgtatcttgtctcctcagttggagaacataaaatgaaaacttgcttttcttgtgtctcttcacccagcctagttcagggctttgggtcttccagagaactcgatgtgcattgacaaatacataatcatctttatgccaagacggctccagaccctcctttaattaactttcttttcctcagctgttttcctctacatctgaactaaactaacttaaaactgtatgtgcttataagagatttgtggagctgggaaggaatcaccatttcatcccctggaagatgaaactcttggcagtggcactttggtttaagaggggttttttggtgtatgtattgaagccaaatttcgtgccagggtggtgttagaatgtgagctattttcattatatttggactagaattttttcttttaggagaatggtggggaatcactgttactagcacagagggagaacttagtacattttcattgagcatgacgaagactatgtggattagtttgattcacatcagggtaataatttttttgctatgaagggagacttatccttggttagaaaagcacggaatttacccagaaagtctcaaggtacatccctccagagttaggaaaataagattcaggatagatttaattttttttttaagagacaaggtcttgctttgttgcccagactggagtgcagtggctattcacaggcacaaccattgtgcattgcagccctttcttttttcttattttttttctctttttttgagacggaatctcactctatcgcccagatctcagctcactgcaacctccgcctcctggattcaagggattctctcctgcctcaacctcccaaatagctgggattacaggtgcatgccaccacacccggctaatttttgtatttttagtagagacggggtttcacgttgttggtcaggctggtctccaactcctgacctcaagtgatccacccacctcagcctcccaaagtgctgggattacaggcatgagccaccgcccctggcctatttcttctgtattttaatcagatttcaaacttcatactgtatctttttcaaactcctgggttcaaatgaccctcctgcctcagcctcccaagtagctgggactgtaggtttgtgccaccatgcctggcttagattttaaaggacaagatagttcatttcatcctttgtaataacttgtccacacagtacttcataaaaggcctttcctcgccacaaaataacttctcttccttccttctaattattaacactgtgtgctccgtggggctcccattatgttgtagataatcaactagaagactataaggtccatgaaggcggagaaaatgtgccttgaacttaagtgctcattcactggaattattcactaatttgtatttttaatatactctcggaatttatataacatagcctgtatttctagctgctgctaccccacaataaaattatataaactctgacatcaaaaaccagtttttctttcctttcttggccttgtaaacaggcatttgtctaagagactgtatctggtactaacataaattccccacttccccgtttctgttacagacatgtcatgctgcccaaggacatagccaagctggtccctaaaacccatctgatgtctgaatctgaatggaggaatcttggcgttcagcagagtcagggatgggtccattatatgatccatgaaccaggtcagtgcactggctaaaaacaaccatatagaactgctacactgagagaatgaaagaataagattgtataacccaaatagggagataggaaatggtttactggttccttccccctccagtcgtgggggatttttttaaaaaaaaactagtgaccaaaaataagactaaaatatctgggaagttcagagacaacctgtcactgaaaaacctcctgtaatctttcattcaatcagagggtattctttttaaggccacatatagcctgatcatagcccctgcctcattctccatcgaaaacattcttggatgtgttctaaataagcaaaggaaagtatatttattgataagacaccagacacccagctgccaggcaaaactaataagggacaccctggggctgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaatggtgtgagcttgtctcttagatttccctcactctttcagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaagtactgatgcctgcctgagtcattcttaaggattcttaattggtctggagtgtggactgggggtaaagatttcaggcatcttatgcaggtaggtaaagaactaagctttgagaaaacaggtgcaaaatgtagctgtttaagaaaacattccaggccacacgtggtggctcacacctgtaatcccagcattttgggaggctaaggagggcagatcacttgaggtcaggagttcgagaccagcctggccaacatggtgaaactcccgtctctattaaaaatacaaaaattaggctgggtgcagtggctcatgcctgtaatcccagcactttgggaggctgaggtgggtggatcacctgaggtcagaagtttgaaaccagcctggccaacatggtgaaaccccatctctactaaaacaaaattagccgggcgtggtggcacacgcctgtaatcccagctactccggaggctgaggcaggagaatcacttgaacctgggaggcagaggttgcagtgagctgagatcacgctattgcacttcagcttgggcaacaagagtgaaactctgtctcaaaaaaataaaaataaattagccgggcgtggtgtgtgcctgtaatccctgctactcaggaggctgaggtgagaggatcgcttgaacccgagaggcagaggtgaaagtgagccaagatcacaccactgcactcagcctgggcgacagaagctgtgtctcaatttaaaaaaaaaacattccacagaataataacttcccctctagtctaacaaaacagtagtactaagtggccgggcgtcgtggctcacgcctgtaatcacagcactttgggaggccgaggctggcggatcatgaggtcaggagatcgagaccatcctggctaacatggtgaaaccctgtctctactaaaaatacaaaaaaattagctgggcaaggcggtgggcgcctgtagtcccagctactcgggaggctaaggcaggagaatggcgtgaactcgggaggcggagcttgcagtgagccgagattgcgccactgcactccagcctaggcgacagagccagactccgcctcaaaaaaaaaagaaaaaaaaatactagtactaagtaaggatattaatctcccccatttttcctgtcttccatccacttattcctaaaatagcaggcatcaacatcgggaaaattcattagaaatgcaaattattgggcaacaacctagacctactgaatcctaaactcaggattgggcacagcaatgttttaacaagctctccagctgattctgatgtacacttaagcttgagaatccactaggaaaatactggaacagtcttggtattctgttttgggaggggatcaaatatcacctgtattgctaataaagatattggaacatgtggtttactaggcaagtggaattcttgttttgccctttttttttttttcaaagagctgactttttataattgaaagaaatgagggccaagtacgggggctcacacctgtaatcccaa

SEQ ID NO: 14977 - DNA, 10772 bp, Human
gacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagatgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatgttctttatagtcctggcacagggccaggcgtggtggctcacacctgtaatcccagcgctttgggaggctgaggcaggtgaatcacctgaggtcaggagttcgagaccagcctgaccaatatggtgaaaccctgtctctactaaaaatacaaaaattagccgggtgtggtggcaggcacctgtagtcccagctactcaggaggctgaggcaggagaattgcttgaatctgggatgcagaggttgcaatgagctgagatcacaccactgcactccagcctgggtgacagagtgagactctgtctgaaaaaacaaaacaaaacaaatacagtcctggcccgtcctcaaatccccaagccttaagcttatcagagctagaaggcagtcatctcatctgtgcccctcttttgacaaataaggaaaccaccctgaagaggttgtgatgcccaatgtcagatggttagaggctagacactgcaagtttccttttgtaagaagatccaagggcttctccagctccccagactcaggactcagaccactgtgctttctcttatctgcactgcctcactgttcttcaaaactttccttgtttagccaggtgtggtggttcatgcctgtaatcccaacattttgcgaagctgaggtgggaggattgcttgaggccaggagttcaagaccagcctgggcaacatagcgagaccttgtctctagtcaggaatggtgacacatgcctgtagtcctacctacccaggaggctgaggcctgaggatcgcttgagcccaggagttcgaggttacagtgagccatgattgcgccactgtactctagcctgggtgacagagaccctgtctggaaacaaaaaaacttttgtttgttttctacagtaatctcagcttcctttctttttttttgagatagggttttgctttgtcactcaggctgcggtgtggtggcacacctggctaatttttgtattttttttttggtagagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtgagcgcgctgcgaggggcgggggctgaagaggcccaggacttgggaacctcagaggggagggatggtgggcggggggtgtttcacagtctgaaggcttgaagggaggctcaggtgaaaaggatgggtgggtgtaatcctccaggggttgggggcaggtgtcacacattgaggactctagggtttggagccacatggaattcagtactcacttggagcttgaggatatcgaaagatgggatatctttcatttaaaggaagacgtagctgagagtatgatcatcttcacaatctatttttcatattgcaccccttgttagcatttgttgaataaataagcaagtatgtattgacgttaaaggagttcctcagagcatggctgagagaaaagaggttggggaaacctcagggaaacttgtctgcgtcttccttttgccgctcttccaggtctgcaaatgaagagtccagaaaagaagcgaaggaagtcaaatactcaggtgaatggtggttggtggtgggtttggttcccagcagccccttggcggcacactgtctactctgccattccagtatctgtttgtatcttgtatcagctgcagggaggagagagaaaactgtctttcttgctttgcttcttgttctttcgctgaaccttataacaagtttaggggaaagtatcctctcctaagagatgattcgaccaaagttcttaccacgcagggttccagtctcctccatgtttcctgtcctggtttcctcctgatgataacgtaacacctaccacttactgatcctttttttagtgccagggattgcgctaacatgctttaacagtttggggagataggcattatccctattttacagatgagaaatctgggggttaaaaatgttaaatacatgctccacagtcttgaggttgtttttcagggtcagagctgggattccatcctagttctgcctgtttttaaaacatagttactgcactatgttggttccactctccaccctctttttcttgtctttttttttttcttttttcttttcttttcttttctttttttttttttgtagtaacagagacttgctgtgttactactcaaactcatgggctcaagggatcctcctgcctcggcttcccaaaatgttagcattacaggtgtgacccactgtgcctggcctgtggtccatttttttttttttttttttgagacggagtcttgctctgttgcccaggctggagtgcagtggtatggtcttggctcactgcaagctccgcctcctgggttcacgccattctcctgcttcagcctcccgagtagctgggactacaggcgcccaccaccacgcccggctaatttttttgtatttttagtagagacggggtttcaccgtgttagccaggatgatctcgatctcctgacctcgtgatctgcccgccttggcctcccaaagtgctgggattacaggcgtgagccaccgcacctggcctgtggtccatattgattttagacctgagctgcccacagtatcagcctccaaaatgtgtattgtgttggtagtgctctcttggtttagctctgtgtttccctccatgaccctctttccctcaactgtttctcactagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagacaaggactccttgctgttgctgtgtgaaaaggctggaatgagccgctgtcactgctgggtagggtgcttaggggttgaggatatgtatgctccccagggtccctgggagtgggaatggcagatttggcccctgagctgaccctggtataagctgctgagccaagggaggcctgtgtttccccgcccatccccctgtgtctccactgtgagaaactgagtttcctttttgagcatattcctgggccaggcctggagccaggcggatttggcaccacagcctctggaagacaagtgcttgagctcttctgggtttagcaccccacccacctcccagttgtttgggttagggagcaagtgtcgctctaagggtgaggggaggggctgcttctgtcctagcaaatttcattttgggatgtttttcagatcgttcccgtcccccaaccgttttttaaagtagcaatggcatcttttaagcagtctgttttggagcagattggggagaatggcaggagggctatttccacaccctggatttgcgacctgtccctctcccttcccccatctcacagctgtctctgtctatcctggggccaacctggccccttgtcttcgtcatctcagaagacggcaccgtctgcttttctctcagtttgtgggggttccctctagaaactgtttagacactgggaaagaagggcaggaaactcaggattcggttagctgggaccccggtcgcccaccaggaggtaagcccaggtttagggccgtgtcgctagacctcccttcccctcccctggctctcaattcctgctcttattggccaaaagtttccgcccccttggggaagttgacttttcattggtcagtttctggtcacatgattttcttctcgggctgcaaacaaagggaagcctgcaacaagttaagctgaagaccgaagcaagagctggttcaggtaatgccttagctgggaaggggtccacagattcgctttgaagggggtggaataaggaaaagggaaggcggaactaatctagaaggaatgagctgcttttcatttctgggctgggggaggaaggccaggtgccgacgctaacacaacaggaacttgctctgggtaccccaggcaagtggccctagatcctttgctttagcggtttggaggagcaactgttagaggagtttaaattaactagaggcgagacttcctagctttatgctgagtgggagagctccccctttagctgttttttagaaatagcagaagtctctgtcataatccttacaggaggtgtttgttgaatcctgcctgaatgaaaagaagggggtggagggagggagtggaggtgggttttcttccagaaggtcgatgaaaagaaaaagatctggaaacacagcagggaagggtggagattagacagcagaag

SEQ ID NO: 14978 - DNA, 8009 bp, Human
tggcctcgcgctcagctgcacaacacgcagtcaaagcgggggctgggttagaagcatcggtctcccctccccaacacacacccccggagccctccgtaatttttttttcttttaatgacaagcaattgccaggctcgcagggtgggtgctgcattgcaccgctccgcgcgcagctggttctcagagtgcagccggtgcaagcccgggggtccaaaagggcgggaggagcacaccctgggcttcccagctttgcagccttctctctgcaaagaaaagcaagtggcttttggcgcgaaagccttggcgcctcccctgatttttatggaaatcaggagggcggggtaaagccgctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgaccctcctcgcgcgggcgcccctgccattcccgggaacaggggctcagcctctccctccctggaagaggacgttgtcgtgggtttggaagagcaggggtgggcttagagagcttccaattaagctattggcaggagtatccctgcagcgggtgaatgccgaggggcgtttgctcaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggcagagaggtcctgtttcccccaagtctctcctcggggtaaagagaaggggctgagagaatgccgttgcaaaaggggtgctctccaattctcgccttcactaaagttccttccaccctctcctggggagccctcctctaggccatcacgggccctcacccggtcccccacctctcttttgcagcgcagtctgaggaataaaattggagaaagttggtggctaaaccgggtgggggtttagggggttgctgggtgcactgcctggacagaaacctgttagcgcaggggtgaaagggactctctggcccaggtcaggggagggaaagacatcccgagaagattcaagggctgtgcaaagccctgtttaaggcgcaggaacttataggagggttgcacagatggctagagccgattttctattctttttctttttctttttttttttttttcaaatgtcggtacctttcccttcccccatcctcggtgggtggtgggctatttgctcctggtgcgtggccagcaggcggcgatatgcgaggccagcaggcgggcccgggatctgaaaggctgggggtggtgggggcaccctccctccctccattcagcagctggctgcaagtgcaacagcagttgtgtacattctcagggggcctcctctttccagtgtgcagtggaaactggctgtagttttgtcttccagcctgaattccaggcctaatttgagatgtgagttgtatctgtaacccagtgcccttgaaggtgagggcaggcactcagcagcctctccaggaaggctcacatcctgggaggactcactgattagttctattgtgttcatttgtctgtgtcttaagctgaagggaagagttaaaaccaagcctttccctgggggtctggatgaacagaactcaacccaaagagtggcattgccttgtccttggagcagggagctgggaccccccttggactttgaaaaccagtgttttcagaatgcaggtggataacaagcctaaatttacttctgggctgaggagagatctttgaggctcctggaaggaaacttggtgataagcctccagtttgaaacggctctgtccctttaatgtctgtgccttgacagcttttggtgaggaagcacttccttccaacagctgtcttcttggcagaaaaccaaaacattggcttaaagggacccacagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttgggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagccaggattctgtctgaccctaaaggccaagttctttatatttatttctaccacctgctaaagtcttgaatggaggctgaaagcacagttggggtatggggaagaaaaatatatatacatacatatatgtatatgtatgtatgtatgtatggggggttgttttgtttttgtttttgataaggagttttgctcttgttgcccaggctggagtgcagtggtatgatctgggctcactgcaacctccgcctcccgggttcaagtcattctcctgcctcagcctcccgagtagctgggattaccggagcatgccaccacacccagcaaagttttgtatttttagtagagacagggtttcaccatgttggccaggctgatcttgaactcctcatctcaggtgatctgcccgcctccgcttcccaaagtgctgggattacaggtgtgagtcaccgcgtccggcctacagatatatttaatttaaagagatctaaaacaaatacaaaactgtccacatctatgttgatggacccataaaaatagcagtctgccagggtctgccggaagagacagataagcatacatattaacatggatatatatgtgaatttcattcaaatggttctcacatgagagtaactagcatctttctctcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgtcccttaaggagcaaccataaataatccataacctatagagggaatttggtttccgtaaatagccctttttgcacctgtacaatcctggttggggggcatgagtcattgtccccacttaaggtggagggaactgagtttggggaaattaaggcagttctccaagattatgcagaatagagatgttattagcgactattgtgtgcattgtagcaatggcatttgataatttacagagcacttctgtatactgtggctccttagtggaattaagctgagacctcagatcagtccctttaaaagaaaagtaaaaatagccacagggttgtttaactcgcttgtattgggctttggtagtattcgtcccattggcagacagtcttctattttaaggtagagcatagtttgtctccaagaattcattgttaaaaacattcactaggatctgtggaggttctaggctaagcagagtaagcagaataaacagatggaaatgggttcctcccttcaatgaactcaacctgattcaccaaagtgtaattcacgagtgacagttacgtagtccagagcaagtaccaggtgcaggagagaccctggggtcacaatggagaccccatatgggtggcatggctctctacttgccattcctattacacagcagtgtcttggctacttgggctgccctttggaaatgggatcaatcttgcaggctccagaagacagagccaagacttgtgtgttaaggagatagtttacctgttgggacataagagccttgcttgtaagcagcttctcagaactaaaagtgtacaaataacctatttctcttttgagtgtcaggttgtactcggttatttctctagggttttgttcatctcagatttttaactgtgagccgaaaaaaaagaaaaaggccttttgcttcactgagaagaaagcaggtccagagatgagacagctttgcttgcctggacacacagtttgtcaggggcagagatgggagacaccaagccatgtgtccttgtctgctttggtcatttttatttgtttctttt

SEQ ID NO: 14979 - DNA, 14700 bp, Human
ctattcagtatcaaaacatggggtgggcctggcacggtggctcatgcctgtaatcccagcattttgggagtcttgagtttggcagatcacttgagcccaggagtttgagactagcctgggaaacatggtgaaaccccatctctactaaaaatacaaaaaattagccaggcgtggtggcgcgcatctgtggttccagctacccgggagactgaggtaggagaatcacctcagcctgggaagtcaaggctgcaatgagccgagatcacaccactgtactccagcctgggacagagtgagaccctgtttcaaaaagaatttaaaaaaaaaaaaaaaaaaaaggaaatcactagtcccaaaccacttatccttggagaaatatggacataaacccaaattgcatgttctttccattatatcacagtgtctctttgtaaaagtggcaactttgggctggcttacatgaattcgctgaaacctttacaacatattggcggtgctgaatacttggggctcttgaacgtaagcctgcaaccaggatgctggtgtacaccctcaccctggaatgctcagccttgatcctcctcttttcagaatggcttcatatctatttatttgtaacatagtgcttaacagtaggaagtcttgagccaaatgcctagctctgccacttatccctgacctgagcaagttacttagcttctccaggcgtcattttcctgtattctaaaatggagatgataatagcatttaccttataggattgttgtgaagattaaatgagtttagggcaatgctatatataggttagtatcatccatcaatttgcaacatgatttcataagtgcatctagaatatgcttgtgtaaacctatggttagatgatgaagctaagaaaagcctgagtccatccctggagagtaagaaactagtatactccttttacacagtaccttgcacacagcacaggcttaacagacatatttaaattgaactgaagcgaatactaccagaactgaaagtggtagttccagatctttcaggctcaaggtccagattttacaagtgtttctgatcaccctccccctacctcatttatcgcaaagagcagaggccaggaaaaggatgaataatcaatgaccttaaaactcaggtgagaataaaaaccagttctgagaaaccgtgtgacatttacatcctggtacctgagctttagatcactctgcatgtgtatttcctctgcacaaagcccaggaggctacttttatattattggggcaaatctcccaacagccctgggtactaaacagccttcagcaggtgcttccaaattttcttatttgcttcaactcccaggttgccaggggaagcttggccgacaagtctatactcctgggcagactgagcaacagcaggtggtggcttctggataagaggtgctctaggtcggaaggaaataaatgagactacgatcagttaaagttcggtaaagcaagagacgccttcaacccgacgaccagacggtggctccgcagcacagactctctcggatggtggaattcccaaccggcttcgatgtagccccgcccctacccagaccacgcccaccaatcaccgccctctcccccccaggccccgcctggagcccgcccctcctaaagcatgctccacctgactccgacactgccgggcttagtccgccgggcttagtccgtggagcgcttgcgcatttcttgagttgtcgtggcactgcccaaatctgaatgggggaaagagggaacttcatatttcctacagactccgccacagcgactttgcgtgctctcttagagctggttttgcctttcgtggtcctgagaaccctggcttttggttccccaatgcggcttaagtgtgcaggttttaagttaggcgatcttcgggcagccctagtcccagcaccgggtccttgcgctgagtctcgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcaggtacgagtggcgcctggccagctcggacatgagaagtggcggccctagcctcggcgacaggcagtcgcggcgttggagccaggggaggcttctgcccgcggtcgagttcgtctctgttctccttgcacctcccggggcctctccacaccagcgtacggtggtcactgaggcttctttttgtgtacctgctcacctggcgggggctggcctggcgtggaagtttggtctggctcactgcaggggtcaaggtgacccccggggtcacttgtctaaaagggatggtttgtgggggtccccagtgtgacccgagtcagaggtccggccttctccctcaattcgaagacatctggctttcggcctccttgtcgtttctttgtcatctgccagagccccataggcagcctcacttgagctcgagattagagagcgcggggctataaaggcgtttagagaaaccatggtgcagggggttggggggctatgatctgggttgggaaatttaacaggttacttaacacgtccagggagggaagttgcatgcagcgaggttacactttcccgattgtaaaatatttgacagatgctcgttgtttgggttgtctgaaaagtattccatttcacgcagattctaccaattggagtttgactctccagcatgtgttgggggtaaacatgagggattttagagccccagacgtgccttttcaaatcatggcgttttccgctttaattgtgtgaccttggccaagttatttaatttattgtgagctcagtttcatccagggcggcgttagtacacattaaatgaagtgtgtcaagtgactagcagtttgggcaggtggttggttctggataagtgttaactgttcaccagaagctgtctgagatagtatattccctcctaatcctctagagaagtgtgggaagtgtcggtgagatacgcagttagactgcagtagtgaggggcccagatgaggtgtaaaggatactccattactgttgcttcatttcctttttctgtgggacactgcagcttgcccaagaggcagatgtttaagaaagatttcaggtctggtaccgtggctcacgcctgtaaatcacagcactttggaaggccgaggccgagggtcgcttgagcccaggagtttgagatcagcctggggcaacatagtgagaccctgtctctaaaaacaaaaacagatgattctaatctcagataagaagggcaagttttttttttttttttcgggggttagtgggggagttgcggtgggaacgggaaggaagagtttagggtttataaatgttgagtttgtgatatgtcatgcttggtagcagctagatttttgaatatggagtttaataaacttgggtgtcttcagcccataggtggtaatttgtagggaagaaaggttggattatagttagagtatagaaacatgagggaagggtggagaaggagaatgtgtttaaagaatagtccggatgagaagggaaaccagtgtggtctcactgaaaccgaattggtaatgacttgtaaggaaggaatagtcagcagtgttgcacttcttttacagattatgtgagaaaatggccatttctatcatctgcttctatgaaatgtattctccagtgtatggatattaaatgttacagtttgatgagtttggacaaacccatgtactgtataaccacacctccctcaatatgcaagatgttacatcatcccaggaagttcccttgtaccctctgtcaatccctgccaccttcttattctgacttttatcatcataaatagatagttttgcctttttttgaacttcatgtaaatggaaccagctctgacccaggctggagtgcaatggcacagtcacagttcactgtagactcactcctgagctcaagtaatcgtcctgcttttgcctctgaaaatgttggaattacagatgtgagccgccgtgtctggctgctcaaaaaatatttttgaggttagtccgtgttgtacgtatcagtagttaattccttttatcctcttattcttctgtgggatttcattttataaatatatcacagtttattctgttggtggtagtagatgttcttttatttatttttttaaaatattttttgagacaggttcttgctgtgttgcacagcctgatctcgaactccccggctcaggcagtcctgtcacctcagccccctgagtggctggggttacagatgtgtaccaccacacttggtttatgttcttttaatatatcttcagcataatctaggttttgttgcttagtaagaaaaaagtaaatttttcgactaaaaactggcatattgtaataaaatgggcgctcagcagagattaccttgcgatgagtttgatatagatagggctttcagatttctagtacctctcctcgtgaatcgtgtttctcttgagaatttgaacttcttagttacttaaagatttcttaaactatgttgaaaagaagtgatactgtgtaggctttatatgaattgtaaatttctgagtgattgtgacaggtgccctcccaactaggtgctctgactttggtaattaggagtacttcagctttttcctttcctggaaacatacgatgaagatgtttgtaatttgtagtagtaagtaaagtgaataatttgccatgcactaaataacataatatggaaaaggtggttctgtaacaattgcacaggtagagatttgtaagtcagcttgacagcaagcagttggtgggatggcattttccattggttgaaaggcatcttccttacctttctctgaattgcgtcaaaaataaattgaggccaataagcacatgaagatgtttaacattttcagttattagagcaaatcacaaccacaatgaggtaccatttagtatccaccagaatgcctagaatcaaaaagacagatgataacaagtattggtgaggatgtagagaaacgaaacatgttacatttgtggtggaaatggtaaaatgacgcagccactttggaaaacagtttggcagtttgttaaaaaaggaaacgtaattttactgtgtgatctaggaattcctctcccaattaagatggcagaatggtattctaggtaaagggaactgtgagagtgaaggaagggagggggtctggaggagaagcattgggtaggtaagtttgactgtggaggatggaggtaaatcatgaagggcctagtatgtaaggacttaattttgtgaggcactagtaggaagttgcagagcaacttgatgcagagttgtggtagtttgtcctttcagatgagacagatgttggggatgaggagggagggcttcagcatgattggtgaattggtgcttttcacagtgacagggtgttcctgaatgggcttaggagtgaattttggacatgatgagtgtgaggtgtcagaaggacatggaggtaggtggtgatgtctagcttaccgttagaaataaatagaggtcaggtgcggtggctcacactggtaatcccagtgtttccggaggccagggcaggagaattgcttgaggccaggagtttgagaccagcctgggcagcaaagtgagaccccgtctctaaaaaaaaaataagaaaaattagctgggtatggtgacgcgtacttgtagtcctagctactcaggaggctgacgcggaaggatcacttgagcctaggagattgaggctgcagtgagctgtgatcaatgcgttgcactccagcgtgggtgacagtgtaagatctatctataaacaaaacaaaacaaaaagccaaatgaattgagtcactgcagattgaaactggtctccagtcctaaatcacagtggaaaagttcatacatttctatcatttaaaaattaaaattatggggatcctcttttctctccaccctcttccccaaacctaagaggtagaagaaaaggaaaatgttacaaccaacttttagagggaaaatcatgtttacttttctctttaaaaatttggagcaattgaaataaactaggaagaacttaattactaaacgtggttaaggttgaatggctcgtaattaattttggaggtggggcttatttaagcagctaagagattcagtattaaaaagtaaagtatgtgatttttcttgatctatgggccacttatttttaattttattttgagacagagtctctgtcgcccaggctggagtacagtggcgtgatcacagctcactacagcctcgaccgcctgggctcaagtcatcttcccacctcagcctcctaagtagctgggaccacaggtgtgcaccactgtacctggctaattttttgatattttgtagaaacaaggtctcactacgttgcccaggatgatctcaaactcctgagtcaagtgattctcccacctcagcctcccaaagtggtgggaccacaggcatgagccattacgcccagcctgtccactttttataagaacagctttcagttgttttcttattgctatgggaattgtggatgccctgccatcaaatgccagttgatcagactttgtttctgagatactcaaacctacattgtgaagctatagccttctttagtttatttgaacattctgcctatatttactgaatgcgcttactctgccggttgcttttctaagtcttggaatataggagcagtgaacaagatgtgccaaaatcctgtgcttgtggagcttccattatagtggggggagacacagtaagcaaagtaaaacatagtatgttaggtggtgataagtgctgtggagaaaaataaagagggtaagttgttagtagggcaagggggaggacatgcagtttttaaaagggtggtcagaaagatctctctgaaaaggtgacttatggggttgggtaaagacctgaagaaggtgagggtataagccacgtggatacctggagaagatcattctaggcagagggaacatggctgtgcctgggaggtttcaggatagctcctgagccaggatcacgccactgcactccagcctgagtgacaaagcaagagcctagctcaaaaaggaaaaaaaacagaatgggccgggtgtggtggctcacgcctgtaatcccagcactttgggaggccaaggttggtggatcacctgaggtcaggagttcgagaccagcctggccaacatggcaaaacccagtctctatgaaaaatacaaaaattagctgggcgtggtggcgtgcacctgtagtcccaactactcaggaggctgagacaggagaatggcttgaacctgagaggcagaggttgcagtgagccgagattgcaccactgcactccagccagggcaacagagcgagattccgtctcaaaaaaaaaaaaaaaaaaaaaaaaaagaacgtaggattttacactgtgactgttaaattattaaacctgaataaacattggaggaaaagttacaatttataacaattaatgggatgagataatgagattataggtaacttcaattctataaacttttacaatattataaagggaaatacggaattaatttaaaattaagatggttggtattcctgttttcagatgatactgttcaaaaactttgctgtagttttgaatcactgcatgcttggacaaacaaatacaatcccttcaaaaatactctcacattagtcctgtcgaaacatgaatttactttcaagccatttttggagatccttggtagaaagagtttttacatttttgcattcaagaagaaatttttgcatttcaaggagaaaatatggtgagctcacagaatgatataaaggagtatctaacattctccatccagttcaaaccatgattcttgttagccttttgatcttgatagtagagcccctgtttgcctctctgactcctctgagtctctgttttgagtgtgttgtatttctaaatgtaggccaacatcttactgaccaaactttctctttaaatgggctgttgtttttaagcaatagttgattgggagggtggggtgtgagttgtggaatacttaaaagccagggctctggacttgagaaaggcctgagtttgaaaacttgacttgcttttcactatttgatcaaaggcaagttattctctctccagtgttttcctctgaaaaatgggaatagtaatatcttcatagggttgctgtcagaattaagtgaagtaatgcatgtgaaatgtttgacatgatactgacacttcacaagggttaaatagatattagctgctgttggtttataacattaatatccatggtggctgagactgtggcaatgttattcattgtgtatttctagtgtagagcaagtgatcagtaataaatgttgaatgaatgaatacgttacagaaaacaggccatggttcattcccatttactgtactgtgtcagaagaaatagaagccaagtttactttaatgcttctttttattgacctgttcatctagtgcttgcctggtgggagtagcattgaggttttcaatatctaatctttataatatgccctgtcaattataggtaaatttagatttctttgagacaagaatcagcggactgatcactgtatttgggcaagaggtttccttctttgtctgtaaaaggaaaaggctgggtttgaattatgctttctgactttaaatttttatttttcttagttagaatttaacataaaaggaggatttttattggcttataactcttagctccttattttaatttacaggttattttggattactctatatatttgtcactgtaggtttattcctttcagataaaaaaaccagagatcccccccacctttttttaaagcagctttattgagatataatttacatagcatacaagttgcccatttaaagggtacaatttagggttttttagtgtattcacagatatatgcaactaccaccacagttaattttagagcatttttttaatcacctcaaatggatacctatgtaccttttaactgttacctccctagcccccaagcccccacctgaagcaaccattaacctaccttctgtctctgcggttccctcttctgactttgctgtgaatggcgtcatacagtatgtggtctttgggactggtttctttgactcagcgtaatgttttagaggcttatccgtgttgtagcatgtgtcagtacttcctccccttcaccttgtttaaatttttactgtatgtgttttcaatttatgtgtttatttatgctgaaaagttcatttcgaaaagttttttgttttgattttgttttctggtcctggaaggcaagtattgtttgtttgtttgtttagttttgttttaaaccagtaagcctgttccacattgaatatttctttattgtgtgtctggaaaagtttctgaagtctgctctggggttagacattccatgttactagattagctcatttagaagaaaaaaatggcagacagatccctcatgaaagctaatgacaagttcgtaacagattataaatgttttactggttgctaagaagatagacacaccaggtatttctggaagctcagattgggcctttgttggcgtccccctgaccctcacacgccccctgcaatcgtaatggcaaggggttcttgacagggtttgctctgggaaagttggagagactttcttgctctctcgtagttgaatggctgcctccactattccagacagcctcctcagacatactttcaacttgccattttcctttttttctctacagggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtgaaataaataggcttaaaaaatcccttatgaaactaaatcttaatctagtttactacccaccctccttctttttctttaagtagtattctcttgattttagtttgagccataaacgaatagaactttatataggtagatactgataaaagaggggagggtggttaatttcctcattagtatttaagggtgtgagggttttgaaatggcatgaatagctcttgatcatttattgcatggaagaagcaatagcctcaataactgagtagcctgtataactgaatgacccaatatatatatttgacttcgtgacacatgtaatgacttggcagtgggtttttttctcattgttttttgcttgcttgatattaaaattcactgagctattgctgaaagtagaggaggtgcttacgggtttgcacatgagtagagaatccagaatcagaattgaaaatgtttttaaagtgaatctacctgcaaattattgagaaattagtgacctgaccaaatcttaggtgccatgggagtggcagtgcttgctactgctattgctgtaaggtagcttccccctcctcaaaagtagtccagatccagacccatcttgaggatagagcacttttgttttgatcagtttaatctctttttatctgataagtaaggtttgagagagcatttagaatctcaaggtgcggtggggaaggattttggacactgcaaaatatgagttaaacaggccaggtgtggtggctcacttgtgcagccccaacactttgggaggccaaggtaggaggattgcttgatcagcctgggcagcataacgagaccctgcctctacaaaaaaacttagctgagtgtataggcacgcgtctgtaaccccagctactccagaggccgaggcgggaggatcactttagcccaggattttgaggttgcagtgagctatgattgagccactgcattctagcctgggtagcagagtgagacccagtctctaaaatgatgatgaagatgatgatttaaatatctcatggaatttgattattaaatgggtttaacagtgtgacggaaagaaggcagttgaatgccaaatggacttgaacctattgacatgaggtactccgaccccatccacttatgatcagaagccaaactaaatggagaacgtttctcgtgccagcacctctttttatcttttttaagacagagccttactctgtcacccaggccagagtgtagtggcacactcatggcccactgcatccttgacctcttgggctcaagcgatcctcccacctcagcttccctaataggaagtccctaatgggactacaggtgcataccaccacacctggctaattttagttattctgtagagacagggttttgccatgttgcccaggctggtcttgaactcctgggctcaagccatctgcctgtctcggcctcccaaagtgctgggattacaggtgtgagccaccgcgcccagcctctcctgcctgcacttcttttagctactgattacctttgccttttaaaaaatgcaccaatgctccagttaagcaatatgtgataaatgtcttagacatttggaatcttttgcatgcatgcttcctgaggcagcattttggagaatgactttggatttacaagctttagctacatttataggaacttctactagcattccatggattagtgcttttcccactgtcatgtgttgatgaattacttaccgagtagacaaatttgttattttttaagagtaaaattgtaaaatatttttcttctcaaccatgcccttgttaattcttgctttcaagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaattttaagtttgaagttctttgaatgacctttcagagtaatttcagaacaccagcagcatcttaaacctgagtctaatttctttcttgttaattaggcaccagataatctttataaaatggttcttaaaagtctagtaataggagtcttaatggcatattgatgattaccacatggttttttataaaaacctgcctgccccttagtgaaaggtacctgtaactcacagttcatttagacactaatttcctttgctgtcatgattggtagacttcacttaccctatattaattttgaaaaaaggtggaattttattatatatgaaggaatagtttgtatcttaccatagcacagaacagtgacctcttgctcaggataagatgtggtgatttgaaaatactcaatagtagccttgcagtgatatctctctctctctctctctgcaaatctaaattttattctctggtatttcctccaagtttttattttgaaaattttcagactacagaaggactaagcatagtacaatatacacctgtatatccttcacttagatcaccagttatcaatatattggcacctttgctttttcttgttctctcacacaggcacacacaatgcatatatgcacacacacatagatctgttttttgttgagtcatttaagattgttagggaattatgataaatcagccatagtactttagcaggtatcttctgagtaaggacatgtgttcctttataaccataatgcagttgtcagactcaataaagttaacatttataacaatactaccatctaatacatagtttactttcagatttccccaggtgttctaataatgagttccttcatagttgtgtttttaaaaaataacagctttattgggatataatttacatactgtacagttcacctcaagtgtacaattcattggtttttactgtatttggagttgtacagccaccatgagaatcaattttagaacacttatatcaccctaaaaagaaaccccatacccattagcaatcacttgccttccctcccaccatcccaactcccacctcctagcccaaagcaagcactcatctactttcagtctctatggatttgtctttcctggacatttcatataaatataatcatatgatgtgtgatgtacgtgactggcttctctcagtgtcatgtttttaaggctcatccatgttgtggcatgaatcgatactctattatctgaatagtattcaatcgaatgggtataccacattttgtttatctatggttggacatttgggttctttccactttggggctgttacgaataatgctgctatgagcaatagtgaacatatgtttacatggacatatgttttcatttctcttgggtatctacctaggagtggaattcctgggtcatatggtaactctgtttaacattttgaggaactgccagactgtttccaactcagttgtaccatttaacattctcaccagcacatgcagttcctttttgtttttgttttgggtccaggatccagcaaaggatcatacattgcatttagttgttgtcacttttttttttcttttgagatggagtcttgctctgtctccaggctggagagcagtgacgtgatcttggctcactgcaatctccgcctctcacgttcaagcaattcttttgagtcagcctcccgagtaactaggactacaggtgcacaccaccatgcccagctaattgtttgtaattttagtagagatggggtttcaccatgtaggccaagatggtctcgattttctgacctcatgatctgcccgcctcagcctcctaaagtgctgggattacaggcgtgagtcaccgtgcccagcatgttgtgactgtttagtctctttttatccagaatagtcagtccccagtgcccttcctgatagtgacctatttgaagagtccaggcaagttgttttgtaggacattccttaacttggatttgtctgattgt

SEQ ID NO: 14980 - DNA, 5239 bp, Human
  misc_feature (1)...(5239): n = A,T,C or G
gcccggggcggggcgcgcgggggcgcggcgcagcccaacccgcacagccgcgtccccaaacaccaccgaggagggaaaacagacggagaaaaaggacaaaacagaaaaatgcaaaacgggggagggagctcaccgcctctcgagctttaaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagccgggcggaggccgccgtctcaggctgggcgcgtgcccgagtgtgtgcacccgggggagtgagcgcgcgccgtccgctgtcgccgtcgggcctcccggggactgggcacaaaggcgcgcggggcctctcccgggacccggtcctcggttagcgccggcgcccgaaccatcccggttcgccccgggccgcccgctccccgtggtgccgcgcgccgcttccgagcatcccgggaacaggcgcatctgtgcacacacgcggattttttaaaaataacatatttctagacatgcctcctctccccccacccccatctttgcaaagcagcccggagggcggggtggaggggcggggcctccgagttaataaaggaagatgggcggagccggcccccagccattggctagctgggggagtgatgtcacccatatgacaccctgataactagttgagagagagacctcaactttttgcagaaggagcgcgcgcgcctgggagagctcggggtccggcgcttgcggtaggagccacgagccggagagaggggtcccgggctgcctcgaccgccgtcgccaccgcctctacctgtcgcgaccgcagctcccaccgcgccggcggccgtcgccgccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaattaaatttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcaggggaagacgcggcaggccggccgagggcaccccgaggaacatggcatggcctctgtgcgatccgagtcgcggtctccggggtgcctgggagggccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14981 - DNA, 115388 bp, Human
ttcagcaacaaattgttaccaaattgatgaagcttcattagtaactctactcctttccaataattatttaggatagtccctggtatattatctaacccattgttaatatgtgcacactcttcccttgactccataaaccaaagctactctacgtccttccctcccttcctggcaatgggcaaatagtgcttcacccataaaagcatctggtcaggctactggaccaatttgataaacatcacttttaccaccaatttttttttttaattttaccctcaggtgagtcattttgtacacagctcattaccttttgagcagtcttctgctgtagttttgttaaatttatcctcaggaaatcaacccctctcatggtcacacctttctttccacttctatggctataattacctcattgtgtcttaattgcttttatgcttcggtatctctgccactacagtataagcaccttgaggacaagcactgtggcttgatcactgtagtgcactcagaggacagcgtggtcctggcttgatcactgtgatgcgctcataggacagtgtgatcctggcttgatcactgtggggcactcaaagtgtagtagggttcctggagtatgaaaggcactcagtaaaggcttgttttgtttccattcgtttatttttaattggcagataattatagtgtatatttatggggtacaatgtaatgtgttgatccgtgtatacattgtaggaagagtcagtcaagctaattaacatatccatcacctcaccaacttattttttgtggtgaacatgctgtttgttgagtgagtgctcagaattgaaaggcattgtgtgctgtggaggtgcagaggacaggcaccaaacccaggcagttgtagaaagttggggaagatttcagaggaagatagacaaactgagatttgaagggtgacagcaagttagcttggcatagggagaggacaatcctgtcaaaaaagagcatggacagagtcctagatttgagaaagagcaggggccatagccataggcaaaaaaccatgcagctacaccttttgttaactatgcctgagaatcaaggcagaagtcagtgtggtagacatacgtgtgcatctatatatgtgcacatgagaggaaactttggtttttgaaagtttaattagatgcaataaaaagtcaaatccgtcagcctctaaaactcttgatatttagcccaaagccctctacatgattaaacatatccattaactttctcattattttctttttcctcaagctgaagtttattttttctatcacattttaattctctgttttaactgttggcattttagtagtatattttaaatagttccactgcagacaatagtatggttaaggaaagatatttgaatctaaccaccttgcatgaagttgttatatacaggaactgttgcaagttccaaacactcaacttagaaatgaacatttagaaaattacctgtttataaattgaggttttgagtgtataagggacaactggcaacaggatgagatggaagccatactggtcttagaatccaaacgtctgcatccttcattcaccaagtccatcagactcttggtttcatcatctgttgaatgggatccacaatatctgttctccagtcataggtattcttaaaattgaaagagaaactgaatgggaaacgagtcacctaacagatggtagattgttgtatttagttatagcacaaggtcatttgctacagtagttatttttatgttagacaataaaaattttatcccccctccaacaactacaacaataatatatatggaaaaatatgcgcagcaatttaggttagtaaaactaaagctgtactttttaaaacaaacagttttaaataggttttctatgtgtttgtgtcacaagtacagcaagtacgtttacagagaaatggcttcttgcctcaatagcgtgaggataatacgcattgtaactattttgtctcatagaatgattgaagatagtgggaaaagaggaaataccatggcagaaagaagacagctgtttgcagagatgagtaagtatggatcttttaaggaacaccctatagtttccattgaatactcatggaaaggctagaaataaccatttatctttatgatatttgtacttttccttaggatcctaagttcctttcatgaagtgtacattttggccttttttacttcttacttggcaagagttcagttagtcagtaattcatcctaatttgctattagactgtctattttatgtggaagaaaatgtttatagatttatatatttacattcacacatatatgcacatacacagacagttgataaacactatttagtgttgacattaatacagtccactaaactttaaagtctgtgttcatcaccctgaactgtcacagcagctggcatattgtaggcactagataaaatttttgaaatgaattattgactttcttccctgcaaagtgatatcatatgtttatgtggaaaggagaagttaggcacaattactggaccaaactataaacttgtcattcagacctcatgtagaagaggagaatctattctgcaaactggtttttttaaaaatactaaggaaaataaaagataaaaggagcttagagttgacctgctacacaagggaaaccaaactaagttactgactccagtgaagaatctattcaataaaggctattggtttatgtaagtgcacagttgctgtataagtaattggttggtagcatctcccttgtagaccatttttcttattcataaagaaaaagaacttgacattagggagaaaaccacacatctcaagttgaatattataaaggaaaaagcatggttctcttcatgtctttttatctcttcttcctgcatacggaatgaggatgagcaagagtgagtggtaagcctttttccctaagaaggcagtagacaaaattaggtttctactaaagattggaagtgactggcaagaatgagggtcagaacagaaaaaggaaagtcccagataataagattcatattttcctttatcattccccaataatctggtggtaccaagatagcattagaactaacaaggaggaaagaaaattaaaattgatgtggggaatctcagtcgtgttccttgctttttccacttttagagatgtgcttagagtgtttgggagagtttcagccaggccttccaatttcctagaccccatgtgtggtactgtgtcttcacctggaattgtgacctttgtgcagttacaaatccaacagagcaaggagcctagtgagtacttgtccatctaaacaaaatccaaagcagcacaggtatcctccaacagcacattcttatattaaaaaggcataaaattatgtcttatattataagacatcatgggacaatgtcttctcagacacagtagaaaaaaaatatttaccataaaaaggcaataaaatctggggaaaaatatttgaacttatcattataacactaaagactgtatcagacagcacactgtaagaactataaaagtatgcttattcaatgattttgtaaatccttctttgagtttaagtatcccagtgctttctgaacctgatatagtgcctggctcagacaaatacatatgttacaaatgtctattggattaaaattgcccaactcaaagaaagctcgatatgatttttagagacatagaaataagacaactctaagtttttcttcaagtgacagagacttaggaaaattgtgcattcggttcccaaattataactttgtgttttcatagaaacatcacagtgatgtcttgcagctttattagttctgtgagttcttgtgattaacggtcagaatagataaacaagccaaacaaatatatatctttcctccctgggtgttccaactcaaatgttggcaaaaacagctaaatacgtctgaccttaataattcattagtttgagcaacatgtttatatcagcactaagtagggcacatccacaataagtaggattcggctggataaaacaattggctggtttcaaagggagcaattgattttgacaggtagactgtcatacaaaagagaaaggtaatatcactgcgaatgtgttaaatggttgaaaaatatatgggtatcccagctgtatcagcagcacaccaaagaaaggaaaggaaactcttatcagagaagactgacatcaagattcaaaaagtaacttctaggaatctgtgctttctagacagggagcaaaaaaggactagacttgtaaatcttctcatctaagtattatatagaaatatttaaagaaaaaacaacaaaagaaagtgccaatgagattctttgctttagaaattagaaatgtgaaagaaaagttgtaatggccagagttaaacaggcagggaagacttttatccaagactattgcaacaagggagaaagactgaactcaacttccctggaagaaaaggcaggaagtactttaagcactggggaaaaatactggaggacttcagggaggagattggtcaatgtgattaggccatctgtttgctaattgtcacatttaaaagttaggcttctaccctcctgataagacttggagatagaggtgataagtccttcaattattatatttcaaagggctggcacccaggttcttgagaaagacattcctgggttgtaaacttggcaagatatttacatctcaaaggggcagagaaagaatttacaatgaaaagttttctaaagtaaatgctgtaagaaaacagaggtcagaagcctagagcaaggaagaagtctatctaaagttaggcaagttgaggaggtctaggtcttagaaaaggtaaagaacagagagcaattgataagaaaaatggataagaaagtttggcaaattcaggtgattgcagcacatatgtgttaaacattcactcttagctcattactataagcagcagaagcaggaagaaacagcaaagaaatgaaattaagagaagcatagactaaaaaacaaacagaaaaaaatagctttatataaaaaattgggtgaccacctactttgatttaagaaattctgtacaagttctcccttaaccaaaaattctcttcacaataatgccttaattatcagtttgcttagtaccttggattaaagctgaaaaaaacaaaaaaacaaaaaaaccctctagttaaatataaacatcatcctcaccttggctttttcagccatcatataagtttagcagcttaaataagtttatcagactgtcttttaacagaataaattgtttgttcttggaattaaactctccttttctgttgttttactctcagagcacatttacttagccttatatggtagttacttgtgaacatgtccacaacactcactgctgtgaactcctttttagggacagacctaggacatgtaccttcaaatccattccccttagatgctgaatcaagccttgtttaaaagccgattgggcacaggatgggtaggttttaatggaagggaagtgattggaaaacacactttgagaacattgaaggctgcctaacaaggtaaggaaggtcctggggagaaatgagagtgatgccactggcctgtcagcagagacaggacttgaaatcaaaaggaggcaaatgaaactactcaacaaataccatttttggcttttgtttttgcttttgttttgagacacagtttcactctgtcgcccaggctggagtgcagtggcgcgatctcagctcactgcaacctccgcctccctgttcaagcgattcttgtgcctcagcctcccaagtagctgggactacaggtgcaccaccacacctggctaatttttgtatttttagtagagacaccctgggtttcaccatgtctggccaggctggtctcaaacttctgatcttaagtgaaacacccaccttggcctcccaaagtgctggaattaccacttgagccactgtgcccggcctaagtactgttgaattatttgaaggcaggccatccttgagagtgttggctgaagtcggcacatgcacgattggaaaggaacctagggcatgattttgaaacgcacactatgagtttaagaaaaccgatctcaaaaattcagaaaaatgacatgaatgaccccaccaccgtaggttcatggatatggtgactgttttcacttgcttcttcatttctcatgctcctcagtctttttaagatattaacaccatggatcgccaccccagaaattctctctatgtcatcaccctaacatagtctcctgctttttctgtcccctctacttctctttttctgtctcttagtaccctgtagacactgaagtcagagaatttaaagatttcttcttgaccagttgtctccatatacaatttgtctttctctcaagcctttacctttattgctataacccttgagtgttcagagtcccccaaaacaactctcatttctcatgagccagcttatccaaaataggcagcacataaactaaacttcccttccagccttgcctacttgttttcaagtgttctgctaatgaagcagtctgaggagggctcattgtcactccactaatagtgcccatcacaaaaatacctatcatccctgccaaggcggctgccttctagtgttcccaaagcctgcggtctttgaacaactgccaagcagctgggcacagctcagaagtggggagagcactcctgttcccaagtttgtgcctcattttgtcactagaaatatagaatagccctacttgtgcacagagtctcctgttggcaatcttggcccagtcacgcacactactacattttgtgtgcttgttgataatttctggaatatactaaagctctaatccttatatccaactgtcctgtggatatcttacttggacatcttacaagcaactcaaactctttagcccaaaactatcttcacccatcaacaaacctattcctccctgtttgtaccttacttagctcaatgagggatactctattccactcagctacctaaggtagcaatcattttttacccccaaactcctttatcttcctgtcagtatctctctctttctctctctcagtatctctctctctccctccatccttcacacacacacacatacacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatatagaaggcaaaacatacaaaaattgtgtgaaaatgttcagagtgcaaaagctaaaaccaaaagttagataagactggttcgttgatttgttggttgattggttggttgaatgaacaaatgaatgggtagggaaaaggtggaaggaaagaagggagtgagagagggagagagagggaagtagggacagagggagaagagaagaaagagaatcttttcaaaaagggctaaagaaaggaaaaactgctgttgataacagtgtaaacaatctgtgtctttgctgtcctatttattacttccttccaactatgacatgggtacaagaggcttgaggagacggtgcaagagcactaagttgccttaaataaatttgttttagtttttttattatgaaaagtttcaaatatatgtagaagtagagaaaatagtatttatctcaactcttaattatgtatgccatcccccactgtattagtatgaagcaaaactaataaatcacttagatcagttgaatcaccagatttaacgaattatattccagtgatataattcagaaaacaaccactatccattattttgaaaaataatgaagagtacattgaaaaaaaatgtaacgagaaaattctgtacttttttattaaaaagaaaaagtatagattctttggagtttagggtatgaactggttataagtttcataacaaaatggatgttttttagatcttggccaaaatatagtggtaattctagacatatcaacatactaaaagcaaagattgccctgctgattttatttctttactcatttatttaaattccatctttttaatagataaattaagtcagctaatacgctttttaataagactaccagactgctagatcagaaaaataccatctgataaaaattaaccttaatttcagcaagatattgaccaaagctgttggactgtgcatgtgttggggaattgtggactgggtcacaatacagttaggtagatttatgggggatgtcatgaccatgtctaaagccacaactaatgggtctatcaacttggaggaaggcgtctagtagtatcctggaaggctctgtttgtggacctgttctggtccttggttttaatcaatgactcgaatgaagacacagaactaatcccaaagtaggtttttgggtttataaactttcaagaaaagaccacacatgtaaaactgggttaagttcattgtttgctggggcaaagaaaaatacatttattttgacaaggcagataaacagagtaagaggctatgtatcatatctcagcccagcttcttctggtccctttctggatggatcctgcagctaacacatacattgattgtgcacggttgtgtgctgctatatctgacacactaaattgtattgttcaccacatcccttttaatattcagggcttacatcatcagccaggaagaatttatacagcatttatagacctacagacctcttcctgattcttgaacaaaacacagggtcagttaagtccacacagtgatacgacaggagagagcagtcagtgcacttcaggcccaaagcagcatctctacatccctctttactgcatcctggagaagtgcacctttgccgtatttcccccaggacttcaatcagaggaaagtgcagaggtgccagggttactgtgctcagagggtaaggtcttgcagaaactgagaaacttaactatgtgccacatcacaaacattttttcatctggagcttaaatcattatgcttgaagaacttacacaaataatctgtgcccctaatgttttcttttaagtgattatttacagatattgagactctcctgattgctgagccaaacttagcaccaataaaagtacatcctcatctgggagcaaaggcagatttagcattcaggtatttctaaaagtctctctgtctctggttatcgggcatcttagagagctcattccccacgagtcacatttacagagggcatgaaactaggaaagatttttgaagttccagtgacaacttaagaattttaaaagattcagaaaagttcctagtatgagctaaattttaaaagtaactaaccagataaatatgacgtcctacccttagctccaaaataggcatttaaatagcaaatagaaaagatttgacttatatagaagtgcatatgatttttcaaagcagttttttaattaacttcaaacttaataaaagctggcataatgagccgtctatttttaaaaaaagatcacattagttaggagtccttatcaaaggtagtaataattgctttctgtatattctatacaggtaaagcaatagctatttggattaattttggacacctaattttaaagagatattagccagtcacagaacagggtgactagaatgtttaagggtttcaaaccatgcttgatcataatgaaaataataataacaactgccatgaattgaagccctactgggtaccagacagataaacagtatacctgaaatggctgtggagttgaacatcttttaccctaaaaaaagtcaaggagaagctacctccccagctaaattttaaagtccatgatgacaaggactgttgcacataattttcagatggtaatgaggatgctaataatgataatgtagctgctttgcaatatttcagaaatgaattctcaaatggcagggggaaaggagtatgtgactccaggggaaactagatcaaataggttgaagttacagggaggtaaatcaaagctcaaatataaaaaagaaatttctatcacatatttttgttcagaaatggcacatgaagcctcttaaggggcccatttactgttaagtggtcattatgttctcagtgcagaagtcaagactttatatctgtgtattaccagccagtaaagttgatattgttatctcgctttatccatgaggaaattgagatgccaaggaaaaacttggtgaaactcacacaactgggaagtgacagagttaaattttacttcctttaaagttcatttattttcacaagtaataatcttctctgtcattggaaataatcctacgtggccattggctaaatgttcatctcttgagaacatttctaagggaattcctgcattgggtgagggtagttccccatctctttgatccctcaagtgctcagtgtcactaagcctgtttgtcaaagaataagctttattaagagtgaccgtttaatgatctgctttgtaaaaccacaaagtaataggactattggcaacacttcaagtgaatctgaagatatcggtttgagttgaagaaatgctaaatcccctagtgggggacacttgctaattcatgctgagtttcactgggaaagcacttaattggccgtctaatatcatcgcttccaggatagttcatttactttctattctgttttactctaaaggattcacatagcacattttattagtatatgactggtaaagataaaagttcaatacatgcctttatatctgttatggaccataaacatgggcttagaaaaagaaaatatgtagaaatggagaaaagcagacatttattgatagtctaatgtgttctagacaaagtctagagattaactcattcaaaggagggtgggaggaatactaggagctcaggtcttgatgtaacaagcagcccatctgcagggtattgagatgagactgaccaaggctacgagagattctgtggtagaaagtggtgggcaatgtcgttaggcaagtaagctggaaagaaactgcagacgagcttggattctgagcagagcttttagacctgatgttctgggcatcaggagccatgctggactcctaagtgggagagtgaaataaggaaagtagtttaagaatatagggaatgtgttccctctaagttaggaaggaactggaagccacagtaaaagaaaggttgttttagaaaggcatctcttcctctgagattgacaggaaggatcacaagaaagttgttagtaataaaaatgaatacttatgcagcatttactgtgtgccagacggtgtttaagtgccttaggtatattcactcatttatccttacaacagtcctgtgcaataagtactattattatcatcatccccatcttccaagtgagaaaactgaagctctaaaagcaattggcctaagggcacacagagaagatgctcagcagtcagtacatggtcacctaacagccacattctaatgaccaatagcaatgcactttaaatgcttatttgatgatagtatctatatcatctagctgtttcactgtaggtcacagcttgagcagactgttttcagaagtggtggacacaacagggatgacattgtgtttcttgatccaagaatatggtttacaacctaatctccaatgttgattacatgtgtgtgctctttttccctagaacctgaggaacttgtccttgaataggacagacctgttcaagtcttaaagttatatttatattctaataaaaataaaattaggggtaaggatcatatctacagttgttttatttgtaaacattgtaaatttctttctgcacacatggcataccttatgtgtcctttttccccgcactaggggctcaagatctggatcgcatccgactctccacctacagaacagcatgcaagcttaggtttgttcagaagaaatgcaattgtaagtatgccagttgtttggactaattaccatcatgaatcctatagtttacatttggtactaagtttattaaactagattctgttacaaatattgctaatattgttatatatgtttacacaacaataaaaggggtattatgatgcacaaatggtagagatgactcctaagtagtcttgaaatctgaaaatgcttaaatactaaagcatatgaaccgtttagttcatactaaaaggatgaacctctggatacatatacaatataattctgaccttggaatggtttaaatctggatggatgtttttcttcttttctctaaccttggtatcataaatgcagtgccatcaaaatggtttccaacatcattctcagcaaactatcgcaaggacaaaaaaccaaacaccacatgttgtcactcataggtgggaactgaacaatgagaacacatggacacaggaaggggaacatcacactccggggcctgttgtggtgtggggggaagggggagggatagcattaggagatatacctaatgtaaatgacgagttaatgggtgcagcacaccaacatggcacatgtatacatatgtaacaaacctgcacattgtgcacatgtaccctaaaacttaaagtgtaataataataaaataaaataaaaatggtttccaagaactttataaaatatcaaacattaaatcccccttatatttgtattttcttttacaagcacaggaaaatattttaaagcttttggaaaacatttaagtttttttctgaaagaacaaaattagctctttgtgtcagagttttaaccacatttgtttacatgagacaaaaataagaaaagagacaatacttaaagaaacaaaggaacttgctccagtttttttttcaaatttaaaagtgtaagcaataagctagatcactagtcacaatgagcagtcttattctctgctgggtcaacacttccattgtattaccatatccattttctcttggaaaaaaatattgattcatagttcatgtgtaagaacgttttcttttctttttaaaaagtttacttattaaaaaagtctcattttttaattaatattggatgaatttttaaaaatgaaaaccgtaatgttctcctgatacatacacatagttctatgataactggcatggtaattagactcatggtaagggtagaaaccggcatctccacatgtctaccctctcagagtctctagaagatgtttcctagggccctgggcaggtcaccttagccccaggcttctaggcttacagctaatcatgactgtgaggatgcaaagtacgcatctattcctcaagtttctcctctacatcttattccccagccccagtggataaaaatggggctgaagtttggggaaggaggggatggaagaaaaatataagtaggttgtcttattttcattttctgtggcttataacagaatacttgaaactttgcaatttataaagaaaaggaatttatttcttacagttatggtggttcagaagtccaagtcaaggggctgcctctggtgagagtctgcttactagtgggactctctgcagagtctcaagatggtgcagggcacacatagtaaggaggctgagcatgctaactcaggtctgtcttccccttcttataaggccaccagcctcactcctgtgattactcatggattaatccattcatgagggcagagcctgcatgaccaatcacctcttaaaagccccacctctcaacactgcctcacagggggttaagtttcaacatgagttttagaagggacaaacattcaaaccatagcattggtcacacatcatatatgtgttttgactcctcacaggaagctaaagcaatctaaaatgagtagtgagaaaagcattacagatgttgaaagaatttgttactgtatttgtagtcctaatgagtcaataaaagccatttccactgcttgcgataggggccaaggaaaatgttcccacagaagaagtttcctcttccccttcaaacacatcacccagattacaaataaaaggaagaatctccgtgttttcagcaattaaaagggatatgattgtcccacgttcttatcatgtgttaccactacaatggcctcagaattggaggggaaggcagagggtaagtggtagacactctgtcctccttagagctttgccaagcggagccttccttaggctcctttcaggagagctagagatttccaataaaagactacaaaatggtaagaaggaacgcccccaaaaaaaaagcaaaaaaaggaaaacaaagaaaagaaagaaaggaaaaggaaaaggaaaggaaggaagggctcagggaatcagggacttggcaacactgcactcaacattaaggtggacacactgtgttgtccccactcaacattaaagtggacacactgtgttgtctgcagctgtggtccacaggccttatcccatgcctcctgctctctgagaaaggcactttctcattcttgggcatttccttttcctctttctgttcttttctggtccacatccttatcctgcatccagaattgtcttggaatttcttgaaaaacagtagagaagaagtgaggatgctaatccatccctgggtgaaaatagaagcttatacctgtccagtggcccttcagtctgtccattcattgacctcttaattcagttaagtgtataatgagctcctgctatgtgtttgacattgtgctaggtaccaaggatagtgtgatgatgaatgacatgcaataccttccttcaagttgctcaaaatctaactgagaatatgggcttttaagcagatttataaaaccatgtagaaagataatgatagaaatatgtacatggtatgtgagagcttcagggagtcagtgccctgagttgttgggggtgagggtcactggtaggactttcctagagaaggagatatcaggaaagtcttatttattttataatgtaccttataaaattcctgtatttcaggatgagaaaagatattacattctacaaaattagacaaagttaaggcccaaggaagaaaaacaagcatattttgaatgctttgctaaattaaggttttaaaaattgtttctaccttcatcagaggcattaaatgcaagtactatatgtctttgcaaagttttcctttctaacaataaatgcaacagttgtgatattcagaggtatttgtaaaatgcttacataattgatcttggcttatcttaatcaaagttgaaaccttccttctagaaagttagccaaccagaagcagcaatgtttacatgacataacattagtcaacattgaatatattcgctgattagaggaaagtaattttagtctgcaataaacctaacccacaataaattatgataccttataatggagtttttccctacagtaaaagaaataagaaacaaaatgtaggtagcatatttgtaagtgcatttttttattggaaagtgtcaggctgctctaacaaaaataccataaactgggtggcttataaacaacatttatttctcatagttctggaggctagaaaatccaaaatcaaggcactgccagatttggtatctagggagggcagccttctggttcataggtggccccttttcactgtgtcctctcatggtggaagaagcaaggcagccctctggggctttttttttttttttttttttttttttttttttttttttttgacagagtttcactcttttttcccaggctggagtgcaatggtgcaatctcggctcactgcaacctctgcctcccaggttcaagcaattctcctgccttagcctcccaagtagctggaattacaggcatgcaccaccacgcccagctaattttgtatttttagtacagacagggtttcaccatgttggtcaggctggtctcaaactcctgacctcatgtgatctgcccgccttggcctcccaaagtgccaggattacaggtgtgagccacaacgcctggcctggggcctcttttataagggcactaatccccaccatgaaagttctgccctcaagtcctgatcacctgctaaaagtccccacctggtaataccatcgcattaagggattaagtttcagcatgagaatttggtggggcacaaacattcaaacaatagcagaaactcattatagtatttacttcgtagaaatcagtggatctgaagtgaaaatagattgtttacttttaggtccataccttatttaaaatttattgcgtatactaacaaaactaagttttaaaactacataaaggaggaaaaaacaaaaacggctgttgtaaaactatcacctagaaaaaaaatgaatactgtctgcatacagcacagactgtgtaggttttcaggagatttcttttttatctattatctaaatccaaatttcataaatgttggttaattccctatagttctttccccacagcccttgcctactttgtttatgattttgcatgtggacaactggttcctatcactgacattcatgtttattttcttctgttcaattcctaatgtatgctgagaatagtcagttcccgggattctaaaaggactctgaacaagaggccactgtcacccatgaactaaatgaggcccagaacctacttttttatagagaatgaactaatggattttatagatgaatatttgtaatcgatttgataacagggaacactaacttgtaaccccaatttttaaaaatgcgtactcccaagaagaattatattcttttttttttttttttttgagtggagttttgctctttttgcccaggctggagtgcaatggtgtgatcttggctcactgcaacctctgcctcctggattcaagtgattcttctgcctcagcctcccaagtagctgggattacaggcgtgcaccaccacgcccggctaattttgtgtttttagtagagagagggtttcaccaggttggccaggccaggtggcatgagccactgtgcctggccaagaaattacattcttctcattggtagaccagcattttcttaatgtacccaattattggatatttaacttcagtaaaaatgttgtgtaaattctttttctctcttgttatgtatgtactgatataatatccctgattttgtcccttggtccacaaaaagaatgttgaccaatccctgctataaaagacacttgtaagtccaggcgtggtggctcacacctgtattcccagcactttgggaggccgaggcgggcggatcacaaggtcaggagatcgagaccatcctggctaacatggtgataccccatctctactaaaaatacaaataattagcggggcgtggtggcgggcgcctgcagtcccagctacttgggaggctaaggcaggagaatggcatgaacccggggaggtggagattgcagtgagctgagatcgtgccactgcactccagcctgagtgatagagtgagactccttctcaaaaacaaaaacacacttgtaaaaaacccatcttctttttgagtcaaagggttctcctttccaaatcgcttcttccccttaccattcatctttgtaccctgccataccttccccatgatgtaactagcacattctctaacagaataaaagaatgagtgtttctaaaaaattaggggacaccaagttgattatttgatattctaggaggaatggagcagaacaaagaatacaaataatattttaaataatcctttctaatcagtagtcttctcttcagcttccagattttttgttaactttccacaaaaattaataccccataaactcttataaggatatataaaatggcatcatctcagcctttattttagacaaatagctgtttctaccataacattatttccttggtcagcattgacgtggttaatgatccagataccctgtaatgtcagcagatcttttttttttttcagaaattactttggagtcaatgaaatgcagccctaaaatcatgaacaacaaaggacaacaagagaaataaatcagaaatatctaatccctcctgtttaatagtaggaacaaaattaagaaggcaagggaatattctatcctacacccacagctaacattgcaccatcttttagtcctactggttacagcctgaattttctttccattagtcatatcaactaaaatttaattaaaattttgtttaaaaggcaaagaggagaaaaggtctataattatatctcggctgtcagagtttctcaacatactctttttctagtaattgaaatattttaaaggtatccttcattcagatatgttaagttagaacacctgctttttctatgttactgtctctaaatttcttttcaaatttcttttgaaccaaaaaaatgcagttacctttttacctaaatgtttctctatcaccataaaagtaagccaagtgagtcccatataactagtcggtcctgaatcaatattctatgaatgaacgaatatgctccactagattcatttctcaccagtcaggtgactagaagaacgctggtcttatgtggcaggagtgccttgagctatgtttttagtagtaaacactaatattccactcatttttcttccaactagtgtatcagtattttcctcttccctgcttcatgtttaaatatgtggatttttagctgccactatgaattttctattcttggtaaaaaattaccataaatttagcagcttaaagaagcacacatttattatcttacagtttttgtaggtcagaaatccaatgcagcatggctgggttttcggcttagctttacactcaactaaaatcaaagtgctggttgggtctgtgattctcatgttgggatcaaggttctcttctaagtgcattcattgtgggaaagtgttattttcttgtggttgtaggattggggccccgtttccttgctggctgtcagctggagactaccttcagttcctagagcctcccttattctttgcctcatggcccctgtgggctgctcagggcatgggtgtttgtggcttcttccagcccagctagagtgtcctctctgacttccccatttatgactagccagagaagtctccttgcttttcagtgactcacgtgtttatatcaggcccactcagatgatatccatattttaaggtcagctaatttgggatcataatatcatctgcaaaatcccttcactgcagcccctggattcatgtttgaataactaggagaaagtatgtgacaccatgcaccaggaatcaaccacactgctcaagaacatagactcttgtatttctcagataacgatgtataaaatcttggatgtaaaaataaagtttaaagtcggaaacacaggcaagagaaatcgaaccagagaaagatatgtatttaaaagagagggatcagaggattctccctagtcaaggagccagcaggaaaagcaggaatattcacagttggggaaataaactgcagatgactaacccttggagcacaattatctatgttagtgttgttgcaaatgtttttactacatattttcattcctgatgttgaatcattctagacacttgtttagaataaaggaaggtgcattgtgctagaatgcaatgttcccaaaaattccctgtgggaaagttggtggtggcagtggaatataaacaaacctattaaagatgcctatgtaataggacaatggaaaaactgctcctctctggcaccctggacctatggcaaaattatttccccttaatcagagtaaacctctggatgagaaaagcaatgattttaaagtcctgatgattatgatatgggtttaattaaagctgcttcttccctttaatggtttttaagatcttaaaaatcagggttttgtttccttgttagtagacttttgttttagagaatgccagaagctttgcttaaactgctgccactgcataacctgtgagctaagccacacctgtagtctcgtttccaggcatctggatgtaacacacagtgacttccttccctttcttctgcttctgcattagacgtgaaagctgtgccaactaagcacttttactttcacagctgaggaaaaaccatcatcttaaaatgctcctgtcagttgggaaagagtgatgcatacagaggaatgcgtttcaagcttcccaaccctatctaacaggtgccaaggcaagattcgatgaccttcccctggtggcctgccaagccctgtttctgggaaactgcctgcttggcttggagccagtcagcagagcgatgaagggatgcccagaaggggttctcccactgcctggctcccaggatctcaggactccagcacacattgtaagaaaacagaagtcagtcgggaggacagggatgggagagcagcttctcccatgaaatcacacctgagattccatctgaaagtcactcctgatgtcacctgggttcactcctcactgaggttttgttaacattcattgttattagcaatcactcatttatgtattcactccataaatagagacagcacttactgcatgccaagcattattctagatcatggggagaacagtgtgagtacaaagtggaccattcagaaattcatccctatttgcatattctcttactgaaactttacataaatgcatatttattttagtgtacttcttcagcaataaaaatttcattttcaatatatcactctcacctgtcgaagagtaaagcaaaagagagatagaagttggtaatagaaaagtggaagatttattcagcgaatccttttaaaagagaggttgcttccacagggtaccaagactcatcaagtttctcaagtcataaatctgggcatcatctttgacctcttatctcaacccagattgaatcaatcataaaaatctcatcagttatgctttcacatatatctcaaatctatccacatctttctgtgctgactacaaatgcctagtccaaaacatctttacctgaattacaatctaaaatggctcctaaaacttcctatcccctgagcaatcccatgcataatccccaggactgggaatttcgtggaattcactcctgtgattagattatgttacattgcacagttgcaacaaaccttaaaataggggaatcacctgggtgggcctgaactaatcacctgagccctttaaaagcagagagttagccaggtgcagtggcttatgcttgtaatcccagcactttgggaggccgaggcgggcggatcacaaggtcaggagatcgagacaatcctggtgaacactgggaaaccccgtctctactaaaaatacaaaaaattaaccaggcttggtggtgggcgccagtagtcccagctactcaggaggctgaggcaggagaatggcgtgaacctgggatgcggagcttgcagtgagccaagattgcaccacggcactcctgggcgacagagcgagactccgtctcaaaaaaaaataaaaataaataaataaataaaaataaaagcagagagttttatctggcagccgtagaagagaaaatcagacgtttgaagggacagatgaatttgtcatgccattgctggcttgaagatggaaagtgccacatgctcaatcactagatgttgggagacagctggctgacagccagcaaggaatagggacctcagtcctatggtcacaaggaactgaactgtgctaacaaatgtcttgaaagtattttttttcctcagagcttctaaaataaaactgagttcagccaacaccttgatttaatcttgtgataccctgagcagggaaccagtcatgccatacttaactccttaactacagaactgtgagttaataagagtcttgttttaagattatgagtttgtggttatttgccacacagtcataaagaactatacacagtaaagcatggacctgtgctttctgctatacacagtaaagcatggacctgcactccagtgacatctgtgagaaagaagactgctcagatatgtaagagccactgggacatatactttgtataaaattcaaagcaggactgagactgaataaccctgtaggtttagaaggggagtggacactttgttttacacaactgatgaagttcagcgctatttaccgaaaacttttcccttatcaagttccaagtcccttatcatcatagagggagaaaaaggaaccaaaggcaggatctggacaaggagcaggataacaaaggtgggagagagaagtcaaaagtcaaccattctgagtaatgacacccccaaagcatcctccaaacacggagaagccacacagggaaataacatatgagtattttctttttgagacagagtcttactctgtcgcccaggctggagtgcagtggcacgatctcagctcactgcaacctctgcctcccgggttcaagctgcatcagcttgattcacctgcatcagcctgagtagctgggactacaggcactcgccaccacacctgactaatcttttgtatttttagtagagacggggtttcaccacgttagccaggatggtcttgatctcctgacctcgtgatctgcccgcctcagcctcccaaagtgctgggattacaggcataagccatcgtgcctggcccacatgaatattttctaccacaaaatgaattcaatctcaaagggatatctaaacccagattagatcttgtcacttctctgctcagattcctgcagtggctccccacttccctcatggtaaaagcatagccctgacaatggcccagttggctccactggatcaagtctttttttgttctgccctcatctcctcccactctcctatccggttactctgttccatccaccattggcctccttacttcactgggaacataccaggcatgtgcccgcatagggccttagcactggctgttcccttcacctggaattctcttcctgtagcgaactcaatggcggacctcctcgtctttctcaattctttgctcacttgtcatcttctcagtgagctctactaccttggcaaccccatttaacactccagttcccctatccgccttgtcctattgtttgtatttttcctaaagtatttattacattctaatatacgctatgctatgtaatttacttagttgttatgtttattacaccttcccaacttgagtgtaggcttctttgggcaaagatcagtgtatgtcttgtgtactgacatatcccccatacctggaacattataagtgttcaaaaaatacttactgaattagtaaatcaacattttgagactactggggaggagctcttgaacaagaaaatgatgtcaaagatagtgtatggttcagtacctattaattttaaatgaataaaataccactggaggtctacctagtgtgttgacattaagttgtatttcagaaatgaaaaatatttatagatatcttctgggtttaccccaatgctcagtatccatccattttcacactgtattagttcgttttcacactgctataaagaacttccctgagactgggtagtttataaaggaaagaggtttaactgactcgccattccatgtggctggggaggcctcaggaaacttacaatcatggcagaaggtgaaggagaagcaagtaccttcttcacaaggcagcaggagagagaagagagcaagagaagaactaccaaacacttataaaaccatcagctctcatgcgaactcactcactattatgagaacagcatgggggaaactgcccccatgatccaatcgcctccctcacttggcacatagggattacagatccctctctccacatgtgggcattacaattcacgatgagatttgggtggggacacagaatcaaaccacatcaacccctaagtctgttttcctcttaagtgatctgaactttgacttttcttgccataaggcttctaaaaatcttaaccctcatcattgtgttagtgagggaactgcagtagctttaagaagcctagctattgaacctatgactagaaggccatgtgacaaaacccattacagagaaagccctatggatttgtgaggttttacaggggcagaaggatctcgcagcagattgaggttttcttttcctaagttatttgggagacttcagaatcaactggaacttaagagcatcattctaaagcttgatacatagaagctcctacaggagatggggagggatgattacatcaaaccttaaaaatataaatatcaaaaataaaccaagccaatttactatccaaacagctaatgtatttaggcaaaagacttttaaaaagacaattgcattttttattacattaagtgcaatgtagagtggcaccgattgtctccacttcactctttttatagcatattttatctttttctagttaaatgtattcaatgctttttaaaaaggttgttaaaatgtacataacattttaaccatttaactgtatggttcagtggcattgaatacattcacaatgttgttcaagcatcatcactgtcaatttccaaaattttctcatcatcgcaaacaaaaattctgcactcattaatttttttaatatcctggaaatattgtctcagccattcttttcagtgatggccaccaaatagactaacctctggggtatagactaaaatggctaaaagtcaagcacatggttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgctctgtagcccaggcaggagtgcagtggcgtgatctcggctcactgcaagctccacctcccaggttcacaccattctcctgcctcagcctcccaagtagctgggactacaggcgcccgccaccatgcccagctaatttttttttttgtatttttaatagagacgggatttcaccatgttagcgggaaagtatttttaaaaatcattctgcaaatatgtatggatcaccctccatgtgccaggtgctctgtagacagaacagtaaacaaaacagaaaaaaacattcatgtagcttgcattctagcaaacaacacaacaatttcagataggagcaagtaatctaaggaaaacaagacagaatgataagaattgttttgtgtcttatcactgtttacatcctccacagtgtctagcacacagaatgcatttgacccatattcatgtgcagatgggttcataaaatgtctattgagtaatgactctatgcatgacatcttactgagtaccttgagggacatggagattattcagacttggagcttcacttcaagctccttgtaaatgatcataagaaacctgatatgcacattctagaggtagctatttgataacttatttagctttttccttggcctaaacccagtttttatttcatttttctttccattactctaatttcccaggccctttctaaagtctttgctcagcatggtctgtacaacttactttagcatcttcaaaatgttcagcagtagcaagaaatctaaaagcctgaattgtccaataaaggattctccctttcttcccttttcaaagccccctcccccaataataacaacaacaatccatcctcaggaacagttagatgtgtgtcaatcagataatgttggttcttggcactatctttgcatttaaaagggaaaaaatttaactggggcagcataagaaaacaaatgcaatgagatttttccattagtttaaattattctagatagtaatattccttagtatacaaatttagtaatagaataacctcaagtttacaatccaacgaatgtgttctatttattataatgctcctgattttgtagattggtagtatcagacagtggatagtggatctactatcaaatagtaattcccctctcatgctttgctgcataaactgatatctgccctatcaatctcatgagccaaatgtcattttctgaaggaaaaaggggttacttataattatggtagttacaaaatcaagtatatatatataacatatttaaataaattgtcggtagctgtttttaaccattgatggtgttgggctaggacgtctgctttatctccttgtctgtcagaaattataaagttctatttgttcaaggtgaggagagcatagtacaaaagatattaagtggcttcccttgggtaaataccagataaaatcatgtaattaaagagccttacttctaacttcccaatattatccaagtgttatagtagacagtcagtgtcctacaatgtctgtcaagccttgtcaccaaaaaacactggaacattgagaaaagcatgtggaccagcaaacctgctgtaaaactgatagtaatggcaccagccctaagcagcttactttctcagaaaaataatcagcctttttgatataatcaagtatgatacattttatctttcaatttaaatagtgctaaataaaaaacaatgatattatattgtggagaaaaataaagtgagaaaaatttatgtaactaaacaagaatcagaatctgcttcaaacatggtcataatcatcattttcttctcatttattgttctgggaggattcagccaggaatagacagagactttattaggatcagtgcttagtctgtttccccaggaagcagacctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctaagttccaggtgtttgtactgagatgtcagaggtattcagaaagaggctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtgatgttatgataaggtagacattgtgtaataattaaaacaggctaattgacatatacatctatcttacatacttatcatttctttgtgattagagcatttaaaatctaatcttttagcaattttgaaatatacattattaactttagtcaccatgctgtgcaatagatcactaaaacttatcccattggccttaaaagttttttttaacaaaagatacactcctcatgttctttatactatattgatttatggatgacctcactcaagatacctataaatgacctgtactgctgattaaccacctagagatctcttcatcccaaattctagtcctatttcccaagcaattttctatgcactagggagctgggccacagctattttctgaatgaatgaatgaataaataaataaataaagtggattttctgttatttatttgtatttattctcattgcacagagaattgtatagatatatagtacagaatgaatgaagtaaaagtaatgcagttgctacttactcacttttttcaatggccaggtatacttcatctatttgagtttatgttggccagatgggcacataattcagggtcagtgagttcaaatttctaaaggacaagtaggagacagttcctcatggctgccagccctatcggtgctctttcagaatgtggcctctggcttctaggattctggccacagttcaagttactgcataagaaataagaaaggttctgtggaaaactatgcccaataaagccttgtggagctttcttagaacactgaggtaaagggaaagcttctaaagattatgtgtaatgctgggcatccagtaggtgccctactctattccattcacttagcattattgagaacccagtttgaacaaggtattatgcagagttgagaggaatgcaaagatgaacaagacatagcccatgccctcaagatgctagcacgtagttctgtggtttttaagtttacccccacgtatcttctggagaaactgatgaaagccatggacctatgtttcaaaatatacatgaccctgagcataaaatttagctcatgattttatattaagtggaatttataattccaattatggaatgatataaaacattcaggaaaaaacttgtttattaataactatggaaaatatgtagtgtcataaatggtccaatagatatgtgaagtgctctgggagcaacaaaagggagaaagtaatcctacctgagggtataagaatgagcatcctcagggacatggcatgtgagtggtaccttgagggatggtgattgtagggcacacctggtggagggagcaggctaagtaaaggcacatacaagaaagccaagggaatgtcctggaatttaagaagtccagtgtggctagagcataggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagatagaaagagacagaaagtggaggtgagtaggaggctttcttctaagtagaaggcttttacaagcctagattagggcactagaatgtagggaatgataagaccacattaaagatgtgagctctaaaagccctttataaaatgactgtccacaggagaaataagatacaagattttcttgcttctaaagtgattaatattctgaataaagttaaacactggcaatgagaaattagttatcattcagatctgtcttttcatttaccttctcttattatttttgtaatccttggtataatactttaaaaataatgggcttaataaatccttgttcaattgaatgtttttagatttaatttatagtgtgacagctactgagtcaacaattttcatacctcactttgaataacgattctggtctgcagacacaatttaaggaatactgaataccttttcctaataggcaatggatgtactaccagggcctgtgaagattggcatgatattcaatttgattttacaccaaaaatatgttgtagaccttttcatgaaggtttattacatcatcttaaccaggaaattaaagtgaaactaaaatgttatctctgtaagacatgatgcttctctctaaggatccttagcaaagagaactaccttggagataaaagcatgctttcagagccagaaagacgttgagattggaagcataaaaacgcctagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcataccatttaattgagtccttcttccctaaaagatttttaaataccattttctcatgataagaggcctgaacaagggcataaaaataaattatttattttagagctcttaacaactaggtaatttgcacctggctttcttggccacagtgctcccaggaaattcctctgaatcaaaggagcatctctattcttcctgtctcttgtctaactccattctttaagttgtgctccatagcagtggttctcaaactttattgtctaacaaaatcatctaagaagctgattatacctagggatgccctggccacactctagacctatggattcaaactcgatagtttgagacccacttatggctctaaagaacagcccgggtttccaccaccatacctcttagctttagatggggctctgaattaactcacatagtagtctgaaaatgaaattaaacatttaactttaggagattcaaatctttaataaaatataaaaacaaagatattccctcattgaaaaattaagagtgttatatactgggcagtataaatgaatagttatagaccctgctttcctctaagctccaacacaaatttctctggttctaggtcaatataaaatctaaatgcaccatcatcgttctttgctctgtgccattgctcactgaacccacttcttcctggaatatccttccctccttatccccatctatgcactttctgctgtgttttaggaatcaacttgagccttacctcctcttccaaatctttacatagtttccagcccataaagcattcctgtattttgagctcctgtagcacttttctttttaatctgcactgtggatgtgggctttggataacacagtgtcttgtggtgatcttcagttaggtcatctgagtgtgtctttccccatgagacttacaatcttttttgtagtcaggctctcatattttgttaaatcaccaataacatcaaccataatgcattgtagagccttaaaaatgctggttggatttaatttctttgaaactattatggaatctagctgcttgttccatttcccaactctgtgtgtatatgcatatggcaatctttctccatatgttacagcctgcatgtatgattgatgcatggcaactagtgatacactgaaatattcttttttttttttttttgagatggagtcttgctctgtcgcccaggctggagtgcagtggtgcgatcttggcccggtttcacaccattctcctgcctcagcctcccgagtagctgggactataggcgcccaccaccacgcccagctaatttttgtatttttagtagagacagggtttcaccgtgttagccaggatggtctcaatctcctgacctcatgatccgccctcctcagcctcccaaagtgccaggattataggcgtgagccaccacaccggcccctgaaatatttgatttgaaattgaactaaactcgtaatcactgtgatacagtctctcatggatttataacatcatttcatccactaaagggaaaacaaacctcaagttatagaagaaagctcatattaagggacaaatatatttataccagacagagtgaggcaaagaattgaaagaatttttgtgagtggaaaatttttataattctacctgaatatgacagtaaattttaatgcctctctgtttgctctcaaaaataagaataatgcctaaaatttatatagtactttatattttactcttttcccatgtacattttcactgttcctcagaactctatcagaaaggatattattattcccattgtacaaatgaagaaacacttgaatcccagtgtctcagttcatgtttctctataagagaatataaatagtatgtatatataaatgtcaaatcccattgtatacctctgaatatatacaatttttatatgccgattgaatattttgaaatctaaaaggagagaaaatagattattattgcatgctcaatgcacttatttaatatctctatctcctccctctccgacacacatgtaagttctgtgtgattagggacctgtctattttgtacactccaattctagaaaccagaacagcactgcaacacaataaggactgaataaacacttattgtatgagagaagttataagactaagatggaagactacaaaatgcagccagtgagcagcttagggtaatgagtctcaggaacctagtgtcactcctgacattctcaaggggctaagttcctctccctacctcctcacaccccagttctgtgaagcctggcccacatgtgagctccttaaaagcaattttttcttaaagtctacttggtgcttagaatactgaatgaaactttccatttgagagttgtcgtaggaacaagacaatgcttatatgcgtgttcatctgttcattctaaggacattggaactttgtttgataactaaaagaatgagtctccataattaacttttctacaagctagcaaatgtattttaagaatctgctatatgaaagaacataatatggcacttcaaacccggtgtgtaaactaatcagaaatactacctgaactttgttcttgtactctgaagagtgtaattgcaatggaaattcatgccgggaatattgcactgaaggtcaggaaatttacatctagggaggggagaactgaatgcattttcaggagaaactatttatctttgttgctatggggattcctgcatatatctgcatatctcaaagaggggaaaacaagtcataacagaaacctcagacaccagtcaccctcactttaagcacggagggcagggtggagattgagggagcatgcgcatggatatacacacacacacacaaaaccacacacaacactgtctacgcacaagaagatatatgtattcccaatagcagatcaacagattatatccaatttccagcataactacaatttcctgttctcctaattaaagcacatcataatgcaatgagtgaccttcttagggattaagcctcaaacccttctaaaataatatgtatatatatccttatacaaatcactgttaaactgcataaattaatttatggtaatcagcttcttgcaatacacctcacaacctacgaagacatttcaggctgtcttgatgccaaaggactgagaactactgacttcaagaagcgcttcttatacttaaatgtgaatacaaactgcctagatatgttgttaaaatgcagattacgattttctaggtctgtgtgggagcctaagagatgcagcatttctaaatagcctgtgttttgttactacaagtgtgatgttggaccaccagtatcaccaggaatccattttacatccttgcaggtgattccattgtgaagccacagttaaggatcactattccataatgactaaagctaagtcactataattgtctactgacctttctcagctgcaagccctttgaaaaccttctaaaagtttataatcagtggttgtcagaatcacctggagagttttgtcaaaacccttttccactcttttatattttggactcaggaggtggtagagtctgggtttgagaattttgagatcatcaaatgctttagaaaaagaacatcatgcttagattcagaaacttggacccagcctcagggattcaagaaaggctggccctggataaatcataaaatagactaaatcttgaagttgtctttttgatatttttctcccccatattttatctaacttatatgattctactatttctaataaagtttatgacatcagccatctctatctagatataactaggtttgtcattttagcacttttcctacggatgcttggatttaagtcatctctgtgaatgaaggactccatctcccattaaaatagtgcaagatgtcagaaaacacattaaaaatatctcttgagataaacaaactctcctttacccatctgcaactctccccccaacacccgaacctagcccttttctacctgagattgcctggatttatagaaaaccattgaagctttgtctatttccatttatgtatgtaaagacaaatcttaggtcttaataattaatgcctgaaatcaacactattatcgttacttttaagattccatgaagaactaaatattaggttaagaatgcattttgtctattctcgatgtggttattgttaactaaggaatttcgttatgcaaaccgttgcctttcctagtatattaatgtaaaatatatgcaactgtatagatgagggaattcctcctatctcctgtgcctagtagcaggtgctctattaatggacgactggtttgatagctatttagtaaaatgcgcgcagtgccatctagtggttcatagtcattattacacaacctaaatgtcatctaaaatgatttaactagcacagcagtaagcaacatatttatacaactgtcagacttttaaaacaaacttcttaataacttcttaatgaatctcaacttagcatttctcagtgtcactatttaaataaacaaaaggcttatgttacttaaatttctcaataactaatgtatactgaatgcttattatacaatgcttattataagcactatgtggagtgctttatgtgaagtatctcatttgacccccccaaaacaacaatgtagtagagaaaatagtattgtcctcattttacaggcgaggaaactgaaacctaaggaagttaagtgacttgcccaaggtcatagggacagtcagtaggggaccccagccactgccccggttcctgcaccttctgcactatgcttacacctcccaaggtagtcgccaatgaaataaagtttccatgaaacctttgtgaaagatagcctcctcaccaggtttctaatgacccgatatggtaaaatcaacttaaactccactaactcaaaatttatgacaacaaaactaagtgtctgcttttgtggctgcaatgcactttgtgattcttttacttcacccacataatacgtcatcaagattatgggttgattaatttattgaaattgggatacttggctaaaatttagttttggactcacagatcttataaattagtagtagaatagtatggctttagatcagagtgtatttagttattttatcacaaatagctcatttcttgatcatctattatgtaaatacacgttctcttttaatctcactataactgcctctggatggcattcgtttcctcattttaaaaaaggaataatacaatgtataaacaaaatattattacattttatttttattaataaaatttgcccagttttgcagttatttccagagccaggaatgaaaccttaatctctgtggctgcaaaatctgaattctttccactatgccaccactggaaaataaggggtacaatgtgcgtgactgcagttttttctgcatagtaccaccttgtagacaaaaataccaccatcccttactggaactaaaacaatatgctccaactacttcccactgtgtgcctgtccgtctccgctcctttcttcccttaaagtcagaaatgacatttttaagctgcattcctgatcatgttgctgtcctacttaaaacccatgtcttcatactcagcataaagagccaaatccttattgtagttatggtgctcctgcaaccttatcttgttctggcccaatcaagaccatatcgtaatcccattttatacctagcatgctatatgtcacagtatgtcactatttctgatcacccgtttgtgtgattgtgtgagtcatgtctgtattcccaccagactgttagctcccataggcaggaaccacatctatattgtttgtattgagtcctcacaatctaccatagtgtttgcatataattatgaaaactagttttacttaaatcatttttaattatctattctcacagttagccagaattattttatttttcatgaaatatttttcttttacgttccttatattaggaccttcaatatgtaagcacataaatgcagcatatttatgtttaatacctttcatataatttctaggtatttgattataataataaacaactattgtctcctacatgacatgccctattccaagtgttttacaggcattattttattcagctgtcatagtaatcatccgaaagtagatgctattttcagttccacttttctaacatgaagattcagagaagttaattagactgacagtatacctaggattcaaaccagtgtctctgtgattcttcatgactatgccttattgcattttagaaagcaaatgcatccttagaaaaccctgtttcactgttgagtcatttctttgtcattctctcatttagtcaaaagacatttaccaagttcctatgtgtaaggatgtgtaaggcagtgtgaggggcactaggggtgtgaacagttatcacaatagacacagccttgtcctgtgccacatgcaacgcagaatgggaaacagacaaactgttggtctacacaagagtgcccactacatgctgtgatggggaaggacagagctctaaggtggtgcatgcaaggggtataaaacccggagacagggtttctgatccagcccagaaagatatccttgaggaagtaatgttgacgccaaggtatagtagatgagatgtagatgagaagtacacaggggctagatgaaaaaagaaaagaaagaaaaaaaacttcaatccttgtttagatttcaaattaatgggaagttattaaaggactttaagcagcatactatatatatatatattttttttttttttttttttttttgagacggagtctcgctctgttgcccaggttggagtgcagtggcgcaatcttggctcactgcaagctccgcctcccggcttcacgccattctccaagcagcatacaattttaagcagcatacaagtgatatgtcaaattacggtttagaaatcacactctggctgcagtgagtagaaagggagtacagaaagaatgaaaaaagaactgactcagccaaacagtaagcgtgatagcattgggtaacgaaattgggtggtggcaataaaggttcatggaaatggtgggattacagtgatgtttaggagatatacagtccataggactaggtcattgatagaacccagaaagtaaatctccctggagggagaataggcagcgggaggatggtggcattcaccaaggaagggaatcccagagccggcaaggggagagatgagtatgggctgctcaccctgaggctgaagtacccaaagaacccttacatgggcatgcctatgtgggaacccttatgtgggccactcctgtggtcactcccatgggcctggataattccaccactgggaattctaaaagggtttcctattccttacaatggctcgtcaagagaaatttaagcatccagattccctccctttgccaacagccatttagctttcttgacatatacccatctccctcccatgctcaagttcccagtccatgctcctctccccagatgtctgttccacatcatccacaaccaggaactaggtgaggataggtcacagggaccaagcaggacgacaggctggatgtcatcagcactgctttctttgcatcctgcacccagacacatcctgatgactagatccagaagattcacagatcaaatctatagggagtaattagaggaatcccagctcttcccaactagaatttaaataaataaataaatttagtttataaatgccatttccctgggagtgttttgcttgctagatagaagagttggataaataacaccaagaaatacaaataatttccttgttgattaattcttgatatacagaaaaggttgcaaatttgaaatcacttaaatctgaatttttccaaaactaataaatatttattttagttggtatgtgatttgtactcatctgctccaaatcagagatatattgcaatatatttttcttttgacatgactcacattatttacttgttcatctataatgcattgtctgctaggtaccaggaactaccactttttactctatgcatttttccattttaggaatgccagccccatttcatagatgaaggaagtgagactctaagtcttagaggtcatgcacttgtcgtagaagagccagatttgcaacctaggtctttggactccaagtccagtgctccttgagcacaggtatcttcccttcataacataaaacattattttgagtaattgttaaaattaacagcaaaaatccaagtaaaggacacagtaacggttctatgtaacctgttgttttttttttttagtttaaggatttgcataatctactcatctcttggatctcaatgtgcacacaaagttagttatgagaaccatactttaggtttttgtttttctttatgcctaatttgaaaataagaatgtctgaacagattgctctctctctcttagggttctgtggttacagatcctgcagttaaacctagcctgggaaaagggtctgacttcaaaagactgttggctagttggctcatttgttattataatggaagaaattggtgacaagttctcctataccaaaagtcagaaaccatagatctgttctgaaaagcaaaagtaagagagaagtcaagaaaaaagtcacatagctcaattcatagtagaagctgatgttagttttgcttattaggtatatagccaggagagagcaatgaggtagaagacaaaaaaatagggagctgttagtgaaaaaatatatatacagtgcatatttctcaaaaacggaaactgttatatttcattgagaataaacaaaatatttatttgcaaatgcaaaagcataatgaaaagtcaaccttaaatggtgaagatgtggaggaactggaactctcgtacactgctgatgggaatgtaagatggttcaactacttttggaaaatactttggaactttctttaaaaattaaacatacacttactgtgaaacccagccttttcatttctaagtatttacttaatatttttaatgattttaatattttgaatccctcattgtctaagagaaatggaagccacatatctatacaaagacttgtacgtgattgttcatagcaattttattcataaacaaaaactgaaaaacaacccaaatgttcatcaacaagtgagttgataaccaaattgtgatatatccatataatggaatactactcagcaataaaaaagagaaaactattgatactttcagcaatacatgtatgaatttcaaaacagttaacactaagtaaaagaatccagacccaaaaaagagtgtttaccatatacttacagttattaagaactgaagtttgcaacagaaagcaaatcaatagttgcctggaacagggaatgaggatggattgcagaggagcatgagaaaacttttgagggtgaggacgtgttctttatcttggtcgtgatcatggtttctgggatctcataacaagacctcagggcaaatagggaagaaaacagaaacagctttcttgactaccctagtgaaagtaaccatgacttaaatcagctggtaataatgtagccaagaaacttcttgttcttgaccagcctagttcagtgatgtgtgacttagttctgctgctgctgcagtgtatacataacttttcctttttaccttgtcttcctgcctaccttaactttctttttttttgttgtttccaacagcatactactaaaaaacacataaataaatgaaaacattttaaatactcaaatataatttggacatcctttcaaacactagaatttaaatgttggccttttctttttgagggggcagggtgtgcaatggggaaataacttttaaaccgatagacttggatctgaatgctagtcttgccattgactcctcttctacttttgcatttgtcagttcagtttccagatcctcagttttcttatgtgtaacacagggataatagctgtatttcaagagtgattgtgaagattggaaataactatctattgtggtggtcagtaaatcatttgcttgctattatgtaatgcacatcaagtcttagagataatgcacagcctatgttcatttacttatgttgaccccctgcaacagctgcacacatgtgagatacctagaaaaaaacaggacagagggtcatgtaaactgatgtatttgccttccattactttgggctgatgtgttaactctgctttaattgtagtgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccgtaagcaccctctgaatgtctgttcctctctacatgtttggctttcacttcctgtcttacttggtctttttcccaaacaattttatatctctctctttttttttttactctcttttttcttacagtggatgcttatgtcagtaaagtctccatgtgtttaatataaattttaaatcctgtgaaaaagactagagagtaaaatggtgccagaggaacttgaggacaattgtattttatgtgctgacctttagttatctcatcccatgcttcctggaagctgtggatgcttgagaggattgcctgtggtgcgatttaatgaagcgtgaagtgggaggatctttttaactctcttctttgcaaattgtttaagacagtgtttctgaggtgtcctaacaaggccctacagcaaacaagaaagaaattgaaaagggtttcttgactatcccagtcaaagtaactatgacttgcgttaaatggactggtcaatttaagtgtttcgatcataaaataaggggatgctgtccacagaccacaactgaagctcagcttcatttttgtataattttcccttttagaatcagagaatttcagggctggctgagatcttaaaggctgttcgtccacatatctcattttacagatgaaggaaatgaagcacaaagaaattgtcacttgtttggtgtctcgcagcatgttagtggccgagtggggacttaggtgttcaacaaaggtttctttaccaaggtatatgtggattcccctgaattacattctcagcctacaatttcaagagggctttttgccaatagcctccaacctggacgtagtaccaccccctccacttccactgcttgttttgaatattaaaaaggaaaattgctaacctgacctttcagcaatcacattttgagattctcagaaggttttacttagtctcattgtctggccaatgcttggaagtatttacccccgcagtggagatgttccagccaggctaatgttattttgcaattcacaaaagctaccagctgtcactttgcaacttagagtgttaacagaatcgttcctgctcagtttttccagtgtgcattattgtcttcgtgatatttatattttgagaaattcttcagttaaaataaacaattttacaactagcattccaggttggtagagtctttgcttcggctgtgcacacttcagaacgagatgtacagctctagcttaatcactatagtaactggatgctggggcaggtaaagaggactgtggttccacatgacaggcagcagaggcagcagaatggaacctggccatggcatttctgtagtggcatttctaacctggccctgtgacaagagtgtggcagctttcagatttgcccctaaagatgtcaagagacttatttgttagaaatgtaacaatggaaactgcaaaaagagaaatataatatctcactaaatcctggagtactgctagagaactcataaagaatcaaagccaaataatcatttgcacccactccataaatatagaccagaaaccagactaacaataaggaagggggtattttgtgagatatataggattcacacaaatatagttagatttttcacttttggtcagaaatatttgctagatcacttctaaatatagagctatgaacggtctctaaatagctgctgaaaatatagctgaatcatttcaagattgatgaaaagctaagtttgacatctattccaaggtaaggaacaattcacaaaaaagttcagaagaaatctttatttggtgcctattcttcgtatagataggaagcctcctgatgtgtactttcaataatctcactgtagtagatttataaacacatccacatagacaaatttcactgcaaagatttataaacatatccatgtagagatcctactctgcagacacttctgcgtttgctccttcagcgtagcaaatgagcataggcagtcctactgacactcaaattttccatctgatggcatggaattttggatgtgaaatgtaagccatcaggaagtacagctaactggatatgtaatttagaagtgaatataagaagagaaacttaagaataaaataaatgttcaaattctatttcttataatagtaaactccaatttatccaaatgagacccagcgtggaaatctgatgccacttcctaccacctgtcccacgacagagtccaagtgtttaagagaaccgtctgtattttggcagacatgaatgatcctgatactactaaaagaaagatgtgctgttgctattacagaatcactgaaacatttaggagatttttctcccatttgtcgtattttaaatggacatataaataaacagggaaaaaatccaaaataaaaattagagatgccttaagaacctagactctgaagaagagttgctaaaaataaataaataaaaaagaaaggcagtatagtgatttaaactcatgaagaataagaacttggattcaaagaaacttggccattttgtgggggaggggatggtgccttaaaattcactagactcccaggtagttgaacttcgtgaagaaagtggtaacctgagatgaggattgatgcctcctttactgggatgtacttctgagagccagacttaccttcgcacagccatagctccccaagaatagcattccctctcccaccaaaaaaacatccggatctcaattttcataccaggatgcttactgcagactgtaatcagtttcctggttgcaagatttctctctgctcgttggcaagtcagcctctcagaagatatgataactacatctgtagatgatttgtacaatgttgggggtgggcagtggaccccagtggtttatgctcatgcttgccattctgtccctgaagacacagttccttgagtccagaagatttttgttttttgtgacattccttttaaaaatggctgtattcctgggagggggtcacccagggagcagttaccaaccaacttctaagcaaatctctccacggccagaggttatcttttttaaggcgtctagtggaatggatgagtgtgcctgagaaggatgggaaaagagatgtcagaaataagaccaggggctgagagggaagaagatatgtgagggagcagccagaacttgagccagtctcttcctcttgtccctttcctccgatcaccccaggaactggcctcccacctccccttctttgctgccaggagccttccgctcctctgtctcctccagaatccccccagcaaactggcagcagcttcttctgtcacctcttgtccatattctattgaggagggggaaaactctttgaagtcttcaaaggacctttaatgttgttcttattattttgtaggaaatagagagtaactcaaaagaaaaatattgcagaaagttaaaagatgaaaataattcttaaaagcctataatgtgcagcctttttgagaggtgcagtcacaaactctgaggttctgtgaagcctttcgcctgtcatggtcaagttgatcacctttccacaggtccacctctccttgcacctgattctgctattgtcttatagtgcatgtctgactgtttatatgactgcctcccaaagacttctttaggaaagaaccatattttattcttcttatgaacagcacctgagaccatagccaacacaagaatgaatcaatgaatgaaaatccaaggttgatctttctgagctcttgtcgtactaatttcttttaactatttttttttaagaccgagtctcactctgccgcccaggctggagtgcagtggcacaatcttagctcactgcagccttcgcctcctggcctagagcaattcttgtgcctcagcctcccgagtagctgggactacaggcgtgcaccaccacacctggctagtaattgtgtttttagtagagatagggattcaccatattgctcaggctggtcttgaacctctgggctcaagcaatccacctgcctcagcctctcaaagtactgggatttacaggcatgagccaccatgtctggccagttttcttttaattctttttctgagattaagtcttccttgatctccaatatattacaaagactagcgggtcccagtcacctagattcagaccctctatttttacttctgctccacagaaaaaaaaaacaagtgttcatggttaccaatgttggtgatcctatttttacaaaagacttctatgtactcctctcaccttctccctgcttccccaggaaacactaaaaacaagttgtcttgactcaatctcatttcaattcagtagtatcttctttcgtaagacagttcttcataaagtagattatgtgactctagccttgtttttagcaaataacattatcatatatactcagtcactcaaaaatcatagtatgacagttaaaaatattaaaaggaacagtgattttcctattttcagaggtcaagctatagtcttccatgataatcataataattgtattaaaaataagatgtactcagtatttactatatgtcaatagtcttactgacttggccctatattatcatgattttccagtagaggagatagaaagaggttaaataatttgcaggtcatacagcatcatactaaatgaggtaaatgagggaaaactcattttgtttcaggaactgttttaagctcagctctattcatgctttctgtttcactttttaaaatgaaaattaattaaccttttttctcccagacttgttttgcttattacaggatattattctgatgcttacattcctaatctttccagtttctggtatttatacacatttgaaagagtgtatgtggaagaaatatttggacttaacatgttttacattgtagcattaggatcagttttatgacagctacccagaactacaagtccatcacataatagtcttacgtagagaatacaaaatcctggtattttcctccctgtttgccatattgcaccttactgggccatttgaacacccatgcccactgctgagccttccaatgctacaaaaaagaccacagaactatttcaaatgcatggatatgaaatgcctggtactctgccaaaatccttctgtctttcgaatttaaaaaatgattcgatatttaatgcaaaatgtactacaaagtacacaaccatttctctgcaccaaaaaaagtattgttcatgtttgagactatgtagatttgtgaaagcaaagaagaaaaaaagagaagagttataaaaaaccaaatgttcttctcttttattatctatacagccaagactagatatttaaaacagtgtttacttggcgtggtgacttttttctttgcacgtcttaaatttcaagatgtccatagaacattctcctctactaactaaaatcttgttgtagtgaaaaatactttgttcaaaatttctacatcctgctaaaatggaatcactttccaaagaattttcacagctgtagatacattaaatatcctaatgtcactcgttgtttatctgacatactttgaatgagtagcaggtagaatttcaagagagatgaggaatttcaaggggtatgggggcattccaacagtattgaccccttctgttctggagaaacccctagcaaactcacctgccccggcgctataaggagtacttttcccagatgttttgctaacattgtggagggcccagagagaagccagatccaaataaagggtttctgtctgttcacaggttaacttcactacgccccaaaccagagttaattatgcctgtgaacacttctaaattcaaagcatcacataactgcacaatctaaaagaaacagccataaagccaatcattatcatcgtattcaaacacgttatatttctcaatataaatctcaagtggtaaatcagaaagttgcttctcacttgtgcattcattaattgaactgacatatgtaaagagcttgctatgtggtaggtgttatgataggctgggaataaatgataagacaagatgaaatgagatgagatacccttggaaaatgggttgtattaaaattaactgtttctgaccctttatctccaacatgttgtgagcaaatgaagagtagagaccacacctttttcatctgtatatccccaacctctaggacaatgctaatcaatatttattgagtgactaaatgagtgatccatatgagcaaaataattttcagataaaaaatgtgttatagtagaggcatgttgtggaagcagagggaggaagcaattctctccgttaattaagccaccaaaatgtgtgagaaagagcagtttgagtgctgtgcctctgcttatcaaaaatgcttaccaaatgtttttgtgaaatatgttggtaaaagaagagcttctgattttagtactcttaaatagagaaataattccttctgtctgtttaagaaagaatcagtcagaattgaatcttacttaaaagaacttcaagtttctcatgggattttgtaacttcaaacaggaaaccctgttggcaattcggagacaatttacctcctgtacttagcatccagccctaccgatcaatatctatttgttgttttatcttcttgtcaaaaacaaatattctcttccctgcaacttttccatataaataatatattcttagttggaagaaatcagtatgtctctttataagattatgggaaacccagggcagactaaagcagtttctcacttctttattatgacaagtcaaattttgaagtaattcaaatttttaacataaaacaccctacaaatcactatatatattttaaccaaagggtaagtgccttcctctttccattttcaatcagttgtcccctagaataacttgaaaagtctcagagtgagaaaacaaaatgtaaaggaagataaaagatttcaagaaacattgatttatgaagccatttcagtttgtgcttttgataatttgcatatattagcctggttctcttaaataccttgttacatgttaattatataccaatacacaattttattgagaatttttgaatgtcgatctagaacaagaaagtaaagtttgtataggcaaaagttccagggtaattggcttagaaacagaacatattccactatgccaaaagactataatggagaaaatgaataaagtatgtattatgcgctgttttctctctgcattgaaatggaaaacattacaaacaaaatactattattttattttaaaaataaaataacttttttttttttttttgagatggagtctcgctctgtcaacaggctggagtgcagtggcgcgatcttggctcactgcaatctccgcctcctgggttcaagcaattcccctgcctcagcctccgaagtagctgggactacaggtgcacaccaccatgcccggctaattttttgtattttagtagagacgggttttcaccatgttggccaggatggtcttgatcacctggcctcttgttctgcccacctcagtctcccaaagtgctggaattacaggcgtgagccatcacccctggccaattactattttaataataaaatgatatactaatattaattctttaagctttttctgtgccttttatattaccaaagaattaactgtactagcagccttaattcacaaagaaagacttacatggccatgtgattgaccacatcacagactcctaaggctgatcccgcccctaaaagtctgtgattcatccagacttgtgccctgtgatgcatccagtctctcaaacacatctggctcttttatgtcttgagatggcagtcagaattgcacatgaagttgaaggcatactgccatggcttttcataaaagcaagagaagtatacagactttttctgtgcacttcctgatgctgccccactcccaggctgtttggcctgaagttttagggaaaatctatgtttttcaacctcagcacacactggtggttggcttcctgggttgcagctgacagccagcattccatcggtgcagttttactaccttactgcaaaggcattgccagagacatagtcattttggagcaatatgctgctttcctgctcgtttgtacaggactctgaggagcttcccattatccatcctcatgcacttgtctttctgcttcctagacacttaacagattttattggctgtttgtaaatcaaactggtcccaactaatgacaattcctgatgagcatagctcctaaatttttccatttgggatgtatcagcttttctctactccttgcttcctgtgttaatgccagtgccttttttcacaatgaaatagggaccctggtcccatgttttgctcaaaatatgggctgataaccagaggaatatatgctacctaactgtggttggctaactagccaacagaagacgcttttcactttgggtttcataaaataattttgtgcagaataatctcacagtctctataatttatttaaacaaatcttcagaaacataatttttttgttagagaattcctgaatttgaaattagggtaactatagggactttttcatcacaaatttttttcaaccattatttcctactcacaatacaactgtgcttatgtgatatatttactcttcaaaaaaagctgatattttttaaaggccccctctttaaaattggacaccctcctcttcaccctgttatatttacaaataatgttcttttaaaaaagatccatttgtatttaagtctttagtgctcccattctctgttgtagagtcagtcatctctgctcactcctcaaaccgcataaatatttatccagtgcctgggataagcaaagtatgaactcacccagttttggtgtgcttgccacgacctaaatccctgcatacccccagaatccttcttcatgacagagtcacatttgcaatctggcacagtagcttgcataacaatagattccagtggcctaatttcacccttgagttcctgtaaaaccctcattcggctgccctccacttggtgatttatctagatttattgtgtcaatttggcagaacagctctgatataaccactgttggatctagtatcatcaatcttccatttccaggaacaatacaggactggcaatctccccatgatcttcttcattaaaagctgaggtctaagagtacacctatgagctatcattgtttcatcctttggagaactctctgttccaaaatcattggtggtcaatcctctccttttaaataaattattctctcggattcattgaaaggaactgtattgctcttgaagcctcacatataatgctcctcgatttctttgcattttgagggccacattattgctatgtgattgctaatcttccataccttgtagactttactgttgtcattatttgaaccatgttacagtttaggaaaaaagctaattacctcctgaggtcaaatgtttgatacttccagttatccatgtaatgggaggacaggaatgcttttgaataggctggtttttacaaaatcattgcatttctattacagctacctgctctaaaattaataactcactgagtggatggacactcaaaattctaggtgtaatttttataatgattactaatcatttcttaatataagaaatgtattagtcactaactctgtgtgagaccaagtgctaggcactaggaattcaagtaattcagaaaacatcatctctgcactgaaggatctcacaatgtagaatccagtcacattgtggacatgtaaaaatcacatcaaggtcattcattgtgacagatgccacataataagtaaaaagtgaagggcagagtgatttcctagacatctaggagaaaagctgttttcagagcagggtgaataatgatattgagtggcatcttgacaaatggatgggagggttgtgggcagaccatgttaggagggggaggggccaggaggcgttgaacagtttgaccatggtgtgcagtacaacaacagaaatggtagcagaggagactagacgagactgctgggtgtgccatgagcaaacgttagaacttcgtcctgagggcaaaaggcggccagagggttttaagcaatgaaataatatggtcaaatttgtgatatgagtgtgcaagcagagagatcatttcagaggttatgaccgtgttaaagcaagagctgatggaagcagtgacagtgggaatgaaaagaagggaatggattcaacatacaggtaacaagtctagctgagtccttcaaacatttgttcggagtggtagtaattaaggaagagcaagaaatcaaaggcgaccccaactcaggattcattttcaggtaactaggtacatggtgtttctaataaccagcagaaggactgcaggaggaacagcaggttagtactacggtgagtctgagtattatggaagagctctgtaaagataatgagttctcttttgaacatacttagtttggcatgaggtatctaagtgaaggtttcagataaatgattacataaatctggtgctgaggcttagaaataaatatgaaagagtcactagcatagggttcagtcaattttgcattctggctggttgtatttgaggtattacactaaaaatgacagcgacagtgataaataacaaatgatccctctctgaaacctagtaaggaacaaaaccacgattatttatatcttatttttcttatatataaggcatatgaatcttattcatataaattatttattccatgtactaaagctttgccaatacaagctttacttacctttcagacacattattattttaaataactcttttgaccattcttaagattagcaactatcaaataaatgaattactaatatgatacagtttctgattccaaagtataagaataaacagttgattccagctggaaaatcatttagctgaaacattatactttttatcatatcccctttatatcacatttgtgaaggacagatttgttatacttcctgaatcaatgaggatttggcagcacttgtgtcatttgggtagaaagaaagtgttcaaacagagcttttactttttttttaagacagagtctccctctgtcgcccaggctggagtgcagtggcacaatgttggctcactgcaacctccacctcccgggttcaagcgattcttatgtctcagccacctaagtagctgggattacagacgtgcaccaccacacctagctaatttttgtattttcagtagagacaggatatcaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaaaagtaaatatatcacataagcacagttggcttgtgggtaggaaatgatggttgaaaaaaatgtgtgatgaaaaagtccccatagttaccctaacctcaaattcagaaattctctgacaaaaaaaaaaaaaaatgatgtttctgaagctctgtttaagtaaattatagagattctggaattattgtgtgcaaaaatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagacagttcttcagatatgtgcattgaattgttttcacaaccttttataaaatggatgtgcccacataaggcatgcagctatgtatcctgtgatttctacagaatagaaaatgtcaaaccttgttgctggaagtactccaaatgacatcatggttttgttttgtttttgtttttgttttttttctattaccattaaacagggaaggccatggtaaaatttcagtatttgctgtcaaaatggctttagccacattgtgtggagggaagatcatggacaaattaagatgtaagttattattccttgtgtgtctgtttgcttttccttgctaggtaccacccttttctctccctcattcctctatgtcccctccccatttgtatctttcctcattctatgagagttgtttgaaatacatttttcactgatgtttggattttgtcatagcgatattttcatattagataaatgctaatgaaatgaatgttttcctctacttataacctgttgagtatcaccaactggcctctttctgaaattaaagtaaaataagcactctttgcagttaattgtgttatactgccttacacgtggtacaggatgataggcacgtgaaggcttagtgggaaaccttcccctttaaatcttctaaaagcaagactcttggcacatttcctcattcttctcagccagcactgttcaaatcactgggaactccaaaggtttcaaagccaacaatgtcaggaaagaagaataggaattacatagagacagcattggcagagttaactagatgccagtaaaagcatggtagctaaagtacattgagtaattgtgggccttaatgaacattttgtctctaaatatggtagagttccttaaccaacgacacactggggattgtttgtttgtttgtttgtttgctttaggtaaagaaactgagactcagttaaccatatggctaagacgatgccaggatttgaaccctgacttttttttctacacaggtggttcacaaattttagcatacatcagaatcaccttgagggcttcggtaaaacatagatttctgggtcccaccccaagaatttctgactcagtaggcctaggatgagggtgggtgaaaagcatatttatttctaactagtttaaaatgatgttgatgccgctgtttaaatttaaaatttccatttaaccctatccttttccctaaatagtatgagttggggctataatgctgtgttagaaagggcactgtcctgggaattgggagttccaggttgcaagcccagctatgtgactaatttgctgagttatcctttgtcagttacttcacttctttagtcctcagcctccttctgtatcctaaattttgggattttgtaagatacccatagaatcacacctggctgcatgcagccatctgtgtggctcacagcacaaggctcacctgctgcctgtcctcttctgagtgagatcgcttgcttcttgatccacccaaaaggaaagaataaaggaagacacagaacaccttttgttcctttgaaatttccctggagatgctccagggatgagtcattccagtggaccagtaagtaagtgaaagggacaacaaagcctcaggtagccacacagcttccctcacttctgggacttccctccatggagagccaaagacagccaggattcagagaagcctagccagaccttaggaggagccatgtagcttctcttttgttagcctgaaagatatagaaaattaaaaactatctacctcagtgcttatttgagagataatagctaaattagaaggtgctgacaccgagggcttttttttttctttttttttttcaaaaaaaaagaaaaaaaaaaagcttcagagtaatcctcgggcatttccttcagggttaagccagaaagagaaagtttagcaaaatgaaccaaggctaaggaaggaagttctgagaaccttgtctgccaaccccaactggccatttacgaagaggacattagataaatgtaaaaaacaaaacaaaagctaaacaaaaaaatccacttgagagacatctaaaaatacctgtttaatattatattaataggtacctggatagaagggtcccatattaaaataggtttaaggaaatctaagaaaaccagttttctgcatctcagaacgtctgtcaacctttaacataccaggctaattctgagccctcgaagtcctggtgtttgctgtctttccactcagctttgttcagtgtaagatttcatcctcctccaagagtaagggtggagggtgagggaggggggcttggtggaggtgacagtcacaggagtcacatctcactacagaggtccccaagcccttacagctcatcacctaggtggcgtctcagaccaattactaaactaattactggttagagaaaaagtatgacagcaatggccattgtgtaatccactttcacctcctgtgctcagaagggccatccctttccctcaacccatgagcaatccatgaacaaatgtgggtcaaataaagatgaagggaatggctggtaggtaagggactagcaatgtcagcacagttacaaagttcaaaatataactaagttattgattagatctttacaattgtgaaaacccttccagttctctcttgggcccaggagttcaaaggaaacagtataactgctacagtgctttctcctcaccccatcccatcaccctccaaaaagcactctctagtggccaaagtctatcctctttagggcagtgaaagaagcaacaaatgcatgtgtccccttggaggtaaactaagttttctagtctgcagaaacaagcccacaatatcacagattctgtagaaatacagatagtgtgaccccgataaatcgcattccccactttgagagcagtgcacctgaatcacacccttatgtgtccctggttctctgactgaggagtcactctttgtatagttaatcctgggaagatggttttagcagtttccaggtaacttggttaaaatcaatttgaccaaaaacaatttagttaaaggtaatttggtcacaaaaatctctccagaatgttaactagtcaaaaatgaatatcctgagttatgaatatttctagtttctgtgataattattaatggaatgagcgaatgtgggcaaatttacccacaaaatctgcccgcagagaccagtggctgccccttggtgagtgggattgtgggtgttcctattgtattcttttgctggcttgcattttaatgataaaacagataaggtagccaggcatggtggcacatgcctttagtcccagctacccagaaggctgaggcaggagaatcacttgaacccaggaggcagaggttgcgtgagttgagatcacgccactacactgggcaacagagcgagactccatctcaaaaacacaaatcaaaacaaaacaaaacaaaaaaaacaggtaaggtcatgattttctacgttgcttctgtaataagaaaaagtaaaatgaagggatatggaatgtttcaggcttgagggttttgttttcccttctttaaagtttttctaattcacgttaagccaaaatgccagctgtgcttgtttggcaatttttctatttttgtgcatagggttgagagatatttagctcgttccagctactcccttattgttggtgaacacagagcaagaataactggctgaaaataagtcggaaattttaaaaaacaaagagaaagcaacagaaaatttgaagttgattttcttaacgctttaaaatgcattagaagagaaaacaacactatgttgcaacataatttccagtaattagggcaccattcagtggtagggtgttccctgtgtaattccagggagcatcattgacacagcttaggagatgaagggcgccccctgcagtcatgtgccatggcaacctaaacataaacttacctaataacactactattttgtcagattgttcttggcccaattataagctgttttaatgggttggaacatttgtttatacttctgtcttagggctcctggatagttctaaggatcttaagggattctaaatccaatgctgtaagcctggtatgtcatgtgctgttctaaagctttggggaggactttttaagtctttttaaaagactagtattatggaaaatactgcatatttattgagtttctattactgaactggttgttttgcctctacgcctacccatagactttctaacgcactgacctactttaaattcttcagtatctccctcagcatcttctggacacaacctaaactcctcagtacaattcagccataaaaaagaatgaaatcctgtcatttgaggcaacagggatgagcctggaggacattatgttaagtaaaataagtcacgcacggaaagataaatactgcatgttctcactcatatgtgggagctaaaaaaaaaaaactgaactcatggaagtagaattgtgcttattagaggctgggaagggtagggggctgcaggaggttggggggatagggagaggttagctaatggctacaaaattacaactatgtaggaggaatacgttcgagtgttctatagcactgtagggtgactatagttaacaaaattttattgtatattttcaaaaagctggaagagaagatgttgaatattcccaatacaaagaaatgataaatgtttgaaatgaaggtaacgcccattatcctgatgtgatcattacacattgaacacatgtatcaagctatcactctgtagcccataaatatgtacattaatttttttactcagatagaatctctacagtctcatggttaataaactatttgaaacagcggaaaccctttataaatggagtatttaatgaaaatgagagtcaattcatgttctcaaaaccataatccgataaaagcctctgatatgcttaacatctgactttggtgtaaaaacaatgttcccagattatattttgaccttgaaaaattaaacctaaagtgaatagaggtggcacattcacagcagtttatcccagcagctgtgctggcctggtgacaagctagttagcatggtgacaaactatataatagcaaaccctttcattctaatagtgatttgcacagaggaattataaaacaccttgggaaattatgccattaatattcattaaatgcacatagtggcagaaattgaagaacagtggttcagtgaagccataggcccttcagagaaagatccaggaccctgactttacctcattgatcatccacaagaccaggcttcctcttcactacacgagtcagaaaacccttccctgtaaatcaagtgccttccacccagaaaactgtaattcatagaaagttttcttcttctgtaggaagttaatcaagtgtttgtcattacatctttatcctcaccgtgtctttgattttcaaatatcttacaccaaaatccgaaagttttagtgataatataaattggtaaatttctagctagataaatgaatatacgcacaccccaactttatagtaaaactctcattgtgtttcaaatgaagtcagcgtctctctcatatatacaaaaatttctcttgttgagctacatgagagttaatagttgacctcaaaacaaaaatgtagtgtcttattaaagacatttaataagtgtctctctcattaaaatgttaactttacccaaattacttgtgattgctatgtgccagaatcatctacaaaaagaaaccagagaaaacattatgccaggaatatttcagcataaaaattagcttttatattattctttcataaaaaatgtttattttgctacttttttgtcatttgtagcagatatattgaacaaaaacagtggagaatgttcatgtgatgaataatatctttccttttcctttcatcagatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacaggtaggagaaaaatatgtttaaggaagtatctctttcaaacagtggttgctctccttctagatgtcattccaggtcacagatactcagacaaattattctgtgtgatagcaacctgtattgtatttttcagcctctggcaaatgacctctgagccagtaactaaacccagcacatctggatcacaataatagacagtgtttactgaccatgaggcaggcactgtgctaaattttttcctttcattgtctaatttaatccctacaacaacccttctgtgttagtctcttttcacactgctataaagacatacccgagactgggtaatttataaagaaaagaggtttaacagactcacagttccgcctcaggaaacttacaatcctggtggaaggtgaagggaagcaaagacctaccttcttcacatggcgacaggaaagagaaagaatgaaaagcccaggggaatctgccatttataacaccatcggatctcctgagaactccctcactatcatgaaaacagcatgggggaaccaccccatgatccaatcacctcccaccaggtctctccctcaacacctgggaattacagttcaagatgggattgggtggggacacaaagccttaccatatcacctacaccctcagtgtcattatttttactatcactgcactttcaaaagggcttaattgtctcactcagcctcatgtgaaatatatgcttgacccggcaacaagctttaacattggtttagcaaaggataccagaaaggaatcccaacatctgccacatcatgacctgagaggcccaaaatatggtaaacacagctgcctgaatcttctacagcatgacacatttggggttccaagtgatgtgttttaactgggtatggctcaagctaccctgggaagctgcatagtttagggggctatctatgtgtgtacctctctggtcatgtagagagactccaggcccattctccagcgtagcccagtggtagcatagaaatccatacattaaaggttagtttaccattttttgagaatccaaactaacttttttgtcctctaaaaatgcctcttgactgggtgtggtggctcactcctataatcccaggactttgggaggccgaggctcaggagctcaggagttcaaaaccagtgtgagcaacatagggaaaccccatttctacgaaaaatttttaaaacatagccaggcatggtggtacatgcttgtagtcctagcttctcaggaggctgaggcaggaggatagcttaagcccggatggcgccactgcattccagcctgggcgacagagcaaggccctgtctcaaaaaaaaaaaaaaaggtatatccctgccccataaaatgcatacaacaaatgctcactacacagctttatggattaagagtcaggaagtcttttctttttactgaaattaacttttaaaagtgtcaataggccgggtgaggtggctcactcctgtaagcccagcactttgggaggccaaggcgggcggatcacaaggtcaggagtttgagaccagcctgtccaatatgttgaaaccccgtctctactaaaaatacaaaaattagccgggcatggtggcaggcacctgtagtcccagctagaagcaggagaattgcttgaacccgtgaggcagaggttgcagtgagccaagattgtgccactgcactccagcctgggagacaaagcaagactccatctcaaaaaaaaaaaaaaaaaaaaagtcaatcacttcaaaacacaaatctattttttcattcaattttactgctttccaacttttctcatggcatgctaaatgtatggctccttttatttttacagtgctttatgcctcacaaagtgaattatctgatttatggcttgcaacaaccctgtgacctaacaaggaaaatatgattcttttttaacaatataaagttcatagctagtgagggcagggggctgagtttttaactctggtcttctaattccatctgttaatgttattcttgtgttcttgttgttgttgcttttgttttgtgcactttcagttcatatttacaaatatgcagatgatctgactcaaggaaatgtaactacctgttgtattacttcacccagtcatggaaacaagaataatttcatttataactgaattcttgaattttagttagtgtattatagaataattggtaaatgtgctaatgcctcagaatatatgtctcattcaaaatcagctagaataataggactgggttttaaaaaaaaaatcttaaaaggacctatgctggtgtgatggctcacacagtaatcctagcactgagaggctgaggcaggaggagagcttgagtccagcagttcaagaccagcctggacaacatagtaagatctcatctctgaaaaaaaaaaaaaattaaacaattagccaggtgtggtggcacacacttatagtcccagctacttgggaggctgagatgagaggatccctttagcccaggtgttcaaggttgcagtgagctataattgtgccactgcactccagcctgggcagcagagtgagatcctgtctctaaaagaaaaaaaaaagagaaaaaaggacctatgtgttcaagaattatatgtgatgttgacatgttcaaaattccttttgaaatatcctatagactgttctgttatatgatttatatatatccttaatgataagcaacttatacatgttgaaatcataatagcattgttggaaacttccaggagtgctttttagcaagtatgacaaatagtcaaaatgaataagatcatttcaaatatgaaaagaggtaacacaaaaataataagaccagtttatttttgtacttaatgaattggctattaacagctactcaagagtctgaggtaggtaggaggaggtaggaagacagcttgagaccaggagttagagtccagcctgggcaacataatgagaccccatctttcaagcaaataaataaaatattttaaaaaataaataaataaaattatcccatcccctttgatattctagttcaaaatttcaagtagtgatttttgcatataaatatgtatttttttatttataccattacagtacatgtattaatatagctttcttacttttatcattttgaaagaaacttatagatacaatgcattccttttgtacatccaaaaggacctggatagtgagaaagaagcagactgaattgagaggaattatatataaagtaataaaaggagcaaatttttaaaaatgtagatggttctgtcctaacaggattccctcctgctcttgtataacagaaccattcacattaaccactaaatatttagtacttaaggaagttgaggaagctcagaagggaagttgttctataaatttagaagactgactgacaggaaaattgtagagtgagctatgatgcgttcttgagtaaaattccatggagaatttccattctttattttgcttcattatttttatactgtctttcatatatacaaatgatgctcttggaattgtttttctcctggtgatactattgactcagcctcagtggagagaattcagtcctatgtctgcttaggtataaaaagcaaacgatgttttcagttctaaactagtttaataacacatttggcaagttctgtttcttcagatattagacatttattgagtgctcttttgtttcagtctcaaatgatatgatatttacatagcaggtaaattgagatgattctctgtcctaaatttatggggggtttttttatgcagaaaaaagtcacgttaaatggtttcttggacacgcttatgtcagatcctcccccgcagtgtctggtctggttgcctcttctgcatcgactagcaaatgtggaaaatggtgagtagttactaaggagcaaaggtgattttttaaattattgaaattaggccattagttctacagttagtaagcccaggctgttgttttagggaagcctatttagtggctcttagttttgtttagggtagaactaacccatctccctgttcgggaaggccttaaaggaccactgaaaaattaggactgtcagttccaaaaataaatctcatggtcttcttctcaattacaagtcaggtgtggttaaaagacttggcacgatagaaggcgaacttcaacaaggagtgtgacattattttgtatttgttttagatccgaatttctcatatttgcatacacggtactgattatttcttcccaggcactcagccagaaataggtgggagaaatgagaaaaaaaaatagatgatagcaccctgttaatctttagtcatatgttccagattgtgagctttcaatagttgtacttacgttaaagataagagtaaaataactttcgtatcatgtctttttttaaagcaagtatttctaggataaaaggaactactgttggcatatccagatttaaatatgaaataccatttggggcaaaatttacagaaaattaaacatggagcagttcagtgcctccatctaatctttaggtgttcctacttattgttcaatgtaactctgaaatttctccagacttgacgaggaaataatttagtctctatctcttactgagatttaacttaagtctctatatattactcaacttctgtgtatttctttaatatacattgcagctaaagttagcttaattttaaattatcattcagaatttttagcatctgcccttatttatctgttagttagaagttatgaatttatcctgtttttctcatggagaaaatttaaagaatgaatttattttatttttttgcaatcactaacaatcatagtttttttatgtttatccatatgcagaagcgaagagcaatcaaggtccatgttattatgcaaaatgagttcacgttactgtttacagttctagaactagtcattttccaatcataaagctataatttctttcgttctctctcagcatttcctgctgcaggagatcagtttcttaggcaccatcccagaacagttgtccctagattgaagtcccactctagtctttctcaagagccgggaagaaaggttatgacacttgtttagaagacaatgcgtccagagctagttatgtctttgtttttacactttgctttttatcttcatttattattattttcattgtttttcctgactggttaggccggagaatagctttaccaaaggcaagaattgttattgttgttttagtatctagctcatagcatgtagacaattacttggatttgatcacttaaatctaatattttactttgcttcaaatctagtattttgctttgcctgctttataattcaaatttcctaccaaagaaagttaaccgtctcttgaggcatttgaattatttagaactgttttcagataatttgcacatcttttttagggccctatacacctgcctcaggaaagaaaaaaaaatctgtttgtcagatgtaggcaacaccactcgttaagtaagccattagtcactctattttttaaaaaataacttaattatctcatccacaccagttttccattctctgcccatcttcctttcttttttcttcctctcattctccgtgtctctgatattcgctctcttcccactggacaatcagcattcaccccttgtgcttctgagtcttccagtgagctgtgctggtctcctggagacagagagcagtttggggtaaaggcaagtctgtttggctaatttaaattcttgtaatgtgagagatgggaatagaaagagcaaatggcattacagagatttttgttgttaaaaggacacctcttctccatcccatttcatttcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatgggtaaggcaaggtccaggcaatacttggagttggatgtgtgagtgttgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacagtaagttaaaatcttttccaagttttgttttgtggaaacggcttaaaaattattgttagttttatttttcttagattctggagttcttttaagtgcgtgactagaatattaaagaaacaagtatgagaggagagtgtggacttaataatactgttccattttacttttctgcagagggtggggaggggagattgtggttatattagcaaaccatcttttcatgaagagtgtgagtgaccaacctggcaaaggtggcatgtgagtgtctgtgtgatagatgtattctcaggagcatgtggtaccaggtctgtgggaggaaatgtgactccatgtgctcactgttcaaatggattatgatttactgatgtttatcttcgttaaactcaaagatcagttccagcaatgttgccctcgtgcatctcttcaaggattggtttttgtaaggtgtacagattggttcttgtgggatataccatcagcccttccagcacctcttggaatagttccgtcacaagaaaatccaacctatttatgagtttttctatattttaatatatttcaattcaacctttagtctttacttaaagaagtcttcagaatatacatcttaaatcaaaatgttcttcctaggaattattattgggaaccaatattcagtgtaaatatactagtacttcatcaccggtcagattctgaattcaagcaacagttcttcactaaggaagagtatactgagaacttgccaattccaatgcaactcctcactgttgtttatgtcatgctgaggacagatagatacattaacacggatcatgaactacaacttagtttagaagaaaggagctaaaactttctattttcttattgttagcatattaccagttttcaaacttctaccccatatcctaaaagatttgatgtttgaaaactaatcagatttagttgttttacataaatgctaaatctacataaggagcctctttcttaggggttgtagacctaacattatattccagggcactatctgtacaaagaaggatcagactccttgagaggacagaaggccctgtggtttgtggggcaaagagctgctgttgctgctgtcttaactgttctaagaattacatctcctaacaaaagccagagggatttcttgagcaatgctcttattacttagcttttaaaaaatgaggacaatagtcacttcattatattaccaattatggactctaggtataaaagaaagtgacaaaatttgaaatggtttcttatggaaaggaaaaacatggttaaggttttattattatgttggtgcaaaagcaattgcggtttttgccattactttcaaatggcaaaaaccgcaattgcttttgcaccaacctaatgtatgtggtaggctactttttataaaattttgactgtataacatcaggataaatttcccaacaatctaaacgaagaagaggcagcgtgattctctggaaataacctgaattttaaattctgaagactcagattgaagttccattttcacttctaactggatgtgttcagccacacctgaaacatctttcttgcacctggattcccgcaaaatcttccactcatcttcattccaagcctatttcctcacaaaccattttctgttcttaagtgagagcagtccttctagaatcaggtctgatgctgtcatgcctgtgatgtaaactcttcatggtctgcctctgtcctggggataaagagacagttcttaacaagccatataaagattttgatgatctgcctcctgctttcctccccagaagggctcccttcactgttgctgcttcctccattctcgaatgaccttcccagtctgctgagtttttgtcagaaggattcctgcaggcccattaagtcccagcgcaggtgccccatgcacaatgcctgcttccatttattgtagcatttgctgacactgagcagcaggaggcagcttgttcggaaactcttttccgagcattgagcaaacttccagactcagaatcagcactgaaaaaggatttcttccgtaaatgaatatctattatgaaaagcaaatcatttgataaaatattacataaatattagctgttgtcacttctgccttccttcttctttccagaaatcacctgctaagaagctgactaatgcattaagcaagtccctgagctgtgcttccagccgtgaacctttgcaccccatgttcccagatcagcctgagaagccactcaacttggctcacatcgtgtgagtatccctaccctcccagtatagagacaattttcttcaagggcacatgtctggagccacacaaaagcaatttcctatcagtggtcagcaaccaagatttttaatttagtttaaaaaaaaaagtcagagtaatgccatcataattttttgttgttgttgaggtgtacagtacttccaccaggctggacaagtaaagtatgcaacactaacataattcacctggaggtggaaaatatttcagaaagcttagttataaaatacggatgttagtggtgtctgcacattggaagttaacaatgggatcactgtggtaaaaaatgatttacagtatattattccttaatttcatatgtgctttgagttccaaatataaaagctgtttgttttatttctctgcagacccagtttaagatgccagcaaacctagaaattacttttgtttttcatcccaagctgtataactttagaagaatcatagcctgtgcaggggaaggttgaagagggggagtggcgggaaaatttatcagaatatccatagattcttttcttcaaagtatgtgtgagtttcgtggcagaaggtgttgggccaacaaacagtccttccagccatccctgctacctcccagaagtttcatgcctttgaacctctctcaggcctgggtggccaagataacaagggggcttaggtagaagaaacaattttttccttggtgttacctggggctcataagaagaaagagtctcattacctgcttctatgcacaattagatgtcatgtagtcacagatgcctccttatgaactgcctgtagttttccacacttcagtgggacctatcacaccatagggcctgtgtttgcatgttgacatcaagaggtgggtgacgggacctaccggtataggaattcaacaatgcaaagttcatgcttcaggcagttcagcatatgatccataaggggcactgtggtgggtatgagaccttcgtggaagcagcaactatgttctctgatggaccttagcaaataccaccaaacgatttgtgttgggtcacgtctgtgagctttgtataaatactttggggctttgttttgcttgttcccggggatgctctgaggcatctctgacctcagcagtatacacagcctggaggctcctgtttctcagcttacaagctggcatgggctcagcctccagaaactaatgtaaactaattctgtagaatgtggctagcttatttttggaaattatgtttctataaataagccttaaaataagccaggggtaaataaatctggggaatgtcccaaagggccaaccacttgcagaaatctacctcacagatgcttattaagaaccttattaagatctagactttccttcccataaccaattagacacaatcactaagttgctaatgaatgaccacagcgaagtgagagcagccagtgctccctgagctctgccgagagtaatttcctaccagccctgctgggagtttcaccccaagagagcagccttcaacagagctgctgggtgtcatgaagatagagggtgtgggtgtgaatagcctggctctaagagctttgctgcttcccactcctccaaagaattagaacgtgatgcactgcaacgtaaaagtccatttcacagtgagtcccactggagtattatctagctcagggcctgtacccagtgggtgctaggattgggtggtgtgtgtgtgtgtgtgcacgtgtgtgtctgcatgagagagagaaagagagggagaaagaagtatttaattggctgagtaataatttttacattttgacttacggggcaatataatctgttttgttatttattgaattaactgagggctatagcctcacaatgcgttcttagtttatgttccatggagagattttaaaattctgtacaaaatgtgtcttctgagaaaaacctctatgtattttaccagatcctcaagagtccttgaatcaaaatactgatctctactcactgataacatattttcccaggatgaaagttttaattttaaaatgcaaattgtacaagatatttaattgttgaaataacatacaagacattctggatgtagaatgttaagtctatattagaaaagaattttttttctatttttagccatagaaattttttccatatttgtttctttttcaaatgctattgtcatgagtagatatccatgtcttttttctgagatttctaattttaaaatgcattgctcatttaactattctaaattatcataggcacatcaaggccattgaaatgaaaaaataaatggtattaagccttaatcatttacaaagaagaatgctctcttaatctgctataatgaacatgtacatggaattaatgaatattcacacttcttccaaatgtatgtaaataagattttgataaattagacaaaaatatatgacattccataccatgtcattttataataagcccactacttttatacagtgctgtacaatggaaataagtgaaatttaagaaataaaacacaccaatactcccacctccacttaatgcgcttaatttattactcccaaatatgacttaaattataaaggtcttatgcagaaggaatattgtcatagtgcagaaatgtgtatagtaagacactttatcattgagtctctagcaaaaatcatcctaaaagtatgttccttagaactatacatagcaataaacatgttttctagctatagctctgtcttggtcatcctcattccctctctgatctttccccttgctttactaaataatttattaagcaatctttaattgtagtacaaaccacatctttgtcattctttggatgtagtgtcacaaaaatatcccagtccacatcagttacacccatagataagcttacagacagaggtaagaagggagcagtgagtggggtgcaagcattggcaatattgatgggcatcctctgtcctgtactgatgacctgaggttctggacattgggaattatagcacagactcaaaataaaacatttttttgccactgtgaaaaagtgtgttgattttgtaaattaatacaaattcttcaaagacatattcagaaaaaaattccatgatgtacatgtttaagtgaaggataactgtatgtccttacatagtgctgaaatatgtagaacattatagagctcatggatataaaatttgatgttgaacattatacagtcttcttaaatgcacatcttgctgtttaatgattgtgttaaaaattgctggccaggcacagtggctcacgcctgtaatcccagcacttggggaggctgaggcgggcggatcacgaggtcaggagatcgagaccatcctggttaacacgatgaaaccccgtctgtactaaaaatacaaaaaaaatagccgggcgtggtggtgggcgcctgtagtcccagctactcgggatgctgaggcaggagaatggcgtgaaccagggaggcggaggttgcagtgagccgagatcgcgccaccgcactccagcctaggcgacagagcaagacgccatctcaaaaaaaaaaaaaaattttttttactacatggcacatgtatacctacgtaacaaacctgcaggttctgcacatgtaccccagaacttaaagtaaaataaaaaaaatgctgttagtcctctaatatatattgcatccaaaggtgagcagcaaaagcattataagatacaaataaaattaagaaaataataagtggaaaatgctttatcaatacattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagtaaaaaaaaaaaaaaaaaaaattaaatcaataggatttttaaacaggttgcggtactaatacacacacatatacacacacatacatacatttgtatatggaaatgaagcatgtgacacacagaaaatgccattttttttttaactatagccaagggactttttttttctacccaccttgtagagaggtgctgccagtcatgaattagtccttaaatagaaatgagcaggtggtgacattttggtattttgacatttgttcttagctattgtattgcttgtaaatattaccatgattaacggtctctattctgttcaattcttcgctgccaaaagtgatacttggtaagtagtgcagtcatttccagtctacttacaaagatgtataatcatgatcataagtggggatgagacacaaaacaagtgagcaatatgaggctagtttagaactaagtcttcttatgctgtacactcagttcacaaggatgccacttatataaaaatgtcctctgtgaagatcttgtccagaaggccattgtgacttactctcttttgtggagctgtttcttttacataaaaccaaatatgttcaaaattcccagtgtgagccatttgttagataaggtaacttgccatttgattgtggaagaaataggaatttcagtccctctgaaaaccatcatttggtgccagagctagccattctttgtccaaagttcaacatttcagtggtagaccttaaacaaagccatttgctgagaaaccttgatttcagctttgtagtgaccagattcaatagaatacatttatcaagctagttaaaaagcattctaaatccacttgttttctcatttttagacagagcaagaaggaaaaatttttaaaaaaagacaaaatcagaagtgtggggtcaagtatttttttcaactctttgcaaagctacaatgaagatattatactctgttcactgttttaaaatctaacagaccaaacttttcataattcacagaggacatttgtataaaattagcatccttcttccaaagtgctagtgttcaactcaaggcagaattagttttaaactagccttgcgttgctcccttatatatcaaagatatgtcttagataagtaatgcaaaacactaagattgttttcagaacttcagttttgtctagagtagataagtagctgttgttttggcttcatccaacagatgacatgtcttacaaaatctcagagtatagtttagcaccagctaccttgaaaaaagttttgatgaatttgttattttttatttttttatttttatttttccataagttattggggtacaggtggcatttggttcatgagtaagttctttagtggtgatttgtgagattttggtgcacccatcactcgagcagtatacactgtaccatatttgtgatcttttatccctaaccccagagacttattctaagtctcaatgaatttttgcatgtagtattgacattttaaagcctgcagagcttcaggtccattccattcaatacattgggatatgcaagtctacctttttcccagaatgtcttcattgtagaatccaaagctgttctctaaggtaaaaattaaaccatttacaaatttggatcttaattatgccaatataaattgattctttaggctgctataattaatgtctcatcttcaaaacgttctatactgtcaaactcaaatatagaattatagtgaaactgaaatttcctctgattcagaaaatgctccacctcattttccatcttttgaactctaagtcccatctcatattaccattcattatcctatattgaacctaaaaaagggtaaaaatggcttggagatgagatagggatcttagccctatcattttacctgaactaaaacattcatgatggggaaagaatgacagaatgaaatgaaaatcagatgaaggaagacagactccatgcagttggtgtgtagaaccatgaacaattctgaggaaaattgaattctgttttccttctcttatcataagaaaacaagtgaagcttatgggatgctgtacaccacatactctatcatatggatcacccaaacaacagaaactaacttcatatatccttgtggagcttacttgcatcttcacttagaacaaaggcaaataaggtatgatatgattttacagcctgtgtcctttcagaccaggcatgttggagaggcccatcatcatggagaacacagaaggaacctttcaaagcctcaggaatcttcctctttccaagagaatatagattcaatgatcaggtcttcaaggcttcttgagaaggcagtagaagtaaagccactaccttcttcaaaatccttgcttcattccagaatattatacaatgaaacatcaaggctcaaagctcatgcatcagtattcacatggtgtctggagatcttcctcccagtgtttacctgagattatatattctcaaggaaatgtaactttaaaacacttaaggaatttaattggaaaatataagatttcttgttgatcctgggaaaggtagaacccagatcttcccatcccgtttcctggagggatgagggagagttttaaatttgtgacttttatttgttttaactttccattcaccctgtgttttgttttaggcctcccagacctgtaaccagcatgaacgacaccctgttctcccactctgttccctcctcaggaagtccttttattaccaggaggtaagttccaaccctattataaaataagccctttctttggtaatgagccttgattctgtggtaagaaaaatattctcatgcaagccaagggcagaatattgttactagaaactaacttgcaaatatccattataagttttcaatttcattcatttgtatgcatttaaagaggggtagggtggctttggggattaatgtcatgtctggaaacctgcatttataatttacccacagtaagaatgtgagggtatgtttcagttttactactgacacacatgcatcccatctcattaaggaagtcacgttcatagtcctcagagttgaagtcaaagaactggaatttcaggatgcaatggtgtgttactatataaatggtgaaatgtgtcattatttaaagctaagatacaaaagaatcctttgttggtgaaccctggagttcctgaggctagaggataaagaccaaacttggaaatgtagtttccatataagtaatttcacgataataataagaacttttttaaaaggtggatctgcatctcatttctttgcacaagatccattgccatgtgagcaagaaacaggagaagcaaatatttctctaagagttagcatcagacatatgcagggtcaagaggtgctctgagtcatttgatcaaatattgcaaatcaagcaccagataattattttataaatacatggagaaggctcacgggaaagcaaaaacaaaggtaaggaaaattggagtgagtaattgaacataagatttcaaatgcctttcagcagaaaaaaagtacagcctcatatttcacaaaatgcacataattcatcttttccctgaagaggtttataaggtgccagtttcactgtaatatcctggtacattcaactgaggatttgaagacaatgagactaagaacacagctgattttttttcctctgagttcctgtatgtgcccatcaacaggaacctgagatgaagatgttccccataattgtaattagcagaataaacagaatatggcagaaaatggggtttctgatgtataaacgaggtctgtaacaagtggaaataaggaaacagttatacagcagaacatccacagtaaaataatatggtttaggccctcagtaacttccttttagcactcttttttagaatcaccagcaaatgcaaccattttttttttctggaatgaaatcataaactgtaaaatctgtaaaagacacaggtctgtgcatctatctagggaagacctgatgtgatgtttagaaatatgtacttttattaggaagctctgcattctgcaaatatcaagcagaggtagaccccatccttactgaaggtcattttatatcatttcagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctctctgagtgggccttgctctgtccatgggaagttttaatgaggtctcattgtttgactccctcaggttacctgagggaataagtgcatccagccctgtggctgaagagcattccctcataaagctgtacgtaaatcagcttgatcacggtgcacggtcagtatcccagccctgaattgctaatcgtagtagtagttccatagctagactgataagtcattctactctggcactaaaatcctctcatagtacgtcttattggagatagaggtcttctggggtttaatgaaattgtgttgagacttttcaacttgagctggactttgcagctctttcctctcctttccacatattttatggatttcatagcctcataccggtatataagagatgtatatatgtgaaatgtatcaagctggatcttgtttggacaagtctctgcttttgtacaatttgcaaaaaacccagatggtaatttctaagactcttgaattaaggagtctgttggaaagatctttagcattaactaggtgaggctaggacaatgtcatgtagctggacctctttgcagttaaagacttgaggacttgtacctttctgtcctattggacctggtccattttccccccagggagggaagtctgattcctaatgaagtaacaatttcaaaaacagtttcttgctctctgtgcttattctctatcacttgataatgctggtggtgaatcacttttgttttcttaatcgtgtcgataaactaagatggatagaaatctatcatgccagatgtaggcaaaagttaaaggttctatacttctatcattgaaacagaaccaaagaaatatgacctatggctctgccctcacccctagcccatcccaacaatgaaataaaacctaagcaagccaagtatagtgccagtcagtatagggcagcaccgagaaagtagagaagttctccatattttatttagcctaagtttagtcttttgtatcatgacagatcctagaaagataaagctgaatgaggctgaattgaaatccccactccagaatcctcaccacaaactcctggcattattcacctagggcccttcacaagcataccactttgatcttcaaaagacacagggatataactttgaagtcttttgacatcctagtaatctacttcacacagatttatgagtgtgtacctctggttaccagcatcatctgtcgcattccctgttcttacatcttttctagctctgtacttgattcacttttcccttacttaaaagaaaaaaaaagcgattctcaaaggcactctcccttggtccttcgaagtcttcttacatgtgtgtatgtctatgtgtgtgtgcacgtgtgcacatgtgtacattcagtgttggtcagaagttaggtagaatgtgggtcatataacataattgatggaccgattcacttcattcattttcttgattgtaaactgtatccctaatctattttgttttcttataaatttatgggaaagaatggctgatttgatggaaatctattatcaccactggggaaagagctctaagagctatgtatggtgagccagcaacattatctaagcttatgaaagttagtgtattattattattattgcagatattattgcaaggactgaccacaaagccaggtcccaaaggctctttctccccttcactgcccacagctctgtgcctcttaggatctgctatcttctttggcatcatgcctcctttttaaaatcttaattatcttgccataatcattacttagtttacatgagaaagttaaccaatactttttaatgtcaagtaagcttctttcactatggtcaagcttcttcattagtcagagtaaagactaatgaaaaaattagtcacacttcttttacctccaattttagaaacatcatttaaaggtttcacaggtattttcatagttgcaacctctaaagtggtaagcactcacaaaaggaatcaccttgactattctatataacatctagccaggtcttatcactccaccaaatattaggaaattgcttacaattcatatagcatgttgaacacaatctaatgtgctagtttctggtttgctgcaataacaagtagttaattaatcatattgtattagatggccgggcaaggtggctcacgcctgtaatcccagcaatttgggaggctgaggtgagcagatcacctgaggtcaggagtttgagaccagcctggccaatgtggtgaaactccatctctactaaaaatacaaaagttggccaggcacagtggcgggtgcctgtaatcccagctactcaggaggctgaggcaggagaataacttgaacctaggaggcagaggttgtggtgagccgagatcgtgccattgcactccagccgggacaacaagggtgaaaatccatctcaaaaaaataaaaaatgatactgtattaggctctgtagttcctatagggagagtgcacccaccccagatacttcccaaatcctgatccctccaagaggagcagaaattgtgagttattttttgggttgacttgttggtcaggtgattgataggtttgggttttcaaccaaagaaatgctaattcactgtgcctttttcatttttaaaaaatatttttgcttacccaaagattctttacttaacaaccgtggcttttaatctgactcaaaaagttcaagctaaattttaaatagttgtgatttgatcatcaaaagtagctaaaaataaattttggatactgattgtagcctctccttttgaaaatcaaagttttcttcatagctaattttttctaagattaatgcccatccattttcagtcataaaatagataaatttgtaaatcaacatctggcaccaccctgaagatttctcattcttttcaaactttctgggcatgttgtatgaaattttatgaagttgaaataatcactctctgcagataattctttacttcatgtagtcccagagctctactaatatgttagatctttccaaactggaattacaccagtctacacatcaaccctaataattttctatactatgcatcattaaaaccacagtcacctctcttgttcagttcagtaacctttactctcctactagagttgctttggctgttgtctctgcatgccctataccaagcaaactttcctagaggctctcctgacaaaagtgcaattgctgtgacttgatgatacctgggtacaatgtagtaaattaaatatgacctaagaattcttattttttccatggtacctgtttgagatggttgaacttctatgccagcctgaattgatgacagctaattttcccactgagacactaacctattttttaatactggtctatgaattttcaggtaatacatattttatatttcagatgtaagctattgaaatctagaaaaaaagaaacaatgtttcaagacattacttcttgacaaaacagatttctggatttttttattatatttaagttagtgtgatggcctcattactagactataattctagtgagaaggaaaattttatacactatagatagttacttaaggaggcagccaactttataagtcattcttcacaaatccaaatgtcatacaagcttattaataatttaagaatcaatagaaatgaaaatatctgttcttaatttgctatatttcaaatattgtttttcttttaaccattgcgataattattctatattaatataatttgtttctataatatttgttctctgtgagactgcagccaggcctttaatatcatgttcaataaaagaaaaaataatctttgtcaagggctaatatagtaactcaacattagcagaagtggtttttaaaaatatatttcaggtatccaggaagcatctgtgtgtgattttgttacctttggacccaccccctaaatattttcactgaagtaaaattattggcatcagtcgtcacccttcaaagctaaggggataatttttttaataagtatgaaacattttgagattgttctacttttccagaacccattgtgtcactgtgtgtgtgtgtgtgtgtgtgtgtgtgtgtgagaaaaattttggaaggttatttatctctagatatgctgctttccaaaggtctaaaaaggaagtggtgagaagccagaggatttttgttagaaaaacaaagtctgaaggaatatttcctgccttttttctttcagcagatatatgaacttcaaaatttaccatgccatgccctcaaaggtatggctgttcccacaaccatcagtgataatatgtatgtgaaaggatgtgctcatacagtggcaagggattagtgaaaagaaaaagatggcgataagaaaaagagatttgtgtgcacatgattttagaaatgatagtcttgcttctctttgaaactcagattagaaaaggtgtatcccatggtcaagttgaatgccaaatagttctcagtttcggagcttaaaaggaagaatgcattctgatttgaagacaaggcatgtagaacagaagcagctttaatgaagctcagtctgggttgtatgaaagccattgtcacattctgacacaatgatatgctggaagcactctttccttagtcaggaagtaggttccattgtacctgatcccaaatcccacaaagaattagaaacttaatttctccatgcaaacttccaagctacaaaatcaaagtttagaatctaaattagtccataaaatattgtgataatatagcaccttgaagggatcataataagccacacatcattactgttttagtccctttatgttgctgtaaaggaatgccagaggctgggtaactgataaagaaaagaggttgaggctgggcacggtggctcacgcttgtaattccagcactttgggaggcgacggcaggtagatcgcctgaggtcaggagtttgagaccagcctggccaacatggtgaaaccctgtctctattaaaaatacaaaaaaaaaaaattagctgggtgtggtggtgggtgcctgtaatcccagctactcaggaggctgagacagaagaatcgcttgaacccaggaggcggaggttgcagtgagccaagatcgcaccattgcactccagcctgggcaacaagagtgaaactccgtctcaaaaaaaaaaaagaggtttatttggctcatggttctgcaggctgtacgtgaagcatggcatcagcatctgcttctggtgagacttcaggctgcttccacttatgacagaaggcaaagggaagctggtttgtgccaagatcacatgaggagagaggaagcaagccacagacaagaggtgccaggctacttttaacaaccagccctcaagggaactaatagagtgagacctcactcattgctgtgagaatggcaccaagccattcatgagggatctacccccataacccaaacacctcccattaggacctatttccaacattgaggatcaaatttcaacatgaagtttggaggggtcaaatattcaaaccatagcaatcactattttcacagcaactcaagagaaaaaatttcactttgctgcctctcttcaagcttggaagctggagaagaggttctggtggaaagtacttcaagtgaaaagactttaaagacacaagttttaagtgaaacctgtctcccagtcaactctcgaggttcttgattcatttcattttgaaagagtggctatttttgtcttgttttcatcatgcatttggcctcctctgtacatagtcatatttttggcttcctggaaacagatgatgagaagaagaatttgaggctagctctagaaattacagaaactatgtgaacagtgagtatcaaaaagttagaagtgcttctggcactagaaattaagagctatagcaaaacaaaatagtttatttccagaaactcatgtatgttcacggtgtaactcccatattttccaagaattattttttctaagaattcacatgggaaaggaacggaagataaaaggttttaaactatttctttaaaccaacactggcaagggccaacacaaagaaaatgacaacaaaagttaagagatgtatatatatagaatatgtctcattcctttgagggaagaagggacctggttagaagaaggaagaaaaggaagaggagaggagaggagagacaggcaagtggagtagaggaaggaggagaggagcccaaagatttgaagaaaaaaaaaaggagaaggccaccaaaggaaagtccggcctatcgcccccttctctcagccctacctgtacacagtactgaggctagggctcctccatgcttgggctttgtcagtgatgggtggtggagccacatttctgggccttcactgacacatcttcctcccatagaagttcaccagaataatttgtggcaaacacatctttgtggttgacgttcctgtgtttcttttctctactgattcttgcttgttatcttgcatgttcagcatgagaggttgtccctgtgcaattattcggctgtttgcttaagaaattattgccacaatttctgagattcaaagaacaaagaagcataagaaggcagggagatactttagtttggagggaagaatcatggatgtttcacacagtgttttgaatggttttgcaagcatctgaaataaattatgtaatagattcatctatctttagttacaaaaaagaattggggggatattgggcagcaggggtactgtaggtactgcataatgaatgtatggagatctgcttcagtagacaaagtctggaatgcagttttggtggggtaactgtacatcacagaaaacagaaacagttttggtggtataatggtacatcagaaaatgatggctgaaggtggttatttggccctgatgggcaggtttcacagttttaaaaggaaaacatcaatatgctggaaaaagaaagttattgaggtcatcaggaaagtaaattatcctaaaacacaatctaatttatttttaaagtcaattttgggccgagcacggtggctcacacctgtaattccagcactttgggaggccgaggggggcagatcacttgaggtcgggagttcgagaccagccaacatggtgaaaccccatctctactaaaaattcaaaaattagccaggtgtggtggcgcatgcctgtaatcccaactactcgggaggctgaggcaggagaatcacttgaaccttgaaggcagaggttgcagtgagccaagatctcaccactgcactccagcctgtgcaacagagcgagactctgtctcaaaaaaaaaaaaaaaaaaaaaggtcaattttgttgggtacagttgaactttttaagtacagcaatactttatataacagatgcctttctgaagagctgagtgaaaatgtcattcatctgacaaacatgcatgtctactctttgctagtcattttctttacaaatcaaatttaatattaaatttatcagatacctcactattcaaggaatcttttaatatacactattataaagcaagaattccaactataatgtgcatagttctaatgtgttatgtataaatttatattttttagtacttcatggcctgaaagaatggtgctttatagtagagccctaaaacttgtagtacaaagtttttaagattttaactaatttataaaccattatatatatatttagtagatttagagtttcttgaaaatttttggtggaacctcataatttagatcccaatagttaaatatttggtattcaaacaaagacagacaatttatttttctattttccatgaagaaggagagggacaattttagattcaccagtgtgcaggacaaattcttacttaacctatagaggagcaaactttcttcaaacacattaccaatacaattgtaatactaagaatcaataccatagttctcgatgtagcatgactacaaattgtcacagtagattttggatgactttaccatagccacacttaatgaattattatttatatttctatttgtactttaataaaactatattttaaactttaaaattgtcatttaaattactaaagaaaatgagtagttcccataatgaatccataatgttaagaatttgctttagcaatgagactatattcactagctttgtattaatataaacataagaaataacaatatatatgtataagactcaaaggtgtatttctctgttcctctgaaaattttctttgtagctccacagccaagatcatgtggcttttgcttggagtagtaaaacacttctaatatgaagcaatctctagctaggtaattttcaagtctttctatccagaacagaaagttggaggatgtagggaaggctaagttcttgagtgggatctaaaggctggcaggacttagtgaactattggactgtttacatgatatgccatgataaatgttgaatgaattttcattatgtctagacatactcaatataaatgcttgcttgttaagcaaatagcagaggtcaaatctgggatcatggtgattgcgattgtggttctcaggctgggtttctattcctacttgaagtctgtggaaatctgaaaacatcttgaacatttcaaaataataagagatctgtctaaatgaaacttggatctagacttgggagtgtctgttgccagtttctattcttgaatgcattgccgtgtttacgctcttcttggctttcccatcttattaactagctctcctcccaaggacagtgaagtagagcagaacaaactgctggctagggctgctccagcttttctgaagggcaaagggtaagttacagccagagtgtactggaaccctgcattaactaaactaaaaatggagatttcttttgtcaaaaatgctttgtgtgtgaaagactgtctttgattcagtaaaagcagctctgctttaacccagttaacagcactaagtagttatttccagtagacacatctgtgttgttattcactttcccgaatttgtgtccttttcttttttgaaatgactaagctgaagactcgattttctgaaggatatttaatctttgcttgcaaccaatttcaatgtatttactctacagatgaataccttggccttagtggttgaaaaatgtaaatctgttttctaaaactttatttaacctaaatggaagtctttatttttaaagttagtgaaatcgaattgtggatttcattgcctggatttcacttgtgtttttcatagcacatcacttactacccttcctttacctgcttggttttctaaatgccttttctaccaaaaactcactcctacctcctctacttatttctgtccacctctcttaacaacacgctttctttccccctgccctgtttcaggatacagtacagcctgaatgtggcagacaggctagctgatgaacatgttctcatcgggttgtatgtcaacatgctccggaacaacccctcatggttagtgcaggtttggctgcttgactgtccttagagagggatacagtctgagctggtgacaagcagtctcagcaaggagcaaggtcactggatgccagtggtgacactgaagcactgttaactggttcagttaagaagtctctcgtgatgttagtttggatacttcccatgaaggaaccataggattcatatccttgtttatatattagctaaaacgaaaacttgcataaagggatgccttgctaaatattagccttcaggtagattcaggactccgggtcccaccaatcagttctgtgctacgtgtcatgtcaaattaccacaggatggtgataaaagaatttgtcttattccaaggacatggatgtctctgctgatttggaaaacaatgcctcattttacttaagagtgaaaaagagaaaatgcgatgtgattgaatcacaaaatggaaatcatttctttaacaatgataacagtgggaacaatcgtctttcagcaattctattacacatttttctgatgaccatcctgctaaagcctgctttcacatcttggaatacacaaaacttagtttcagatatgttaaattcaggaattaagatagccctgtgtacttggataaagccattcaaaaggcttttctccattttcattgtgacataggagactccttccattggttaaagttacttgatattaataataaatgtggatttgcagcttgaattaaaggaaaaggacaaactatgtatcatatgtatttttcaatctagttcagactattgttttataaacatatttagcaaaccaattccttgaaaatatgtcaatttttctcaaccacttcaattttctctcaattaagggcccatggattttccatagttacaattattaagaaagccaatgggttcaatttccattaaaatgtttcaaacctttagcatggcaagtcctctttcctctactattagaggaaaagtaattggcaaaattaatggcaattacattaaaagtgatgacaaaaactgcaattacttttgcaccaacctagtatttcaccaaggcattcctcagatgctaggccattgctccatgctccttgccctcaccacttgatgttattagccgctttgtttctgaacctctttcctcctcacttgagtattttcaaaattttcttcctattactgcttcttagatctatttttgcaagattaatacatgagataatttttagttctcatgaactgatgaacatttatgtgctttagtacatacatgtatcttaatttgtatttttaaaaatgtataaccagtacactagtttaattttaccttagatcctactgtttaaggggataaaaatgcactctttggctgacgtaaatccatctctttcttcaaattttgtgagcttctagattaaatagtatccactttttcacaactcaggctctcaaaactacaaaattgctttattcccaaggagtttggtactccagtgttacatggtagctgaagcagtagaactaagcattgaatttttttttaattgtattggtcatctttgaagaagaatacagtcagtgtagattcaattgtaagactatgatgcgatctcacatcatgtcctcttcccataattctaagcacactccagttatttctactgctcttctttgaccttttcttaattaaggttgttaacaaagaaatctccaaagagaaaagctcagagtttgtcactaccagccattttccctactcaagtgattaatcatattgacttgatggttacttaagaccataaatctgtctcagcagagacaccttgcgtctgcctgatgaaagctaaatgtgatttgtattttgaaaacaaagcagaatttaaggccaaccaatcaatgaaggaggctttgttttaatagctgcaccctccatatttctcatagttttttctatccttaaaaaattccaacttctttttcaaatttctcattttttcttcccttttctttatgtttaattagatcccaacaattcctcatacctgtcatggttctataagtaatgtaatgacctcttacctcctttaacatcattgtagctacaatgctttaccatcattaagttacagtgagacatataataatagtaataataatagtaagtgtttttaaaacacttacctcatgccaagctctatgttcagagccttgtatacataatttctcctagtccttaaagtaagcccatggagtaaataagatcatcccccttttatagacaagtaaaggtatcattttagagagcttacctgactctcccttagtcccacagctataaaaagtggggcagagattttaaccattatccatccaagttcataaccactgtgtttcatcacctcttttaaaatctgcatcaacacacgcctttcaggatcttttgtggatgcctccttcacactgcatcctccacgtatttactgaaactgtatatcttattctagtgtttttatttgattttagcaaatattttgagcacatactagtaacaggaatggtgattcttaacaagttaccttttatgtatgtagttccttgagttgtgacttctcatgttaattgtaagcttcaaaaagggcaagagttttgtcttcagtctcttttatcttattacaacagctggagtaagaataataaattttgtatttatgaaatgctccaaaaattacaaagcctttttccacacattatttaatttacttctcatagtcctagaaggttggatatgattatttccatttcactgtttaaaaaatatgagctttgagacattaagtgacttatccaaagtcacatgctagtaagggcttgcaaacaggtcttatgacactggttcccatctattttccaccccattccttggcctctagctgttctccatcaaaagctttgtttttgccattattcagacctaatcctgattaactctgtgtgggggtcttctaccctatattaactacttaacacactgggaaactgacttatttgtaatagtttgctgctaaagaaacacttatgtcattgctggttctgtcagataagtcaaataaataaactgcagctcaagggagaatttctgcttccttcctaattcaatgaagttttaaaagccttaataatttgtatgcaccttcctcattgcaggagaaggagtctgaaatgtgatacagtgtgggcttttactaccctcccccaaagcttgtcaaattcctgggcttgctagtttataccaaggtctgtagtagaccaaccaaatgatttgaaaccagcccagaacttctacctctaacattgtcacttgattagactcctgatgtcatatgactaggttaaaattgttctgcttatatttttctcaagtacaagaaagtgtacatttgtgttgtcaatagatttcttgttaagtggattaataatccatctagtttaaaattgctccacaatattttatgctttgggaaaaaagacatctaagaatgcctatttcagaatttcatttatgaggtctaaatttttattagcttgcatgcttagaactctttaatagattcctattggacctagtttacaacccagacccctcaccatggtgtacaaacctgcatgtgacttagcccttgcctactcctttctcagcctcagatctcatggggttctcccattcaatcactacatttagtcatgtcaatttttgatcaattcctccaacgaaccaagctctttcctgcctcaagactccaatactagttctcccctctgtctagaacattctttcccatttcacccctactatatgcacatgaacttgcttgtctagcttccaatcttagattaaagacacctcccccagtaggtcctctatattagtctctattatagcatactatttttattttcttcttatcagctgcagtcattgtttggttggttagttggttagctgtttggctggttagctcattggttggttggttggctgactggttagttggttggttggtggctggttggttggcttactatttactgtatcttcagtggggcagggaccctctccaacttgttcaccaccttatctctgacatctagcacagtgccaggcacatagtaggtgctcaataaacatctgttgatattgtagaatatcagtagtgcagtagctaaaaaaattccatcttcccctaaacaaagttgttaggagtagtcagaaactttactagcaaaattagaatttttactatttaaaaaaatcactattatagagtagcacttaaattgaacatttagtataggagtataaaatagatgaaaaattaaagtattaagctttgtgtagtggtagacatgggcaaagataagcaccagcaattcactgatgtgaacagagcaactaatagggcattctaaaatttttttaaaaacttaaagtgataattgggcaagaatttttttttaattttaatgcccccctagattcttcatctttgtattagtttgctaagaatgccaaagcaaaatgccatagacttgatggcttgaacaacagaaatttattttctcactgttctggaggctggaagtccaagactaaggtgccagcagggttggtttctcctgtccttgacttgcagatggacaccttcctgctgtgtccgcaaataaccttttttctctaccctagtgtctcttcctttccttaaaagaacagcagtcctatgagattagggccccacactatgacctcatttaactgtaattaaaggccctatctccaaatatagtcacattctaaggtactgagggtattcatatgctttagcatatgaatactgggggagacacaattgaatccataacccacttccccactgaatccactgaattgtatgcctttaatatttttaatgtgtaggtcaagatttgactgactctttttagtacattttgttgattttgaaaaatgtgagtttattgcaatctgttgaaagaaaaaagaaattataatctgttgaaagaaaaaagaagagttacctacacttactgacagtgtctcttttatatgagttttcatttcctgttaacacgactccttttgtttagtaaaatttttaggaacttcaattatagaactggacttctgagaaagatatttccttagaatcctggaaatataaatctaaagactgtcacatcaggaacagttggagtagaaggaaatggaggagtctgagagtttttagaagatagaatgcatgacctcaactgtaacatagggggttgttgaagtcagggtctcaataaaggagtttaaaggtctcctttaaggaagccattattgtggtaaattcttattgttatccatgaagattgccatttcatgatttcctgtctttttttgttgttattccaaaccactcacaaagggccactacactaagctttgagagttagtttctttccccattcttcagtactgtaaaaccatttctcggtccccagtgtcactttgttcctttctaccctgactctcttgagctcactgacttctaaatgccaaaaaaaagtgctctattcccttagcattttgctctaaaccaactgccaaagatagagaataatctaataaagcaatcttccatttgagttaactaatcctcttaatagaagagtagtacatgaaactcgatggccttctaaattaatttctagtgataaaattcccatcactagccagagtagtagaaaaaatatgaaaagaaaatatagaagcatttatatatgcttttgcttttgcatttatatatgctatatgctttggatcacagtattttctggttgactaccctaacttagaaagcagaacaggcccagaaaaaaatcaaaagaatgtgaacaaaccgtgagttcccaaaaatctttgctaaatcacactttcataagccctagctcagctggggccacttgagtttcctggaatgccattttgaaatcactggcaacagacactggccatgcatttcgggtagaatgtggagggctttcaaaataatggattttcctgctctgaaatgccgtcaacactgcaatcacttgttaattcatcatagtcttgtagcaagattactgattataaagtcctgaaatgaatagctagggctggagaaagtgttggaattggtatttattttaatgatttagggattgttgatcattcattttcaactatttgtaattgaagtcttgaaatagaggaatttatcagaagaatgcctccttcacccttgtataatttgaacatactgaaatggcattatgtggacccataaattgttcatgtgcacaaaggggtaatattatcacacaggccctcattcactcagtgctgggggaggaaaggcatggacgtatgagttatcacttgctatacagaatcctatatcttcacgtcttacatttccaggaggctttttaaaaatataaccttcatattacttacactagctagtcattcattttaaaagatacttttatcagaagtttttatcaagatttttaaaattatttatttatttatcaaaatacaaatgtttctgacaaagtcactttcaaggtgtcaaagatatcatgttcctgggcctggagcaatggggttatccgcaaaacactgtgttgaattagatgtatagcccctaatacatgagccagaaatgataaacatgttaaaatcaaattcagttgtctctttgtggggtagtttgacgtcgaaagaaaagacagtgtaactttctctttttcattgaagctgtaataaagaatttagttattatttttaaccattgcagaatgcagacattattttataaagacagacatctgctttaaagcatcagttttccagagataattctgcctttgctattaaaattattttcttactccaaatctaaacttgtgtaatgaataaaatctcaatccactgggattgatactaaacattatgtaagccgtatatcctacaattttctgtcttaagggaatgtttataacatatcacacatgctgtatgggtatctgttaaatactcttgaacaactctctcttttatatcgtttatatttaggtttcatttcacgtatttgtgtcttccattttgttttcgagatcttctagatccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctaggtgatatgcttacactttaaaatttgaaaagcactgctctagataattgtcagatggtagatgatattttgaaggggatgaggattactaatggatatgaacatgttatttaaaaggcaaaataataataacattatattaactaatatttttgagcacctcatgtgttccaggcatcacactcttttgatgctttttgcatacattatctcatttgagcaaaaggaaagagaagcctctttttctgaggagggagaaatcagttgttagataaggaaattcaggaatgttctagttatttattatagctcagagaaaagggctaagtctagagtggaagtattcatattaaaacagctatagcttatatatgcaaggggtgtaggctagagcagagataatgtagacaggaatgtcttatgaatgaccagaaaaaaaaaacaaacctgttatatagtggattcagctaaccagacaagagctatttggaagtgacatagccaaaatgctggaagaacataattactttcactcatcttctcacttcagaacaaaggttaaaacactatgtttcatgtttactctatttgtaaatgtacatataatagtatgttactttatatggatccaagtgattgcaatgaataattcttacaaccttaatattggcataagagggtgtctttacaatatgtatttatgagttaatttctttaaggaagagccgtaagtataagaactgatgcagaagaatataagtatgtttatgaatgagaggaactagtttctgatcttgattctgaactgatacataccacaataaccaataagccaaactacaaccaactagtttgttaacaagattagtgctattggtatgtttcatagaattatttttaatggcacccaaaacttagtcttgaatggagcacttcacagaatgaagttttctgaaatatggaagaattagtaacgcttctatttgcattagtttttagggactcagatcatccttattctagtatgaacagtttctgtaaatttataggaggcactaaaaaattccattaaggtcattgggagtcactactaaaattctgtttctctgaaagtaaatataaaaggcaggttataaataagtagtaatattatagatgagacttgtattagttaccttatgctgcataacaaattatcccaaaagttagtagcttaaaataacaaacatttatcatctcagaatttctgtaggttgagaatccaggtttggcttagctaagtccctctggttcaaggcttctgtgaggttgcaatcaagatgtcacttaaggctgtgatctcatctgaaggctctaccagtggggatccattcacatggtaattggcttgcttgggtttctcatcacctaggtctttccataaaggctgctttatgacctgacagctattttcccaccaaacagaccaagagagctaaagagaaaacaagcaagtccaagatggaagccatggtctttttataatctcatcttggaagtgacattccattccttctgccatatgctattcattagaagcagattagtaagtctagcccatcctaaaggggaggaaattacatgagaatgtaataccagcaggtagggatcactggacattgaccacaatgatgtttttctttcttcttgctttcctattttctaacatgtcaattttggacatgtgttacttgtgtaaaaaggaaagaaaaaatgttaaaggcaataaaagtaagagaaattcttctgatcagatgtattgatcagaatagtcacctctctgtgaggctttcttagtaagacaattgaattgactgaagacaggatttattaatgaccttcccgactatatattagatcatgttacaaattcaagtctgagattgttattctaacagggttttgtgtagtttgcaaatcttttgcaccaaaacattgaaatagtaaaaactccttgtggtaaaatgactgcagcaatctttctcagttgcctaacggtctccttcttgctttgttcttaatagcatgcttgagagttcaaaccggcttgatgaagaacacaggctaattgccaggtatgcggcaaggctggcagcagagtcctcttcgtctgtaagtagttggagtaaaaggattcgtctgttggcatctgggatccttgaattttatatgtcatgtttattgttattatagctggtgctgattaccaggacaatttgtgctaatttattgtgcatgtgtttgttgctaagtttgtggtgtcttggtggtgaatttacagtttaaaaatggaagacttgaggaacaaaaccatccacagtagtgtgaccctggagtcaagctggaatcctcgcatcccccttcattcagtgtcaaccccatatgaagtcccaaggaagggggcaaggactggttgtgattcctttatttaaagcaggtgtggttagtgaaggcactaagtttaaggcagagtagttgcaagtgacacttaaaatataccagtagaaataatagagctatagctttctccatttgtgtcagtctctaagacaaaagcaactgtcagctcaacacattgattcagaattcatctgtgctgactaagggtgagttgctattagtgcgtcacaaaggacaaagagtggcaggggagcaagtgaggaagctgttgcctgcacctctcacatcagatgttgcagttatcagagcccttcatgctgagcatttaacctaatgatcccagatgggagctgcataatgaccgactgcattagccctggcagttgctctctgtgacatccgtgactgtaacactgttagaaactaccatgagcaagatggaggggatccaggacaggctaaaagtgtactgtgtgcccccaaaatcagacatgataaaacagagacgtaattggagtatatgaaattttaagggccataagtaaggagcaaacatgttaaagaaaattaaaatatagaatcagctgagaatacaggagaattagattttaggacaagcaaccactccaggagtcacttgaaagtaaaggcaaaacaaggtttttggaaaaacctcttttccaagttttcttgcctttatccatgcatatacttctataaacagaggctatggtataccaagatatgggattagcaatgtgtgtcccagctctccatgacctcatgcaaagcagtgcttctttgagttcagtctcctcatctgtacacaggtgtaaatatgcttattatatatgtcagtgctgcctgttattagcatccactgagatagtaaaatgtgtgaaagtactgcataaaccagcaattacaaaatggcagcctgcagaccaaatttgtcccccagaaatgttttgttgagccccacagtgttttcaattctttattagatgtcaggacttacaaatcagatggttttccttgaaagtctggattttcatcttatcttaaaagactgaccagatcagatgcatgttccttctgacagcaggcagctggagtggaggcattactctgctgcttcggacagggcaagtgtgtggcactttgccacaacccctaccctggcccacctccgtcacttgagttacttccctgcccctttcagcatttgcattagtgatccctggcagactgctaaatctccatgcacatgttattatttatatgtgtactaaattctccagtcttgttccatttctttctggagaacattagtaacttgtgttccttgcctacttacactatatataatctttgtggatccatcataggaaagataccgtccacacattaattctagttcctttgtaaatctcttcataaccacatattaagaatagtatgattagctgagtaaatcatgattagtaagatgacacttggttagaaaggagatagaacggtcatttagtaaatgggtcaatgtttttctttataattcctgatcaattaatatacatagcaaagcaatgactgaaattcacaactggctcagataagtttctaccatttatcaatacataaagtatatgccagaaaaggaaacttatgtaatgaaatcagaagaaaatcttgaatcacaagtcaaagttgccatatgccagaattagctaccgaaagtcatttagaatctaaaatgtaggacctcaaaatttcttgttagctatataagtcattctttgctgaaaagaggtgtaaattaaaatgcatagacagctttataaaagcaaaacctttacaaaacttaatctttcctacagttaggtttatggacattaaaaagcaggacaagattctctgcatctggcttaggcaacagttgccatttttaaaagctttccattcttcggtagaaagatgagttgtgatttttaaaaatttgtttttaaaacaataaaaattggtgtggaggaatttctaaaatgtactgtaaggcaaagaaagcaagacatacataagtgtacataatatgaccccatttttgtaaaacaacaccaaataaatccttgactaaatatacataaacatacacaaacagatatatatatatggcatatgattaatgatatctatgtttatatgagaatggagaaagctgtgactgcatgtataccagtcgttaaagctgattgcatttctgaaaatgaggagctggagtggtgagaaagtagaaggaaatcaaagaatatacatgaatatgtgaattcatcaatctaaaattacatgtgtgaataaagaaagacataaaagtttgttgattagaagaatcagaaaagtaagtcttaccaactatgactttaaaactatatttttatttatttatttatttttgtgagatggaatctcgctctgtcacccaggctggaatgcagtggcatgacctcagctcactgcaacctccacctcgggctcaagcaattctcctgcctcagcccccctagtagctggtattacaggtgtgtgccaccaggcccaactaatttttgaatttttagtagagatgggatttccccatgttggccagactggtctcaaactcctgaccacaagtgatccgcccgcctcagcctcccaaagtgctgggattacaggcgtgagccaccatgcctggcctaaaactatatttttaattgtacattacagtaattgaacggtaactctagagaaagcaccctctcaacagtgcaacatcttttaaagccacctataatgaaagaataggtacaatggggacagtgtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatatcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattcaacacagattgactcacagtctacctccacagcatacaccccaaaaattgtccagctcatctccaccaccacccagttcagcctgtccttttcaaaaacatcaatcttatgttattccaggtttaaaccctctaatgtgttcccatcacacttcagttaaatcctactcctcttaccatcacctgcaaggtcttacctgacctgattccctcctgccattccagcctcagctcaccttgctcagcacactcccacctcccatgtgttcctcctgtctacagcctttgaattagtcattccctcagcctagaaagctcttcctccaggtctctgtgtggatggctccttctcatcactggggtctcagctcaaatatcatctcctaaaagaccacctgtctgatcctacctaattgcccctagcccagaaactagtctcaattacatacccctgtgtgtgtgttgggggcaggaggttgtcacttatcactatctgaaataatcatgtgtgtttgtttcttcgtttattgtctgtcttcctggactgaaacggaagttctttgagaacagaggccatggctaaatggtccctggagcccagaaccaggcctggcaattgtagaagctcagtagatatacattgagtgagaaaacgatgaatagctgagttaaatctcaaacttggttctgaggaaacccaacatggaacaacttgtactaggtcggtgcaaatgtaattgtggtttttgccattatttttaattacttttaatggcaaaaaaacgcaattacgtttgcaccaacctaacacattctagtaatatatttcttgaaacagcaccaaaacatttccatgcttaaccccattcttaaacactgatgtgacatttgaggtcaaactggaggagtaaaggaggaggttgtgataattatttcatgcctgtaaaatttgacctgagaatttggggataaatgatcaaagtattctttaaagttctcaagaaagaataaaaaggagggtgcaaactctggttggcactttttcatatttttttctagtaaggaaagcttttggcttagttgtcttgagacctggctgccatcattaggaaaccacaaattaggatagaaatagcttcataaatgtgacaccatgactccatcgcctttgaaactactgctctactctgacccccagggagatgtgctcacatcagagctggaataaaaaaatttaaaaataaaattaaaaaaaagtttgtcacatgtgatccctgtcaatgtagcaaataataggaggaaagaattaagaagggaaagagcagatgcatagtgacgaattataaaaaaaaatagccatacaaattggaatttgttcaggatactcacaagtctgtaaaattacctattctattttatgtatcatttattatatctactacgtgcaagtaattgtgccaagtcagaaaaaagcattgagagtgggagccaagtcttcaaatgagcaaaggcactttaaaaaggtaggagaaacaacccaaaaaaaggaaaagggtagttgggggatgcaagtaaaagtggggacaggcaggcattggagaaagtgtatgagctgagctagcaggcagagggctcgaagcaaacaatgtaaaagaaccattggactttgtggttcgtggaatgcttgtgtgagtattgatgacactgatgacaatggggagtaggagaatggaggggccgtcctcaaatgtactgatactttacatcaattcaggcactggaaagatcatggcaagaaaaagaagcaaaataagccagttttaaattattgacaattagacttaatccaaagtttcagcttttttggaacaaaatattacggttgataacctcagcaaatgtcagaattggaatgtaaagcagttttgttttattttgggttttatttttttcagtccacaaagtcaaccaataatatatggtggaaaggtttatttaaaatgactcagaattaacagatgtcagtaagtcagtgagtgtcccataataaaggcaacagaaagagctaaagaagaaaggaggaaaggagtgataaaaacaatcattttatctgctgttggaaggctgtgccagcttgaggccttaatgaactatgccagagttgaggccattttctgaagaaggacctaactttctatgtagtccgttcattcggactttctaccagacatcattccataatcccttctccatcccttagtcccttttctctaagacatattatgattgctaacaagcatggagccatccattggggaagggaccacagctgggattaataacatatgctcacaggttccaggtggcagcagtaagaaacctgggtttttgttttgaggggttgaagtgagaataaggacaactttaaaatacatttaaagtacatgtgtacaaatatagtttcatttcatcctcagaacaactatttaaggtaggcagggtgactattatcatccccattctacagatgaaaatttaaatgtgaggtgttatttctactctttttccccaacatgacccacttcaccatcattgtggtctaggttgtgtagggcaaacttcatggggaaggtgagtttttaggacatttcaggacagtgaaattttgcagtgaaagttgggagatagaattaaaggtaaaaatacacatagactttgagaaaagcaacaagacacttgccaggctagcactgaggaatcaaagaataaaatgaaaacatcagtatatgaggcttgtataccagaccaaagaattttaattctatcctgttatgatggacagcagtggtcaggcaagtgacagaatgtccgcatgtttatggcaaaataatcagctcactaaatatgcaggttgcatttacaagggattgactagaagctggtgggaagtgatgaggaactatgttagatagatggttccagaaataaaaataaaggaacccaaaaaggagatgattagacaaaaggcaaaatagtgctgaaatgttaatttacaagattctattactcatttctgaactttccattagggattccagattttccaacaacaaccttcacacaactcagattttactagcaatcctcttttctttcactctcttgttctttccttcctcctatccatctgtcccgatataaagagaagggataaaacatcaaggtcaaagggggctttgtggaatatcaaaaggaggtcaaccctgaccagagtttccacaagctgcagcatcacgcctccatcccttcttagaaagaaaagactaacagaaattcacaagcccacgaatattttatcttggttgcactgttaattaacctactcttccacttcttcagagcactttgttttcccttccaatactctgcttccactcgggcatgggggtaacacatttgaggggaaagcaggacttcttttgaggaaataccccagagatatctgcctccatgtggttctgtctatttctgattccagaatcagcatgaagcaccatgaaggccccaacaaccctggccatgccttaatatcactcttgctgcttgtttcctggatgtttttggatcgcactctctaaatgcatgtctttaaggactagagaggaaaaaagaaataggagtgagaagagatggcggaaagagagattcattctgtccctgagttcttttgtgggttctagagctccccaacccatctctgatgagcagcaagtacatcctaagctcatctctctgagccagcagcctggttctctagacatcccagggccaaaagctcctttaggtaatactactgcaccatggaaacccacccagggaactcatgtctctaagatgacaactcaataatcagatctgtgagtttaaggggaagatagagttcctcatttcatttaatgactctgtctaccccaggtaacacacagacatttcagcaatgatctttagaaggtaatggttccttatagcacctttggtggagccagtcagggttagtattaggagtaccaggaatcttcaaattatattgtatgggtcacagcctgtcttggctagacctagcaaagcaagtaccagaagactgaggcaggctgatatatgtggggtttggggctagccagcctggattcacatcacgtctaccacctacttgttatcgaacttggggaaatctttcaactggtctgtgcctggattctctcatttaataaacagagataataatggtacctatatataatagaactgttatagaatgaaataaaataacattaaagaagtcagcagagttcccaggtacagactgactactcgatgcacgttacatatctcttctttattttttcttaccagagctgttgctctcttttccttccttggaccaaatggctctgttgtgtttctgtctttagaatgaacaaagagaatagcaggagtcatagaatatcagggtgttagccctggaggaaatcttggaaatcccactgcactgattttcaggctgagctttatggcatcctgagggctctgcaggggcacctgggagggcacagcagggcccagcaacacagggacttgtcctcatttctttaaccccagcagcacccgaccccttaaactatctgacatgttgggtatccatggcatatttcttttaaagaaaggattccccgatggaatcacaaagaggagaaaacaaaaaaaagactgaaaaccactgaattacagttccatcttctcaccacacccacgaaatgtataatggcttactaatcattagcctcctgattctgggggctttgcgaagcaggcagttttaaatcagccctccaaaatggaaagctacttccttgtacaccaagttcaccttccattcgcagtgctttgctccgtcttactggcttctatgcattttgttgagtaggaaactgacacccccagctcccaagaatacatgacttataaccctgcttaatggcttctgactcacttagggataatttgccttgccaggtcacatatcctttatggctagcctaatgctcaccaaatgcagggaagcccaggctctgacatcaatagttgactgacacatctcacccccgacagaggtcacaccaatagcactgtatgtcacagactcaattactgtgaatctttttaaaagcactttccttctaaggtggacttccctgagatccattgttaaggctgagagatttaagaaaaaaaaaagagaaagaattttgtctaactggggttttctcagataaattcaatgagaagtcccttcttggtgagagaatgaggttacttagttttgtgaaatgagccccatttatccttattttcccttcaggctcctcttacttggtagctgcaggtactttacggtgtcagagtgtgatcgtaaataacaggaagatgcatttttgtctcttaagcagcatgctcttcaaagttggacacattaccttacttgctagtagtaatgcattacattacttgctagagagatgactggaccctggtgatttaactcaacgacatgctgcagaagcttctaggtttggatgtactggaaatgaagtcaatcttcccgtcacccacagcacccatctagctatagtcaaagcctcttaaatacactggaatctgttggttagggaaggtcggttctgctcctaaacataggatgatcccttctctctttgttctggtggccttgatctgctccgatgttagtttcctgaaagctaactaaccttggtttctcaccttcctcctctctcccaagagaaatcttacaggagatccagagacttcggctagagcatgaacaagcttctcagcccacgccagagaaggcacagcaaaaccccaccctgctggcagaactccggctcctcaggtaggagagagcacccatgtcatctcagggaatatatatgtgtcagatctttgagaaagtctagcagtgtctagccagaaaacagtcctcagctaccttagctgctgacatttgtttttttcatagcacacacgtaattgctgatatttgggggatttagagagaagctgtttatattttgttctttcatttggtacagggaaaagcagtgtgtttctgtttttgtttttgagacagagtttcactcttgttgcccaggctggagtgcaatggcacgatctcggttcactgcaacctctgccttccaggtacaagcaattctcctgtctcagcctcccaagagctaagattacaggcatgcgccaccacacctggctaatttttttgtatttagtagagacagggtttcaccatattagtcagactggtcgcaaactcctgacctcaggtgatccacccgccttggcctcccaaagtgctgagattacaggcgtgcgccaccacacccggccagcagtgttctttacatcaaaaacaacatatctcactaggaacaatttaaacatagctctttttagaaataatcagttaaataaacatcacaggtttttaaatttaaaaatttacccctaactcataaaaggagtctgattttctctaagtcttggtctctaatatctttctttatattcagatctttaaaaataggcatcacaccttcctgtactataaaggaacataaaagcctagtcttctttagtctgtcatcataaaatacttgagttagaagggactatagaagtcatcttgttaccagtgaagggtcttgaccacgaagttgtccagggtcttggcattttgaataaagaattggacaaaacgcacaaacaaagcaacaaaagaatgaagcaacgaaagcagatttattgaaacgaaagtacactctacagagtaggagccagctcccgtaagcggttcaagagccctagttacagagttttctggggtttaaataccctatggaggtttcccattagttatttgggtacaccctgtgtaaatgaggacttggcccaggaccactctgattgcttgcaggaggcgaccaatcagaggctgaagtgaagttacaaagtgacatcctatgcaaacatttgattggttgcaggaggggaccaatcagaagtactttccattattcatctgcctcaccatacaaagggagtagcctcggatccttttgttacttgggtgtggaaaggcgaggttttcctttccattcagttctaggaagtcagtacaaatcgtccttagtttcgctgcctccagtccctattctcctgactcaatcagattctgccgctgcatttcagtgcacttctcagagtcagaagctagggagtagcaggccttggaaaagaaatgtggtttctcctactactcccacgctgcaaaatgagtcttgctgtgggctccatttcagactagcttcttaccatgccttgaataaggctggtattccagtgtatttatgtggcaaacaacacaaaaataaattcaaagacattccctcgtataaatatcatactgttctttcacaaggcacctgtagttgggaagtattacattcttttctttttgtttttgtttgtttgtttgtttgtttgagatggagtctcactctgtcacccaggctggagtgcagtggcacgatctcgggctcactgcaacctctgcccctccaggttaaagcaattctctgcctcagcctccggagtagctgggattacaggcgcgtgccaccacgcccggctaattttttggtttttttttttttttttttttttttttgggagagacggggtttcaccatcttggccaggctagtcttgaactcctgacctcgtgatccacctgcctcggcctcccaaagtgctggaattacaggcgtgagccaccgcgcccagcccattcttttcatctttcagtttgggtgccaactatgttccaggtatatctataactctgagtcatactttttatagtaagtacagatgcctctttgcagaaacccttgtcagaattagtcctgttttcttcttccatacaaaaagacgaaatgaagcaagttctttatgactatgtttggattttaccaagttcctgttgattgcatggatgtttccggaggctctatctttgctctgctcttcagacactttaacacctgagcacggcagagctttgtttttcgttaatgcatactttcatttttgtcttaaaaccacaatgaactttctcaacgatcatgtttccctttcccttttcactttcgccacaagaaaactgaaagctgagtcacagccagaagtgacaatgaatatgaatgataggcatttctatgtgctaatctgacgctttgctgcatactaactctacatacactgtcccgtaaaattactgtaacaaacctaggagataggcagtattattctactcgtttaatggataaggaaactgagattcacagaagtcacacagaagttgcagatatcatacctttcacttagtgtatatatttatgtacttatatatgatttataaggagaaattttttcttagaaaaaaatttgtataattgtgtgtaatttatgtatatatttcctaagaaaaaaattatcttgtataaccatgataccatcttcaattcgggaaagttaatgttgatatatggtatttaatataaacccatattaaaattttgacaattgttctaacactgttctaaaagaaagtagcttttaacggccgggcgcggtggctcacacctgtcatctcagcactttaggagtgcgaggcgggcggatcacgaggtcaggagatcgagaccatcctggctaacacagtgaaaccccgtctctactaaaaatacaaaaatattagccgagcgtggtggcaggcacctgtactcccagctgctgcagaggctgagacaggagaatggcgtgaacccgggaggcggagcttgcagtgagccgagatcacgccactgcactccagcctgggcgactgagcgagactccgtctcaaaaaaaaaaaaaaaaaaaaagaaagtaggttttaacacacatatacattagaaataatctgacagactatcagaataaaggcacttctttagagatgaatacatgtagtgctaggaaaggaaaatcactatttagtcttgttttctcattctccttggaaggtggaggttacaccacagatttgttattatacctacatttggaaaacgctggtggaaacttagagaagattgaatgaagacactcttaaattaatttttaattgaattcgatgtcatatttttaagagattactactgtaagataaatgtacaattagatttttttagtgttgactaattctaaattaatttgccattactcttaatggcaaaaaccgcagttacttttgcaccaacctaataataccagttaacgttctctgatagtttttaaatgcttctcttagtgtttctcacctacagttttagaaggttgctttaaccctcttcccaaagtgtttctgtggccaaagggccaaaattacagaacagtatcaagaagagaactggaaagaaatcagaaacattatctattcttgtaccaaagactactgtggatgtacctggaacaccatacacagacaaggtcaaaaaaaaaaaaaaaaaaagagaaagagaaagaacacctcctgaatttgtcactgaggaatattcttgaatggggcaaggcttttgaaattagaatgcttcaacccaggaagacaaagactaaaataagataccattaaagcatataaaattatgatgtttctcatcctctggattcagaaaagaagcaattttaaaggaaattgaaagaaagattgcttcaagagtaagcagtccttactcttgtaaggattgcttgtaagtggcaataatagttaaaaatataaatttaaaaatttatattttatagttaaaaagttaaaaatataaatttattcaaaaagaattgtgaaatatttataaattttaaattcataattcattatagaagaagcctataagaaagtgaattagaaatgtcctccactgctttaggaggctgaggcaggaggagctcttgtagccaggagttcaagacaagcctgggcaacatagtgagaaaccatctcttaaaaaagaaaaaaagattagtcaggcatggtggcacatgcctgtagtatcagctactcatgaggctgatggcggaggactgcttgaacccaggagactgaggttacaatcagctatgattatgccactgcactccagcgtaggcaacagagtgagaccttgtctctaaaaaaaaatagaaaaaaatagaaatgtatcatttatatcactaacctgtcctcccacaaaatatctttcaattgagtgagtcattgacctagctcactgtgacatttttatatcatcagtttttcgttgcagagttcttgtcatagtttcatttaatatgctatcattgagactagccatatccatttatacattaatacatacatgtttaaagtttccatgcagttttagtatgtaagtatgaatatttcaaactcaaacagaaatctttggggcaatgggaaaattatatgtattacttattcagtaataatcattcagtaatggatttggaatttatttggaaagtatacatatacttcagaattgtgaaccattaacattcctcatcatactgtttcatttctttccccctttaaagatctttttggtacctcttagtgtcaacataaatgatcgagtatagattgtccttagttgttttcattcttgctgacagtttaataaaaggtctgtaaaacaaaacaaaattaagcatgaaccttatatatcatcttcacttgttgaacaagtatgtagaaatgcctttattttgacttcactttatgaaaccaaactcaaacccaaaaatttaaatggattgtatctacgtgctgttaatatctcacctctgagagacacctcaatgggtgctgaagatttcaaatgtacttttctaaatatatttccaaatactaaggtaatcaatattttctgtgaatttgcaaaagggttcttagatttggagaatctggaagatttgcctttttcagtgacaatttggtttttgtttgtttcaagggaccccatagcacatcacagggcccactacatagtaagcattcagaaaatatttcattcaatggttgattaattcagggtagaaaggtctgaaggaaacaaaagatctaaaaggactttaattctgatgtagtatgactgctaacaaaagaaacacttccagctgtaattgttcattcatttgacaacagttccctgcctggtaaccttgtcagagacccagagatgccctttttctgacagtccacaagtccctcaagaatggaaatgtgattagctcagagagttgcatgccgcttctgatgtcagctgcttctttcttagacagcgcaaagatgagctggaacagagaatgtctgctctccaggagagccggagagagctaatggtccagttggagggtctcatgaagctactaaaggtaagacctgccagataaattttcctgagcttattttccatgtcatctgtgaaaatttttgcacataatgtgcaatggtttttccaattgctgtatgtgatttccctcaacatgttgtttcaagctcagatgtaaaacaatttgttagaccagtgtagcagtagctgtcagtaatagaacacattcttttttttttttttttttttgagacggagtcttgctctgtcgcccaggctggagtgcagtggcgcagtctcggctcactgcaagctccgcctcccgggttcacgccattctcctgcctcagccccccgccgagtagctgggactacaggcccccgccaccgcgcccggctaatgttttgtatttttagtagagacgggctttcaccgtgttagccaggatggtctcgatctcctgacctcgtgatccgcccgcctcggcctcccaaagtgctgggattacaggcgtgagccaccgcgcccggcctagaacacattcttatccattcctgaaaccagactgctgagggccttcatggggcaacttcttcttggcttatttccagtttctttatgtctgcaagtaataaaactggatttatttagaaatattttatatttagtagctttcagcaattctgattaaattaagaggagtgactgttaatatcagtaaaatattttattccattagtatgctttatcagtaggtcacatgatttctagtgaactcagacacaaactctaagagagaatatctcattactcttctgtaagtaaaatgtttaataagatgatttatagaagtcttctgtagagtgctgtaatctatttttctcattgggaagtggcattcttcttttagtaaagccttattcccttctttagtatacattaaattgcatttaaagtcaaaagcaggcaaattatggccacatgtctacagtcagcccatgtgatcagtgccacatgatcatcctgcctgatataaacaagcaagaagcagtatggattggaactgtgacatgtcaaaggcaggaagtgaaacttctgataggagaatggtaaagggaagaccctggggcagctcatttgcgagagagggtctcccaactttcagtccgtggatgtcccacggccccaacacaccaacatttgttgtttttattttgtctgtcctttctttctctcttttttttgtctgtcctttctttctcttttttttgtctacctttctcttttcttcttccctttttcttcattttttttgtttctttcttgattgccccctctttccttctttgttttattttttgaaagctactttgtcccagccactgttcttgtaaactttcttttgttttccttactctattttattccttttccctccatcagtgtcctctttaacaattggtattgggaatactttatctttactcaacaaaattgacttttcagtaattagatatgtacagtgtagaattcaattcttgttgatctatcttgggtaagacaagactagatagttcataacctgctgctgtttctggcctgttaatctcatttgataaccaaaaataaactctttctgcttccctttccaaatataccaaatgaaaaggactgaacctatctttcccctcagtgaatgacaggaagctttgaaaactgccccctatgtttctattgcttctgtcaccattagctatgactctttccctatgggatagaagtctattcaccaccagccatgttggtatcaacctagcctaacagagtactgccttttattgagatgtacacataccaggacagagaggtggattgtgttgaaaaatggttgtacatgcagagaaaagagatgggcctgtagtctcaaataaccaagtagacttggagtgatagtcactgaggtggcagaggcctggacctgccgtcaaaggtgtgttgatgtttccccatcttgcgttccttcacactgtgtacatgctcttattggaaccctgggtaatctaactgttattgattcaatctttctgtaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaaggaaaattatcggtggttttatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttgaattgaagttatcctaccctctttcttctttgtgtatctttaagatttattgaaggaaccataaaaagaacactcataaaacgtttaataatgaaggcagctggggtataattgcagtaccaatatgttccagagtttctggtacacttccagttccaaatattatgtaccagtctaaaactgagtagactgactttgactccagaaagtaaggtctcaatattagttttcttagcaaagttactggaattagacctgaattacagtggtaccagatctttgctcacggctgtaagcttaactttcatgttcattaatttcaaactattgataatccatggctaataggattattgtatagattttgatagatactggatgtgaaagcactttgtaaaatcttatacgtcagctataagtatgaatgtatgtatataggtatacatacacacaggtatatataaacttttcaaatttggtccatattttacacacactcacatacacacacacacacacattcacttc

SEQ ID NO: 14982 - DNA, 127771 bp, Human
ttcagcaacaaattgttaccaaattgatgaagcttcattagtaactctactcctttccaataattatttaggatagtccctggtatattatctaacccattgttaatatgtgcacactcttcccttgactccataaaccaaagctactctacgtccttccctcccttcctggcaatgggcaaatagtgcttcacccataaaagcatctggtcaggctactggaccaatttgataaacatcacttttaccaccaatttttttttttaattttaccctcaggtgagtcattttgtacacagctcattaccttttgagcagtcttctgctgtagttttgttaaatttatcctcaggaaatcaacccctctcatggtcacacctttctttccacttctatggctataattacctcattgtgtcttaattgcttttatgcttcggtatctctgccactacagtataagcaccttgaggacaagcactgtggcttgatcactgtagtgcactcagaggacagcgtggtcctggcttgatcactgtgatgcgctcataggacagtgtgatcctggcttgatcactgtggggcactcaaagtgtagtagggttcctggagtatgaaaggcactcagtaaaggcttgttttgtttccattcgtttatttttaattggcagataattatagtgtatatttatggggtacaatgtaatgtgttgatccgtgtatacattgtaggaagagtcagtcaagctaattaacatatccatcacctcaccaacttattttttgtggtgaacatgctgtttgttgagtgagtgctcagaattgaaaggcattgtgtgctgtggaggtgcagaggacaggcaccaaacccaggcagttgtagaaagttggggaagatttcagaggaagatagacaaactgagatttgaagggtgacagcaagttagcttggcatagggagaggacaatcctgtcaaaaaagagcatggacagagtcctagatttgagaaagagcaggggccatagccataggcaaaaaaccatgcagctacaccttttgttaactatgcctgagaatcaaggcagaagtcagtgtggtagacatacgtgtgcatctatatatgtgcacatgagaggaaactttggtttttgaaagtttaattagatgcaataaaaagtcaaatccgtcagcctctaaaactcttgatatttagcccaaagccctctacatgattaaacatatccattaactttctcattattttctttttcctcaagctgaagtttattttttctatcacattttaattctctgttttaactgttggcattttagtagtatattttaaatagttccactgcagacaatagtatggttaaggaaagatatttgaatctaaccaccttgcatgaagttgttatatacaggaactgttgcaagttccaaacactcaacttagaaatgaacatttagaaaattacctgtttataaattgaggttttgagtgtataagggacaactggcaacaggatgagatggaagccatactggtcttagaatccaaacgtctgcatccttcattcaccaagtccatcagactcttggtttcatcatctgttgaatgggatccacaatatctgttctccagtcataggtattcttaaaattgaaagagaaactgaatgggaaacgagtcacctaacagatggtagattgttgtatttagttatagcacaaggtcatttgctacagtagttatttttatgttagacaataaaaattttatcccccctccaacaactacaacaataatatatatggaaaaatatgcgcagcaatttaggttagtaaaactaaagctgtactttttaaaacaaacagttttaaataggttttctatgtgtttgtgtcacaagtacagcaagtacgtttacagagaaatggcttcttgcctcaatagcgtgaggataatacgcattgtaactattttgtctcatagaatgattgaagatagtgggaaaagaggaaataccatggcagaaagaagacagctgtttgcagagatgagtaagtatggatcttttaaggaacaccctatagtttccattgaatactcatggaaaggctagaaataaccatttatctttatgatatttgtacttttccttaggatcctaagttcctttcatgaagtgtacattttggccttttttacttcttacttggcaagagttcagttagtcagtaattcatcctaatttgctattagactgtctattttatgtggaagaaaatgtttatagatttatatatttacattcacacatatatgcacatacacagacagttgataaacactatttagtgttgacattaatacagtccactaaactttaaagtctgtgttcatcaccctgaactgtcacagcagctggcatattgtaggcactagataaaatttttgaaatgaattattgactttcttccctgcaaagtgatatcatatgtttatgtggaaaggagaagttaggcacaattactggaccaaactataaacttgtcattcagacctcatgtagaagaggagaatctattctgcaaactggtttttttaaaaatactaaggaaaataaaagataaaaggagcttagagttgacctgctacacaagggaaaccaaactaagttactgactccagtgaagaatctattcaataaaggctattggtttatgtaagtgcacagttgctgtataagtaattggttggtagcatctcccttgtagaccatttttcttattcataaagaaaaagaacttgacattagggagaaaaccacacatctcaagttgaatattataaaggaaaaagcatggttctcttcatgtctttttatctcttcttcctgcatacggaatgaggatgagcaagagtgagtggtaagcctttttccctaagaaggcagtagacaaaattaggtttctactaaagattggaagtgactggcaagaatgagggtcagaacagaaaaaggaaagtcccagataataagattcatattttcctttatcattccccaataatctggtggtaccaagatagcattagaactaacaaggaggaaagaaaattaaaattgatgtggggaatctcagtcgtgttccttgctttttccacttttagagatgtgcttagagtgtttgggagagtttcagccaggccttccaatttcctagaccccatgtgtggtactgtgtcttcacctggaattgtgacctttgtgcagttacaaatccaacagagcaaggagcctagtgagtacttgtccatctaaacaaaatccaaagcagcacaggtatcctccaacagcacattcttatattaaaaaggcataaaattatgtcttatattataagacatcatgggacaatgtcttctcagacacagtagaaaaaaaatatttaccataaaaaggcaataaaatctggggaaaaatatttgaacttatcattataacactaaagactgtatcagacagcacactgtaagaactataaaagtatgcttattcaatgattttgtaaatccttctttgagtttaagtatcccagtgctttctgaacctgatatagtgcctggctcagacaaatacatatgttacaaatgtctattggattaaaattgcccaactcaaagaaagctcgatatgatttttagagacatagaaataagacaactctaagtttttcttcaagtgacagagacttaggaaaattgtgcattcggttcccaaattataactttgtgttttcatagaaacatcacagtgatgtcttgcagctttattagttctgtgagttcttgtgattaacggtcagaatagataaacaagccaaacaaatatatatctttcctccctgggtgttccaactcaaatgttggcaaaaacagctaaatacgtctgaccttaataattcattagtttgagcaacatgtttatatcagcactaagtagggcacatccacaataagtaggattcggctggataaaacaattggctggtttcaaagggagcaattgattttgacaggtagactgtcatacaaaagagaaaggtaatatcactgcgaatgtgttaaatggttgaaaaatatatgggtatcccagctgtatcagcagcacaccaaagaaaggaaaggaaactcttatcagagaagactgacatcaagattcaaaaagtaacttctaggaatctgtgctttctagacagggagcaaaaaaggactagacttgtaaatcttctcatctaagtattatatagaaatatttaaagaaaaaacaacaaaagaaagtgccaatgagattctttgctttagaaattagaaatgtgaaagaaaagttgtaatggccagagttaaacaggcagggaagacttttatccaagactattgcaacaagggagaaagactgaactcaacttccctggaagaaaaggcaggaagtactttaagcactggggaaaaatactggaggacttcagggaggagattggtcaatgtgattaggccatctgtttgctaattgtcacatttaaaagttaggcttctaccctcctgataagacttggagatagaggtgataagtccttcaattattatatttcaaagggctggcacccaggttcttgagaaagacattcctgggttgtaaacttggcaagatatttacatctcaaaggggcagagaaagaatttacaatgaaaagttttctaaagtaaatgctgtaagaaaacagaggtcagaagcctagagcaaggaagaagtctatctaaagttaggcaagttgaggaggtctaggtcttagaaaaggtaaagaacagagagcaattgataagaaaaatggataagaaagtttggcaaattcaggtgattgcagcacatatgtgttaaacattcactcttagctcattactataagcagcagaagcaggaagaaacagcaaagaaatgaaattaagagaagcatagactaaaaaacaaacagaaaaaaatagctttatataaaaaattgggtgaccacctactttgatttaagaaattctgtacaagttctcccttaaccaaaaattctcttcacaataatgccttaattatcagtttgcttagtaccttggattaaagctgaaaaaaacaaaaaaacaaaaaaaccctctagttaaatataaacatcatcctcaccttggctttttcagccatcatataagtttagcagcttaaataagtttatcagactgtcttttaacagaataaattgtttgttcttggaattaaactctccttttctgttgttttactctcagagcacatttacttagccttatatggtagttacttgtgaacatgtccacaacactcactgctgtgaactcctttttagggacagacctaggacatgtaccttcaaatccattccccttagatgctgaatcaagccttgtttaaaagccgattgggcacaggatgggtaggttttaatggaagggaagtgattggaaaacacactttgagaacattgaaggctgcctaacaaggtaaggaaggtcctggggagaaatgagagtgatgccactggcctgtcagcagagacaggacttgaaatcaaaaggaggcaaatgaaactactcaacaaataccatttttggcttttgtttttgcttttgttttgagacacagtttcactctgtcgcccaggctggagtgcagtggcgcgatctcagctcactgcaacctccgcctccctgttcaagcgattcttgtgcctcagcctcccaagtagctgggactacaggtgcaccaccacacctggctaatttttgtatttttagtagagacaccctgggtttcaccatgtctggccaggctggtctcaaacttctgatcttaagtgaaacacccaccttggcctcccaaagtgctggaattaccacttgagccactgtgcccggcctaagtactgttgaattatttgaaggcaggccatccttgagagtgttggctgaagtcggcacatgcacgattggaaaggaacctagggcatgattttgaaacgcacactatgagtttaagaaaaccgatctcaaaaattcagaaaaatgacatgaatgaccccaccaccgtaggttcatggatatggtgactgttttcacttgcttcttcatttctcatgctcctcagtctttttaagatattaacaccatggatcgccaccccagaaattctctctatgtcatcaccctaacatagtctcctgctttttctgtcccctctacttctctttttctgtctcttagtaccctgtagacactgaagtcagagaatttaaagatttcttcttgaccagttgtctccatatacaatttgtctttctctcaagcctttacctttattgctataacccttgagtgttcagagtcccccaaaacaactctcatttctcatgagccagcttatccaaaataggcagcacataaactaaacttcccttccagccttgcctacttgttttcaagtgttctgctaatgaagcagtctgaggagggctcattgtcactccactaatagtgcccatcacaaaaatacctatcatccctgccaaggcggctgccttctagtgttcccaaagcctgcggtctttgaacaactgccaagcagctgggcacagctcagaagtggggagagcactcctgttcccaagtttgtgcctcattttgtcactagaaatatagaatagccctacttgtgcacagagtctcctgttggcaatcttggcccagtcacgcacactactacattttgtgtgcttgttgataatttctggaatatactaaagctctaatccttatatccaactgtcctgtggatatcttacttggacatcttacaagcaactcaaactctttagcccaaaactatcttcacccatcaacaaacctattcctccctgtttgtaccttacttagctcaatgagggatactctattccactcagctacctaaggtagcaatcattttttacccccaaactcctttatcttcctgtcagtatctctctctttctctctctcagtatctctctctctccctccatccttcacacacacacacatacacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatatagaaggcaaaacatacaaaaattgtgtgaaaatgttcagagtgcaaaagctaaaaccaaaagttagataagactggttcgttgatttgttggttgattggttggttgaatgaacaaatgaatgggtagggaaaaggtggaaggaaagaagggagtgagagagggagagagagggaagtagggacagagggagaagagaagaaagagaatcttttcaaaaagggctaaagaaaggaaaaactgctgttgataacagtgtaaacaatctgtgtctttgctgtcctatttattacttccttccaactatgacatgggtacaagaggcttgaggagacggtgcaagagcactaagttgccttaaataaatttgttttagtttttttattatgaaaagtttcaaatatatgtagaagtagagaaaatagtatttatctcaactcttaattatgtatgccatcccccactgtattagtatgaagcaaaactaataaatcacttagatcagttgaatcaccagatttaacgaattatattccagtgatataattcagaaaacaaccactatccattattttgaaaaataatgaagagtacattgaaaaaaaatgtaacgagaaaattctgtacttttttattaaaaagaaaaagtatagattctttggagtttagggtatgaactggttataagtttcataacaaaatggatgttttttagatcttggccaaaatatagtggtaattctagacatatcaacatactaaaagcaaagattgccctgctgattttatttctttactcatttatttaaattccatctttttaatagataaattaagtcagctaatacgctttttaataagactaccagactgctagatcagaaaaataccatctgataaaaattaaccttaatttcagcaagatattgaccaaagctgttggactgtgcatgtgttggggaattgtggactgggtcacaatacagttaggtagatttatgggggatgtcatgaccatgtctaaagccacaactaatgggtctatcaacttggaggaaggcgtctagtagtatcctggaaggctctgtttgtggacctgttctggtccttggttttaatcaatgactcgaatgaagacacagaactaatcccaaagtaggtttttgggtttataaactttcaagaaaagaccacacatgtaaaactgggttaagttcattgtttgctggggcaaagaaaaatacatttattttgacaaggcagataaacagagtaagaggctatgtatcatatctcagcccagcttcttctggtccctttctggatggatcctgcagctaacacatacattgattgtgcacggttgtgtgctgctatatctgacacactaaattgtattgttcaccacatcccttttaatattcagggcttacatcatcagccaggaagaatttatacagcatttatagacctacagacctcttcctgattcttgaacaaaacacagggtcagttaagtccacacagtgatacgacaggagagagcagtcagtgcacttcaggcccaaagcagcatctctacatccctctttactgcatcctggagaagtgcacctttgccgtatttcccccaggacttcaatcagaggaaagtgcagaggtgccagggttactgtgctcagagggtaaggtcttgcagaaactgagaaacttaactatgtgccacatcacaaacattttttcatctggagcttaaatcattatgcttgaagaacttacacaaataatctgtgcccctaatgttttcttttaagtgattatttacagatattgagactctcctgattgctgagccaaacttagcaccaataaaagtacatcctcatctgggagcaaaggcagatttagcattcaggtatttctaaaagtctctctgtctctggttatcgggcatcttagagagctcattccccacgagtcacatttacagagggcatgaaactaggaaagatttttgaagttccagtgacaacttaagaattttaaaagattcagaaaagttcctagtatgagctaaattttaaaagtaactaaccagataaatatgacgtcctacccttagctccaaaataggcatttaaatagcaaatagaaaagatttgacttatatagaagtgcatatgatttttcaaagcagttttttaattaacttcaaacttaataaaagctggcataatgagccgtctatttttaaaaaaagatcacattagttaggagtccttatcaaaggtagtaataattgctttctgtatattctatacaggtaaagcaatagctatttggattaattttggacacctaattttaaagagatattagccagtcacagaacagggtgactagaatgtttaagggtttcaaaccatgcttgatcataatgaaaataataataacaactgccatgaattgaagccctactgggtaccagacagataaacagtatacctgaaatggctgtggagttgaacatcttttaccctaaaaaaagtcaaggagaagctacctccccagctaaattttaaagtccatgatgacaaggactgttgcacataattttcagatggtaatgaggatgctaataatgataatgtagctgctttgcaatatttcagaaatgaattctcaaatggcagggggaaaggagtatgtgactccaggggaaactagatcaaataggttgaagttacagggaggtaaatcaaagctcaaatataaaaaagaaatttctatcacatatttttgttcagaaatggcacatgaagcctcttaaggggcccatttactgttaagtggtcattatgttctcagtgcagaagtcaagactttatatctgtgtattaccagccagtaaagttgatattgttatctcgctttatccatgaggaaattgagatgccaaggaaaaacttggtgaaactcacacaactgggaagtgacagagttaaattttacttcctttaaagttcatttattttcacaagtaataatcttctctgtcattggaaataatcctacgtggccattggctaaatgttcatctcttgagaacatttctaagggaattcctgcattgggtgagggtagttccccatctctttgatccctcaagtgctcagtgtcactaagcctgtttgtcaaagaataagctttattaagagtgaccgtttaatgatctgctttgtaaaaccacaaagtaataggactattggcaacacttcaagtgaatctgaagatatcggtttgagttgaagaaatgctaaatcccctagtgggggacacttgctaattcatgctgagtttcactgggaaagcacttaattggccgtctaatatcatcgcttccaggatagttcatttactttctattctgttttactctaaaggattcacatagcacattttattagtatatgactggtaaagataaaagttcaatacatgcctttatatctgttatggaccataaacatgggcttagaaaaagaaaatatgtagaaatggagaaaagcagacatttattgatagtctaatgtgttctagacaaagtctagagattaactcattcaaaggagggtgggaggaatactaggagctcaggtcttgatgtaacaagcagcccatctgcagggtattgagatgagactgaccaaggctacgagagattctgtggtagaaagtggtgggcaatgtcgttaggcaagtaagctggaaagaaactgcagacgagcttggattctgagcagagcttttagacctgatgttctgggcatcaggagccatgctggactcctaagtgggagagtgaaataaggaaagtagtttaagaatatagggaatgtgttccctctaagttaggaaggaactggaagccacagtaaaagaaaggttgttttagaaaggcatctcttcctctgagattgacaggaaggatcacaagaaagttgttagtaataaaaatgaatacttatgcagcatttactgtgtgccagacggtgtttaagtgccttaggtatattcactcatttatccttacaacagtcctgtgcaataagtactattattatcatcatccccatcttccaagtgagaaaactgaagctctaaaagcaattggcctaagggcacacagagaagatgctcagcagtcagtacatggtcacctaacagccacattctaatgaccaatagcaatgcactttaaatgcttatttgatgatagtatctatatcatctagctgtttcactgtaggtcacagcttgagcagactgttttcagaagtggtggacacaacagggatgacattgtgtttcttgatccaagaatatggtttacaacctaatctccaatgttgattacatgtgtgtgctctttttccctagaacctgaggaacttgtccttgaataggacagacctgttcaagtcttaaagttatatttatattctaataaaaataaaattaggggtaaggatcatatctacagttgttttatttgtaaacattgtaaatttctttctgcacacatggcataccttatgtgtcctttttccccgcactaggggctcaagatctggatcgcatccgactctccacctacagaacagcatgcaagcttaggtttgttcagaagaaatgcaattgtaagtatgccagttgtttggactaattaccatcatgaatcctatagtttacatttggtactaagtttattaaactagattctgttacaaatattgctaatattgttatatatgtttacacaacaataaaaggggtattatgatgcacaaatggtagagatgactcctaagtagtcttgaaatctgaaaatgcttaaatactaaagcatatgaaccgtttagttcatactaaaaggatgaacctctggatacatatacaatataattctgaccttggaatggtttaaatctggatggatgtttttcttcttttctctaaccttggtatcataaatgcagtgccatcaaaatggtttccaacatcattctcagcaaactatcgcaaggacaaaaaaccaaacaccacatgttgtcactcataggtgggaactgaacaatgagaacacatggacacaggaaggggaacatcacactccggggcctgttgtggtgtggggggaagggggagggatagcattaggagatatacctaatgtaaatgacgagttaatgggtgcagcacaccaacatggcacatgtatacatatgtaacaaacctgcacattgtgcacatgtaccctaaaacttaaagtgtaataataataaaataaaataaaaatggtttccaagaactttataaaatatcaaacattaaatcccccttatatttgtattttcttttacaagcacaggaaaatattttaaagcttttggaaaacatttaagtttttttctgaaagaacaaaattagctctttgtgtcagagttttaaccacatttgtttacatgagacaaaaataagaaaagagacaatacttaaagaaacaaaggaacttgctccagtttttttttcaaatttaaaagtgtaagcaataagctagatcactagtcacaatgagcagtcttattctctgctgggtcaacacttccattgtattaccatatccattttctcttggaaaaaaatattgattcatagttcatgtgtaagaacgttttcttttctttttaaaaagtttacttattaaaaaagtctcattttttaattaatattggatgaatttttaaaaatgaaaaccgtaatgttctcctgatacatacacatagttctatgataactggcatggtaattagactcatggtaagggtagaaaccggcatctccacatgtctaccctctcagagtctctagaagatgtttcctagggccctgggcaggtcaccttagccccaggcttctaggcttacagctaatcatgactgtgaggatgcaaagtacgcatctattcctcaagtttctcctctacatcttattccccagccccagtggataaaaatggggctgaagtttggggaaggaggggatggaagaaaaatataagtaggttgtcttattttcattttctgtggcttataacagaatacttgaaactttgcaatttataaagaaaaggaatttatttcttacagttatggtggttcagaagtccaagtcaaggggctgcctctggtgagagtctgcttactagtgggactctctgcagagtctcaagatggtgcagggcacacatagtaaggaggctgagcatgctaactcaggtctgtcttccccttcttataaggccaccagcctcactcctgtgattactcatggattaatccattcatgagggcagagcctgcatgaccaatcacctcttaaaagccccacctctcaacactgcctcacagggggttaagtttcaacatgagttttagaagggacaaacattcaaaccatagcattggtcacacatcatatatgtgttttgactcctcacaggaagctaaagcaatctaaaatgagtagtgagaaaagcattacagatgttgaaagaatttgttactgtatttgtagtcctaatgagtcaataaaagccatttccactgcttgcgataggggccaaggaaaatgttcccacagaagaagtttcctcttccccttcaaacacatcacccagattacaaataaaaggaagaatctccgtgttttcagcaattaaaagggatatgattgtcccacgttcttatcatgtgttaccactacaatggcctcagaattggaggggaaggcagagggtaagtggtagacactctgtcctccttagagctttgccaagcggagccttccttaggctcctttcaggagagctagagatttccaataaaagactacaaaatggtaagaaggaacgcccccaaaaaaaaagcaaaaaaaggaaaacaaagaaaagaaagaaaggaaaaggaaaaggaaaggaaggaagggctcagggaatcagggacttggcaacactgcactcaacattaaggtggacacactgtgttgtccccactcaacattaaagtggacacactgtgttgtctgcagctgtggtccacaggccttatcccatgcctcctgctctctgagaaaggcactttctcattcttgggcatttccttttcctctttctgttcttttctggtccacatccttatcctgcatccagaattgtcttggaatttcttgaaaaacagtagagaagaagtgaggatgctaatccatccctgggtgaaaatagaagcttatacctgtccagtggcccttcagtctgtccattcattgacctcttaattcagttaagtgtataatgagctcctgctatgtgtttgacattgtgctaggtaccaaggatagtgtgatgatgaatgacatgcaataccttccttcaagttgctcaaaatctaactgagaatatgggcttttaagcagatttataaaaccatgtagaaagataatgatagaaatatgtacatggtatgtgagagcttcagggagtcagtgccctgagttgttgggggtgagggtcactggtaggactttcctagagaaggagatatcaggaaagtcttatttattttataatgtaccttataaaattcctgtatttcaggatgagaaaagatattacattctacaaaattagacaaagttaaggcccaaggaagaaaaacaagcatattttgaatgctttgctaaattaaggttttaaaaattgtttctaccttcatcagaggcattaaatgcaagtactatatgtctttgcaaagttttcctttctaacaataaatgcaacagttgtgatattcagaggtatttgtaaaatgcttacataattgatcttggcttatcttaatcaaagttgaaaccttccttctagaaagttagccaaccagaagcagcaatgtttacatgacataacattagtcaacattgaatatattcgctgattagaggaaagtaattttagtctgcaataaacctaacccacaataaattatgataccttataatggagtttttccctacagtaaaagaaataagaaacaaaatgtaggtagcatatttgtaagtgcatttttttattggaaagtgtcaggctgctctaacaaaaataccataaactgggtggcttataaacaacatttatttctcatagttctggaggctagaaaatccaaaatcaaggcactgccagatttggtatctagggagggcagccttctggttcataggtggccccttttcactgtgtcctctcatggtggaagaagcaaggcagccctctggggctttttttttttttttttttttttttttttttttttttttttgacagagtttcactcttttttcccaggctggagtgcaatggtgcaatctcggctcactgcaacctctgcctcccaggttcaagcaattctcctgccttagcctcccaagtagctggaattacaggcatgcaccaccacgcccagctaattttgtatttttagtacagacagggtttcaccatgttggtcaggctggtctcaaactcctgacctcatgtgatctgcccgccttggcctcccaaagtgccaggattacaggtgtgagccacaacgcctggcctggggcctcttttataagggcactaatccccaccatgaaagttctgccctcaagtcctgatcacctgctaaaagtccccacctggtaataccatcgcattaagggattaagtttcagcatgagaatttggtggggcacaaacattcaaacaatagcagaaactcattatagtatttacttcgtagaaatcagtggatctgaagtgaaaatagattgtttacttttaggtccataccttatttaaaatttattgcgtatactaacaaaactaagttttaaaactacataaaggaggaaaaaacaaaaacggctgttgtaaaactatcacctagaaaaaaaatgaatactgtctgcatacagcacagactgtgtaggttttcaggagatttcttttttatctattatctaaatccaaatttcataaatgttggttaattccctatagttctttccccacagcccttgcctactttgtttatgattttgcatgtggacaactggttcctatcactgacattcatgtttattttcttctgttcaattcctaatgtatgctgagaatagtcagttcccgggattctaaaaggactctgaacaagaggccactgtcacccatgaactaaatgaggcccagaacctacttttttatagagaatgaactaatggattttatagatgaatatttgtaatcgatttgataacagggaacactaacttgtaaccccaatttttaaaaatgcgtactcccaagaagaattatattcttttttttttttttttttgagtggagttttgctctttttgcccaggctggagtgcaatggtgtgatcttggctcactgcaacctctgcctcctggattcaagtgattcttctgcctcagcctcccaagtagctgggattacaggcgtgcaccaccacgcccggctaattttgtgtttttagtagagagagggtttcaccaggttggccaggccaggtggcatgagccactgtgcctggccaagaaattacattcttctcattggtagaccagcattttcttaatgtacccaattattggatatttaacttcagtaaaaatgttgtgtaaattctttttctctcttgttatgtatgtactgatataatatccctgattttgtcccttggtccacaaaaagaatgttgaccaatccctgctataaaagacacttgtaagtccaggcgtggtggctcacacctgtattcccagcactttgggaggccgaggcgggcggatcacaaggtcaggagatcgagaccatcctggctaacatggtgataccccatctctactaaaaatacaaataattagcggggcgtggtggcgggcgcctgcagtcccagctacttgggaggctaaggcaggagaatggcatgaacccggggaggtggagattgcagtgagctgagatcgtgccactgcactccagcctgagtgatagagtgagactccttctcaaaaacaaaaacacacttgtaaaaaacccatcttctttttgagtcaaagggttctcctttccaaatcgcttcttccccttaccattcatctttgtaccctgccataccttccccatgatgtaactagcacattctctaacagaataaaagaatgagtgtttctaaaaaattaggggacaccaagttgattatttgatattctaggaggaatggagcagaacaaagaatacaaataatattttaaataatcctttctaatcagtagtcttctcttcagcttccagattttttgttaactttccacaaaaattaataccccataaactcttataaggatatataaaatggcatcatctcagcctttattttagacaaatagctgtttctaccataacattatttccttggtcagcattgacgtggttaatgatccagataccctgtaatgtcagcagatcttttttttttttcagaaattactttggagtcaatgaaatgcagccctaaaatcatgaacaacaaaggacaacaagagaaataaatcagaaatatctaatccctcctgtttaatagtaggaacaaaattaagaaggcaagggaatattctatcctacacccacagctaacattgcaccatcttttagtcctactggttacagcctgaattttctttccattagtcatatcaactaaaatttaattaaaattttgtttaaaaggcaaagaggagaaaaggtctataattatatctcggctgtcagagtttctcaacatactctttttctagtaattgaaatattttaaaggtatccttcattcagatatgttaagttagaacacctgctttttctatgttactgtctctaaatttcttttcaaatttcttttgaaccaaaaaaatgcagttacctttttacctaaatgtttctctatcaccataaaagtaagccaagtgagtcccatataactagtcggtcctgaatcaatattctatgaatgaacgaatatgctccactagattcatttctcaccagtcaggtgactagaagaacgctggtcttatgtggcaggagtgccttgagctatgtttttagtagtaaacactaatattccactcatttttcttccaactagtgtatcagtattttcctcttccctgcttcatgtttaaatatgtggatttttagctgccactatgaattttctattcttggtaaaaaattaccataaatttagcagcttaaagaagcacacatttattatcttacagtttttgtaggtcagaaatccaatgcagcatggctgggttttcggcttagctttacactcaactaaaatcaaagtgctggttgggtctgtgattctcatgttgggatcaaggttctcttctaagtgcattcattgtgggaaagtgttattttcttgtggttgtaggattggggccccgtttccttgctggctgtcagctggagactaccttcagttcctagagcctcccttattctttgcctcatggcccctgtgggctgctcagggcatgggtgtttgtggcttcttccagcccagctagagtgtcctctctgacttccccatttatgactagccagagaagtctccttgcttttcagtgactcacgtgtttatatcaggcccactcagatgatatccatattttaaggtcagctaatttgggatcataatatcatctgcaaaatcccttcactgcagcccctggattcatgtttgaataactaggagaaagtatgtgacaccatgcaccaggaatcaaccacactgctcaagaacatagactcttgtatttctcagataacgatgtataaaatcttggatgtaaaaataaagtttaaagtcggaaacacaggcaagagaaatcgaaccagagaaagatatgtatttaaaagagagggatcagaggattctccctagtcaaggagccagcaggaaaagcaggaatattcacagttggggaaataaactgcagatgactaacccttggagcacaattatctatgttagtgttgttgcaaatgtttttactacatattttcattcctgatgttgaatcattctagacacttgtttagaataaaggaaggtgcattgtgctagaatgcaatgttcccaaaaattccctgtgggaaagttggtggtggcagtggaatataaacaaacctattaaagatgcctatgtaataggacaatggaaaaactgctcctctctggcaccctggacctatggcaaaattatttccccttaatcagagtaaacctctggatgagaaaagcaatgattttaaagtcctgatgattatgatatgggtttaattaaagctgcttcttccctttaatggtttttaagatcttaaaaatcagggttttgtttccttgttagtagacttttgttttagagaatgccagaagctttgcttaaactgctgccactgcataacctgtgagctaagccacacctgtagtctcgtttccaggcatctggatgtaacacacagtgacttccttccctttcttctgcttctgcattagacgtgaaagctgtgccaactaagcacttttactttcacagctgaggaaaaaccatcatcttaaaatgctcctgtcagttgggaaagagtgatgcatacagaggaatgcgtttcaagcttcccaaccctatctaacaggtgccaaggcaagattcgatgaccttcccctggtggcctgccaagccctgtttctgggaaactgcctgcttggcttggagccagtcagcagagcgatgaagggatgcccagaaggggttctcccactgcctggctcccaggatctcaggactccagcacacattgtaagaaaacagaagtcagtcgggaggacagggatgggagagcagcttctcccatgaaatcacacctgagattccatctgaaagtcactcctgatgtcacctgggttcactcctcactgaggttttgttaacattcattgttattagcaatcactcatttatgtattcactccataaatagagacagcacttactgcatgccaagcattattctagatcatggggagaacagtgtgagtacaaagtggaccattcagaaattcatccctatttgcatattctcttactgaaactttacataaatgcatatttattttagtgtacttcttcagcaataaaaatttcattttcaatatatcactctcacctgtcgaagagtaaagcaaaagagagatagaagttggtaatagaaaagtggaagatttattcagcgaatccttttaaaagagaggttgcttccacagggtaccaagactcatcaagtttctcaagtcataaatctgggcatcatctttgacctcttatctcaacccagattgaatcaatcataaaaatctcatcagttatgctttcacatatatctcaaatctatccacatctttctgtgctgactacaaatgcctagtccaaaacatctttacctgaattacaatctaaaatggctcctaaaacttcctatcccctgagcaatcccatgcataatccccaggactgggaatttcgtggaattcactcctgtgattagattatgttacattgcacagttgcaacaaaccttaaaataggggaatcacctgggtgggcctgaactaatcacctgagccctttaaaagcagagagttagccaggtgcagtggcttatgcttgtaatcccagcactttgggaggccgaggcgggcggatcacaaggtcaggagatcgagacaatcctggtgaacactgggaaaccccgtctctactaaaaatacaaaaaattaaccaggcttggtggtgggcgccagtagtcccagctactcaggaggctgaggcaggagaatggcgtgaacctgggatgcggagcttgcagtgagccaagattgcaccacggcactcctgggcgacagagcgagactccgtctcaaaaaaaaataaaaataaataaataaataaaaataaaagcagagagttttatctggcagccgtagaagagaaaatcagacgtttgaagggacagatgaatttgtcatgccattgctggcttgaagatggaaagtgccacatgctcaatcactagatgttgggagacagctggctgacagccagcaaggaatagggacctcagtcctatggtcacaaggaactgaactgtgctaacaaatgtcttgaaagtattttttttcctcagagcttctaaaataaaactgagttcagccaacaccttgatttaatcttgtgataccctgagcagggaaccagtcatgccatacttaactccttaactacagaactgtgagttaataagagtcttgttttaagattatgagtttgtggttatttgccacacagtcataaagaactatacacagtaaagcatggacctgtgctttctgctatacacagtaaagcatggacctgcactccagtgacatctgtgagaaagaagactgctcagatatgtaagagccactgggacatatactttgtataaaattcaaagcaggactgagactgaataaccctgtaggtttagaaggggagtggacactttgttttacacaactgatgaagttcagcgctatttaccgaaaacttttcccttatcaagttccaagtcccttatcatcatagagggagaaaaaggaaccaaaggcaggatctggacaaggagcaggataacaaaggtgggagagagaagtcaaaagtcaaccattctgagtaatgacacccccaaagcatcctccaaacacggagaagccacacagggaaataacatatgagtattttctttttgagacagagtcttactctgtcgcccaggctggagtgcagtggcacgatctcagctcactgcaacctctgcctcccgggttcaagctgcatcagcttgattcacctgcatcagcctgagtagctgggactacaggcactcgccaccacacctgactaatcttttgtatttttagtagagacggggtttcaccacgttagccaggatggtcttgatctcctgacctcgtgatctgcccgcctcagcctcccaaagtgctgggattacaggcataagccatcgtgcctggcccacatgaatattttctaccacaaaatgaattcaatctcaaagggatatctaaacccagattagatcttgtcacttctctgctcagattcctgcagtggctccccacttccctcatggtaaaagcatagccctgacaatggcccagttggctccactggatcaagtctttttttgttctgccctcatctcctcccactctcctatccggttactctgttccatccaccattggcctccttacttcactgggaacataccaggcatgtgcccgcatagggccttagcactggctgttcccttcacctggaattctcttcctgtagcgaactcaatggcggacctcctcgtctttctcaattctttgctcacttgtcatcttctcagtgagctctactaccttggcaaccccatttaacactccagttcccctatccgccttgtcctattgtttgtatttttcctaaagtatttattacattctaatatacgctatgctatgtaatttacttagttgttatgtttattacaccttcccaacttgagtgtaggcttctttgggcaaagatcagtgtatgtcttgtgtactgacatatcccccatacctggaacattataagtgttcaaaaaatacttactgaattagtaaatcaacattttgagactactggggaggagctcttgaacaagaaaatgatgtcaaagatagtgtatggttcagtacctattaattttaaatgaataaaataccactggaggtctacctagtgtgttgacattaagttgtatttcagaaatgaaaaatatttatagatatcttctgggtttaccccaatgctcagtatccatccattttcacactgtattagttcgttttcacactgctataaagaacttccctgagactgggtagtttataaaggaaagaggtttaactgactcgccattccatgtggctggggaggcctcaggaaacttacaatcatggcagaaggtgaaggagaagcaagtaccttcttcacaaggcagcaggagagagaagagagcaagagaagaactaccaaacacttataaaaccatcagctctcatgcgaactcactcactattatgagaacagcatgggggaaactgcccccatgatccaatcgcctccctcacttggcacatagggattacagatccctctctccacatgtgggcattacaattcacgatgagatttgggtggggacacagaatcaaaccacatcaacccctaagtctgttttcctcttaagtgatctgaactttgacttttcttgccataaggcttctaaaaatcttaaccctcatcattgtgttagtgagggaactgcagtagctttaagaagcctagctattgaacctatgactagaaggccatgtgacaaaacccattacagagaaagccctatggatttgtgaggttttacaggggcagaaggatctcgcagcagattgaggttttcttttcctaagttatttgggagacttcagaatcaactggaacttaagagcatcattctaaagcttgatacatagaagctcctacaggagatggggagggatgattacatcaaaccttaaaaatataaatatcaaaaataaaccaagccaatttactatccaaacagctaatgtatttaggcaaaagacttttaaaaagacaattgcattttttattacattaagtgcaatgtagagtggcaccgattgtctccacttcactctttttatagcatattttatctttttctagttaaatgtattcaatgctttttaaaaaggttgttaaaatgtacataacattttaaccatttaactgtatggttcagtggcattgaatacattcacaatgttgttcaagcatcatcactgtcaatttccaaaattttctcatcatcgcaaacaaaaattctgcactcattaatttttttaatatcctggaaatattgtctcagccattcttttcagtgatggccaccaaatagactaacctctggggtatagactaaaatggctaaaagtcaagcacatggttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgctctgtagcccaggcaggagtgcagtggcgtgatctcggctcactgcaagctccacctcccaggttcacaccattctcctgcctcagcctcccaagtagctgggactacaggcgcccgccaccatgcccagctaatttttttttttgtatttttaatagagacgggatttcaccatgttagcgggaaagtatttttaaaaatcattctgcaaatatgtatggatcaccctccatgtgccaggtgctctgtagacagaacagtaaacaaaacagaaaaaaacattcatgtagcttgcattctagcaaacaacacaacaatttcagataggagcaagtaatctaaggaaaacaagacagaatgataagaattgttttgtgtcttatcactgtttacatcctccacagtgtctagcacacagaatgcatttgacccatattcatgtgcagatgggttcataaaatgtctattgagtaatgactctatgcatgacatcttactgagtaccttgagggacatggagattattcagacttggagcttcacttcaagctccttgtaaatgatcataagaaacctgatatgcacattctagaggtagctatttgataacttatttagctttttccttggcctaaacccagtttttatttcatttttctttccattactctaatttcccaggccctttctaaagtctttgctcagcatggtctgtacaacttactttagcatcttcaaaatgttcagcagtagcaagaaatctaaaagcctgaattgtccaataaaggattctccctttcttcccttttcaaagccccctcccccaataataacaacaacaatccatcctcaggaacagttagatgtgtgtcaatcagataatgttggttcttggcactatctttgcatttaaaagggaaaaaatttaactggggcagcataagaaaacaaatgcaatgagatttttccattagtttaaattattctagatagtaatattccttagtatacaaatttagtaatagaataacctcaagtttacaatccaacgaatgtgttctatttattataatgctcctgattttgtagattggtagtatcagacagtggatagtggatctactatcaaatagtaattcccctctcatgctttgctgcataaactgatatctgccctatcaatctcatgagccaaatgtcattttctgaaggaaaaaggggttacttataattatggtagttacaaaatcaagtatatatatataacatatttaaataaattgtcggtagctgtttttaaccattgatggtgttgggctaggacgtctgctttatctccttgtctgtcagaaattataaagttctatttgttcaaggtgaggagagcatagtacaaaagatattaagtggcttcccttgggtaaataccagataaaatcatgtaattaaagagccttacttctaacttcccaatattatccaagtgttatagtagacagtcagtgtcctacaatgtctgtcaagccttgtcaccaaaaaacactggaacattgagaaaagcatgtggaccagcaaacctgctgtaaaactgatagtaatggcaccagccctaagcagcttactttctcagaaaaataatcagcctttttgatataatcaagtatgatacattttatctttcaatttaaatagtgctaaataaaaaacaatgatattatattgtggagaaaaataaagtgagaaaaatttatgtaactaaacaagaatcagaatctgcttcaaacatggtcataatcatcattttcttctcatttattgttctgggaggattcagccaggaatagacagagactttattaggatcagtgcttagtctgtttccccaggaagcagacctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctaagttccaggtgtttgtactgagatgtcagaggtattcagaaagaggctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtgatgttatgataaggtagacattgtgtaataattaaaacaggctaattgacatatacatctatcttacatacttatcatttctttgtgattagagcatttaaaatctaatcttttagcaattttgaaatatacattattaactttagtcaccatgctgtgcaatagatcactaaaacttatcccattggccttaaaagttttttttaacaaaagatacactcctcatgttctttatactatattgatttatggatgacctcactcaagatacctataaatgacctgtactgctgattaaccacctagagatctcttcatcccaaattctagtcctatttcccaagcaattttctatgcactagggagctgggccacagctattttctgaatgaatgaatgaataaataaataaataaagtggattttctgttatttatttgtatttattctcattgcacagagaattgtatagatatatagtacagaatgaatgaagtaaaagtaatgcagttgctacttactcacttttttcaatggccaggtatacttcatctatttgagtttatgttggccagatgggcacataattcagggtcagtgagttcaaatttctaaaggacaagtaggagacagttcctcatggctgccagccctatcggtgctctttcagaatgtggcctctggcttctaggattctggccacagttcaagttactgcataagaaataagaaaggttctgtggaaaactatgcccaataaagccttgtggagctttcttagaacactgaggtaaagggaaagcttctaaagattatgtgtaatgctgggcatccagtaggtgccctactctattccattcacttagcattattgagaacccagtttgaacaaggtattatgcagagttgagaggaatgcaaagatgaacaagacatagcccatgccctcaagatgctagcacgtagttctgtggtttttaagtttacccccacgtatcttctggagaaactgatgaaagccatggacctatgtttcaaaatatacatgaccctgagcataaaatttagctcatgattttatattaagtggaatttataattccaattatggaatgatataaaacattcaggaaaaaacttgtttattaataactatggaaaatatgtagtgtcataaatggtccaatagatatgtgaagtgctctgggagcaacaaaagggagaaagtaatcctacctgagggtataagaatgagcatcctcagggacatggcatgtgagtggtaccttgagggatggtgattgtagggcacacctggtggagggagcaggctaagtaaaggcacatacaagaaagccaagggaatgtcctggaatttaagaagtccagtgtggctagagcataggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagatagaaagagacagaaagtggaggtgagtaggaggctttcttctaagtagaaggcttttacaagcctagattagggcactagaatgtagggaatgataagaccacattaaagatgtgagctctaaaagccctttataaaatgactgtccacaggagaaataagatacaagattttcttgcttctaaagtgattaatattctgaataaagttaaacactggcaatgagaaattagttatcattcagatctgtcttttcatttaccttctcttattatttttgtaatccttggtataatactttaaaaataatgggcttaataaatccttgttcaattgaatgtttttagatttaatttatagtgtgacagctactgagtcaacaattttcatacctcactttgaataacgattctggtctgcagacacaatttaaggaatactgaataccttttcctaataggcaatggatgtactaccagggcctgtgaagattggcatgatattcaatttgattttacaccaaaaatatgttgtagaccttttcatgaaggtttattacatcatcttaaccaggaaattaaagtgaaactaaaatgttatctctgtaagacatgatgcttctctctaaggatccttagcaaagagaactaccttggagataaaagcatgctttcagagccagaaagacgttgagattggaagcataaaaacgcctagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcataccatttaattgagtccttcttccctaaaagatttttaaataccattttctcatgataagaggcctgaacaagggcataaaaataaattatttattttagagctcttaacaactaggtaatttgcacctggctttcttggccacagtgctcccaggaaattcctctgaatcaaaggagcatctctattcttcctgtctcttgtctaactccattctttaagttgtgctccatagcagtggttctcaaactttattgtctaacaaaatcatctaagaagctgattatacctagggatgccctggccacactctagacctatggattcaaactcgatagtttgagacccacttatggctctaaagaacagcccgggtttccaccaccatacctcttagctttagatggggctctgaattaactcacatagtagtctgaaaatgaaattaaacatttaactttaggagattcaaatctttaataaaatataaaaacaaagatattccctcattgaaaaattaagagtgttatatactgggcagtataaatgaatagttatagaccctgctttcctctaagctccaacacaaatttctctggttctaggtcaatataaaatctaaatgcaccatcatcgttctttgctctgtgccattgctcactgaacccacttcttcctggaatatccttccctccttatccccatctatgcactttctgctgtgttttaggaatcaacttgagccttacctcctcttccaaatctttacatagtttccagcccataaagcattcctgtattttgagctcctgtagcacttttctttttaatctgcactgtggatgtgggctttggataacacagtgtcttgtggtgatcttcagttaggtcatctgagtgtgtctttccccatgagacttacaatcttttttgtagtcaggctctcatattttgttaaatcaccaataacatcaaccataatgcattgtagagccttaaaaatgctggttggatttaatttctttgaaactattatggaatctagctgcttgttccatttcccaactctgtgtgtatatgcatatggcaatctttctccatatgttacagcctgcatgtatgattgatgcatggcaactagtgatacactgaaatattcttttttttttttttttgagatggagtcttgctctgtcgcccaggctggagtgcagtggtgcgatcttggcccggtttcacaccattctcctgcctcagcctcccgagtagctgggactataggcgcccaccaccacgcccagctaatttttgtatttttagtagagacagggtttcaccgtgttagccaggatggtctcaatctcctgacctcatgatccgccctcctcagcctcccaaagtgccaggattataggcgtgagccaccacaccggcccctgaaatatttgatttgaaattgaactaaactcgtaatcactgtgatacagtctctcatggatttataacatcatttcatccactaaagggaaaacaaacctcaagttatagaagaaagctcatattaagggacaaatatatttataccagacagagtgaggcaaagaattgaaagaatttttgtgagtggaaaatttttataattctacctgaatatgacagtaaattttaatgcctctctgtttgctctcaaaaataagaataatgcctaaaatttatatagtactttatattttactcttttcccatgtacattttcactgttcctcagaactctatcagaaaggatattattattcccattgtacaaatgaagaaacacttgaatcccagtgtctcagttcatgtttctctataagagaatataaatagtatgtatatataaatgtcaaatcccattgtatacctctgaatatatacaatttttatatgccgattgaatattttgaaatctaaaaggagagaaaatagattattattgcatgctcaatgcacttatttaatatctctatctcctccctctccgacacacatgtaagttctgtgtgattagggacctgtctattttgtacactccaattctagaaaccagaacagcactgcaacacaataaggactgaataaacacttattgtatgagagaagttataagactaagatggaagactacaaaatgcagccagtgagcagcttagggtaatgagtctcaggaacctagtgtcactcctgacattctcaaggggctaagttcctctccctacctcctcacaccccagttctgtgaagcctggcccacatgtgagctccttaaaagcaattttttcttaaagtctacttggtgcttagaatactgaatgaaactttccatttgagagttgtcgtaggaacaagacaatgcttatatgcgtgttcatctgttcattctaaggacattggaactttgtttgataactaaaagaatgagtctccataattaacttttctacaagctagcaaatgtattttaagaatctgctatatgaaagaacataatatggcacttcaaacccggtgtgtaaactaatcagaaatactacctgaactttgttcttgtactctgaagagtgtaattgcaatggaaattcatgccgggaatattgcactgaaggtcaggaaatttacatctagggaggggagaactgaatgcattttcaggagaaactatttatctttgttgctatggggattcctgcatatatctgcatatctcaaagaggggaaaacaagtcataacagaaacctcagacaccagtcaccctcactttaagcacggagggcagggtggagattgagggagcatgcgcatggatatacacacacacacacaaaaccacacacaacactgtctacgcacaagaagatatatgtattcccaatagcagatcaacagattatatccaatttccagcataactacaatttcctgttctcctaattaaagcacatcataatgcaatgagtgaccttcttagggattaagcctcaaacccttctaaaataatatgtatatatatccttatacaaatcactgttaaactgcataaattaatttatggtaatcagcttcttgcaatacacctcacaacctacgaagacatttcaggctgtcttgatgccaaaggactgagaactactgacttcaagaagcgcttcttatacttaaatgtgaatacaaactgcctagatatgttgttaaaatgcagattacgattttctaggtctgtgtgggagcctaagagatgcagcatttctaaatagcctgtgttttgttactacaagtgtgatgttggaccaccagtatcaccaggaatccattttacatccttgcaggtgattccattgtgaagccacagttaaggatcactattccataatgactaaagctaagtcactataattgtctactgacctttctcagctgcaagccctttgaaaaccttctaaaagtttataatcagtggttgtcagaatcacctggagagttttgtcaaaacccttttccactcttttatattttggactcaggaggtggtagagtctgggtttgagaattttgagatcatcaaatgctttagaaaaagaacatcatgcttagattcagaaacttggacccagcctcagggattcaagaaaggctggccctggataaatcataaaatagactaaatcttgaagttgtctttttgatatttttctcccccatattttatctaacttatatgattctactatttctaataaagtttatgacatcagccatctctatctagatataactaggtttgtcattttagcacttttcctacggatgcttggatttaagtcatctctgtgaatgaaggactccatctcccattaaaatagtgcaagatgtcagaaaacacattaaaaatatctcttgagataaacaaactctcctttacccatctgcaactctccccccaacacccgaacctagcccttttctacctgagattgcctggatttatagaaaaccattgaagctttgtctatttccatttatgtatgtaaagacaaatcttaggtcttaataattaatgcctgaaatcaacactattatcgttacttttaagattccatgaagaactaaatattaggttaagaatgcattttgtctattctcgatgtggttattgttaactaaggaatttcgttatgcaaaccgttgcctttcctagtatattaatgtaaaatatatgcaactgtatagatgagggaattcctcctatctcctgtgcctagtagcaggtgctctattaatggacgactggtttgatagctatttagtaaaatgcgcgcagtgccatctagtggttcatagtcattattacacaacctaaatgtcatctaaaatgatttaactagcacagcagtaagcaacatatttatacaactgtcagacttttaaaacaaacttcttaataacttcttaatgaatctcaacttagcatttctcagtgtcactatttaaataaacaaaaggcttatgttacttaaatttctcaataactaatgtatactgaatgcttattatacaatgcttattataagcactatgtggagtgctttatgtgaagtatctcatttgacccccccaaaacaacaatgtagtagagaaaatagtattgtcctcattttacaggcgaggaaactgaaacctaaggaagttaagtgacttgcccaaggtcatagggacagtcagtaggggaccccagccactgccccggttcctgcaccttctgcactatgcttacacctcccaaggtagtcgccaatgaaataaagtttccatgaaacctttgtgaaagatagcctcctcaccaggtttctaatgacccgatatggtaaaatcaacttaaactccactaactcaaaatttatgacaacaaaactaagtgtctgcttttgtggctgcaatgcactttgtgattcttttacttcacccacataatacgtcatcaagattatgggttgattaatttattgaaattgggatacttggctaaaatttagttttggactcacagatcttataaattagtagtagaatagtatggctttagatcagagtgtatttagttattttatcacaaatagctcatttcttgatcatctattatgtaaatacacgttctcttttaatctcactataactgcctctggatggcattcgtttcctcattttaaaaaaggaataatacaatgtataaacaaaatattattacattttatttttattaataaaatttgcccagttttgcagttatttccagagccaggaatgaaaccttaatctctgtggctgcaaaatctgaattctttccactatgccaccactggaaaataaggggtacaatgtgcgtgactgcagttttttctgcatagtaccaccttgtagacaaaaataccaccatcccttactggaactaaaacaatatgctccaactacttcccactgtgtgcctgtccgtctccgctcctttcttcccttaaagtcagaaatgacatttttaagctgcattcctgatcatgttgctgtcctacttaaaacccatgtcttcatactcagcataaagagccaaatccttattgtagttatggtgctcctgcaaccttatcttgttctggcccaatcaagaccatatcgtaatcccattttatacctagcatgctatatgtcacagtatgtcactatttctgatcacccgtttgtgtgattgtgtgagtcatgtctgtattcccaccagactgttagctcccataggcaggaaccacatctatattgtttgtattgagtcctcacaatctaccatagtgtttgcatataattatgaaaactagttttacttaaatcatttttaattatctattctcacagttagccagaattattttatttttcatgaaatatttttcttttacgttccttatattaggaccttcaatatgtaagcacataaatgcagcatatttatgtttaatacctttcatataatttctaggtatttgattataataataaacaactattgtctcctacatgacatgccctattccaagtgttttacaggcattattttattcagctgtcatagtaatcatccgaaagtagatgctattttcagttccacttttctaacatgaagattcagagaagttaattagactgacagtatacctaggattcaaaccagtgtctctgtgattcttcatgactatgccttattgcattttagaaagcaaatgcatccttagaaaaccctgtttcactgttgagtcatttctttgtcattctctcatttagtcaaaagacatttaccaagttcctatgtgtaaggatgtgtaaggcagtgtgaggggcactaggggtgtgaacagttatcacaatagacacagccttgtcctgtgccacatgcaacgcagaatgggaaacagacaaactgttggtctacacaagagtgcccactacatgctgtgatggggaaggacagagctctaaggtggtgcatgcaaggggtataaaacccggagacagggtttctgatccagcccagaaagatatccttgaggaagtaatgttgacgccaaggtatagtagatgagatgtagatgagaagtacacaggggctagatgaaaaaagaaaagaaagaaaaaaaacttcaatccttgtttagatttcaaattaatgggaagttattaaaggactttaagcagcatactatatatatatatattttttttttttttttttttttttgagacggagtctcgctctgttgcccaggttggagtgcagtggcgcaatcttggctcactgcaagctccgcctcccggcttcacgccattctccaagcagcatacaattttaagcagcatacaagtgatatgtcaaattacggtttagaaatcacactctggctgcagtgagtagaaagggagtacagaaagaatgaaaaaagaactgactcagccaaacagtaagcgtgatagcattgggtaacgaaattgggtggtggcaataaaggttcatggaaatggtgggattacagtgatgtttaggagatatacagtccataggactaggtcattgatagaacccagaaagtaaatctccctggagggagaataggcagcgggaggatggtggcattcaccaaggaagggaatcccagagccggcaaggggagagatgagtatgggctgctcaccctgaggctgaagtacccaaagaacccttacatgggcatgcctatgtgggaacccttatgtgggccactcctgtggtcactcccatgggcctggataattccaccactgggaattctaaaagggtttcctattccttacaatggctcgtcaagagaaatttaagcatccagattccctccctttgccaacagccatttagctttcttgacatatacccatctccctcccatgctcaagttcccagtccatgctcctctccccagatgtctgttccacatcatccacaaccaggaactaggtgaggataggtcacagggaccaagcaggacgacaggctggatgtcatcagcactgctttctttgcatcctgcacccagacacatcctgatgactagatccagaagattcacagatcaaatctatagggagtaattagaggaatcccagctcttcccaactagaatttaaataaataaataaatttagtttataaatgccatttccctgggagtgttttgcttgctagatagaagagttggataaataacaccaagaaatacaaataatttccttgttgattaattcttgatatacagaaaaggttgcaaatttgaaatcacttaaatctgaatttttccaaaactaataaatatttattttagttggtatgtgatttgtactcatctgctccaaatcagagatatattgcaatatatttttcttttgacatgactcacattatttacttgttcatctataatgcattgtctgctaggtaccaggaactaccactttttactctatgcatttttccattttaggaatgccagccccatttcatagatgaaggaagtgagactctaagtcttagaggtcatgcacttgtcgtagaagagccagatttgcaacctaggtctttggactccaagtccagtgctccttgagcacaggtatcttcccttcataacataaaacattattttgagtaattgttaaaattaacagcaaaaatccaagtaaaggacacagtaacggttctatgtaacctgttgttttttttttttagtttaaggatttgcataatctactcatctcttggatctcaatgtgcacacaaagttagttatgagaaccatactttaggtttttgtttttctttatgcctaatttgaaaataagaatgtctgaacagattgctctctctctcttagggttctgtggttacagatcctgcagttaaacctagcctgggaaaagggtctgacttcaaaagactgttggctagttggctcatttgttattataatggaagaaattggtgacaagttctcctataccaaaagtcagaaaccatagatctgttctgaaaagcaaaagtaagagagaagtcaagaaaaaagtcacatagctcaattcatagtagaagctgatgttagttttgcttattaggtatatagccaggagagagcaatgaggtagaagacaaaaaaatagggagctgttagtgaaaaaatatatatacagtgcatatttctcaaaaacggaaactgttatatttcattgagaataaacaaaatatttatttgcaaatgcaaaagcataatgaaaagtcaaccttaaatggtgaagatgtggaggaactggaactctcgtacactgctgatgggaatgtaagatggttcaactacttttggaaaatactttggaactttctttaaaaattaaacatacacttactgtgaaacccagccttttcatttctaagtatttacttaatatttttaatgattttaatattttgaatccctcattgtctaagagaaatggaagccacatatctatacaaagacttgtacgtgattgttcatagcaattttattcataaacaaaaactgaaaaacaacccaaatgttcatcaacaagtgagttgataaccaaattgtgatatatccatataatggaatactactcagcaataaaaaagagaaaactattgatactttcagcaatacatgtatgaatttcaaaacagttaacactaagtaaaagaatccagacccaaaaaagagtgtttaccatatacttacagttattaagaactgaagtttgcaacagaaagcaaatcaatagttgcctggaacagggaatgaggatggattgcagaggagcatgagaaaacttttgagggtgaggacgtgttctttatcttggtcgtgatcatggtttctgggatctcataacaagacctcagggcaaatagggaagaaaacagaaacagctttcttgactaccctagtgaaagtaaccatgacttaaatcagctggtaataatgtagccaagaaacttcttgttcttgaccagcctagttcagtgatgtgtgacttagttctgctgctgctgcagtgtatacataacttttcctttttaccttgtcttcctgcctaccttaactttctttttttttgttgtttccaacagcatactactaaaaaacacataaataaatgaaaacattttaaatactcaaatataatttggacatcctttcaaacactagaatttaaatgttggccttttctttttgagggggcagggtgtgcaatggggaaataacttttaaaccgatagacttggatctgaatgctagtcttgccattgactcctcttctacttttgcatttgtcagttcagtttccagatcctcagttttcttatgtgtaacacagggataatagctgtatttcaagagtgattgtgaagattggaaataactatctattgtggtggtcagtaaatcatttgcttgctattatgtaatgcacatcaagtcttagagataatgcacagcctatgttcatttacttatgttgaccccctgcaacagctgcacacatgtgagatacctagaaaaaaacaggacagagggtcatgtaaactgatgtatttgccttccattactttgggctgatgtgttaactctgctttaattgtagtgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccgtaagcaccctctgaatgtctgttcctctctacatgtttggctttcacttcctgtcttacttggtctttttcccaaacaattttatatctctctctttttttttttactctcttttttcttacagtggatgcttatgtcagtaaagtctccatgtgtttaatataaattttaaatcctgtgaaaaagactagagagtaaaatggtgccagaggaacttgaggacaattgtattttatgtgctgacctttagttatctcatcccatgcttcctggaagctgtggatgcttgagaggattgcctgtggtgcgatttaatgaagcgtgaagtgggaggatctttttaactctcttctttgcaaattgtttaagacagtgtttctgaggtgtcctaacaaggccctacagcaaacaagaaagaaattgaaaagggtttcttgactatcccagtcaaagtaactatgacttgcgttaaatggactggtcaatttaagtgtttcgatcataaaataaggggatgctgtccacagaccacaactgaagctcagcttcatttttgtataattttcccttttagaatcagagaatttcagggctggctgagatcttaaaggctgttcgtccacatatctcattttacagatgaaggaaatgaagcacaaagaaattgtcacttgtttggtgtctcgcagcatgttagtggccgagtggggacttaggtgttcaacaaaggtttctttaccaaggtatatgtggattcccctgaattacattctcagcctacaatttcaagagggctttttgccaatagcctccaacctggacgtagtaccaccccctccacttccactgcttgttttgaatattaaaaaggaaaattgctaacctgacctttcagcaatcacattttgagattctcagaaggttttacttagtctcattgtctggccaatgcttggaagtatttacccccgcagtggagatgttccagccaggctaatgttattttgcaattcacaaaagctaccagctgtcactttgcaacttagagtgttaacagaatcgttcctgctcagtttttccagtgtgcattattgtcttcgtgatatttatattttgagaaattcttcagttaaaataaacaattttacaactagcattccaggttggtagagtctttgcttcggctgtgcacacttcagaacgagatgtacagctctagcttaatcactatagtaactggatgctggggcaggtaaagaggactgtggttccacatgacaggcagcagaggcagcagaatggaacctggccatggcatttctgtagtggcatttctaacctggccctgtgacaagagtgtggcagctttcagatttgcccctaaagatgtcaagagacttatttgttagaaatgtaacaatggaaactgcaaaaagagaaatataatatctcactaaatcctggagtactgctagagaactcataaagaatcaaagccaaataatcatttgcacccactccataaatatagaccagaaaccagactaacaataaggaagggggtattttgtgagatatataggattcacacaaatatagttagatttttcacttttggtcagaaatatttgctagatcacttctaaatatagagctatgaacggtctctaaatagctgctgaaaatatagctgaatcatttcaagattgatgaaaagctaagtttgacatctattccaaggtaaggaacaattcacaaaaaagttcagaagaaatctttatttggtgcctattcttcgtatagataggaagcctcctgatgtgtactttcaataatctcactgtagtagatttataaacacatccacatagacaaatttcactgcaaagatttataaacatatccatgtagagatcctactctgcagacacttctgcgtttgctccttcagcgtagcaaatgagcataggcagtcctactgacactcaaattttccatctgatggcatggaattttggatgtgaaatgtaagccatcaggaagtacagctaactggatatgtaatttagaagtgaatataagaagagaaacttaagaataaaataaatgttcaaattctatttcttataatagtaaactccaatttatccaaatgagacccagcgtggaaatctgatgccacttcctaccacctgtcccacgacagagtccaagtgtttaagagaaccgtctgtattttggcagacatgaatgatcctgatactactaaaagaaagatgtgctgttgctattacagaatcactgaaacatttaggagatttttctcccatttgtcgtattttaaatggacatataaataaacagggaaaaaatccaaaataaaaattagagatgccttaagaacctagactctgaagaagagttgctaaaaataaataaataaaaaagaaaggcagtatagtgatttaaactcatgaagaataagaacttggattcaaagaaacttggccattttgtgggggaggggatggtgccttaaaattcactagactcccaggtagttgaacttcgtgaagaaagtggtaacctgagatgaggattgatgcctcctttactgggatgtacttctgagagccagacttaccttcgcacagccatagctccccaagaatagcattccctctcccaccaaaaaaacatccggatctcaattttcataccaggatgcttactgcagactgtaatcagtttcctggttgcaagatttctctctgctcgttggcaagtcagcctctcagaagatatgataactacatctgtagatgatttgtacaatgttgggggtgggcagtggaccccagtggtttatgctcatgcttgccattctgtccctgaagacacagttccttgagtccagaagatttttgttttttgtgacattccttttaaaaatggctgtattcctgggagggggtcacccagggagcagttaccaaccaacttctaagcaaatctctccacggccagaggttatcttttttaaggcgtctagtggaatggatgagtgtgcctgagaaggatgggaaaagagatgtcagaaataagaccaggggctgagagggaagaagatatgtgagggagcagccagaacttgagccagtctcttcctcttgtccctttcctccgatcaccccaggaactggcctcccacctccccttctttgctgccaggagccttccgctcctctgtctcctccagaatccccccagcaaactggcagcagcttcttctgtcacctcttgtccatattctattgaggagggggaaaactctttgaagtcttcaaaggacctttaatgttgttcttattattttgtaggaaatagagagtaactcaaaagaaaaatattgcagaaagttaaaagatgaaaataattcttaaaagcctataatgtgcagcctttttgagaggtgcagtcacaaactctgaggttctgtgaagcctttcgcctgtcatggtcaagttgatcacctttccacaggtccacctctccttgcacctgattctgctattgtcttatagtgcatgtctgactgtttatatgactgcctcccaaagacttctttaggaaagaaccatattttattcttcttatgaacagcacctgagaccatagccaacacaagaatgaatcaatgaatgaaaatccaaggttgatctttctgagctcttgtcgtactaatttcttttaactatttttttttaagaccgagtctcactctgccgcccaggctggagtgcagtggcacaatcttagctcactgcagccttcgcctcctggcctagagcaattcttgtgcctcagcctcccgagtagctgggactacaggcgtgcaccaccacacctggctagtaattgtgtttttagtagagatagggattcaccatattgctcaggctggtcttgaacctctgggctcaagcaatccacctgcctcagcctctcaaagtactgggatttacaggcatgagccaccatgtctggccagttttcttttaattctttttctgagattaagtcttccttgatctccaatatattacaaagactagcgggtcccagtcacctagattcagaccctctatttttacttctgctccacagaaaaaaaaaacaagtgttcatggttaccaatgttggtgatcctatttttacaaaagacttctatgtactcctctcaccttctccctgcttccccaggaaacactaaaaacaagttgtcttgactcaatctcatttcaattcagtagtatcttctttcgtaagacagttcttcataaagtagattatgtgactctagccttgtttttagcaaataacattatcatatatactcagtcactcaaaaatcatagtatgacagttaaaaatattaaaaggaacagtgattttcctattttcagaggtcaagctatagtcttccatgataatcataataattgtattaaaaataagatgtactcagtatttactatatgtcaatagtcttactgacttggccctatattatcatgattttccagtagaggagatagaaagaggttaaataatttgcaggtcatacagcatcatactaaatgaggtaaatgagggaaaactcattttgtttcaggaactgttttaagctcagctctattcatgctttctgtttcactttttaaaatgaaaattaattaaccttttttctcccagacttgttttgcttattacaggatattattctgatgcttacattcctaatctttccagtttctggtatttatacacatttgaaagagtgtatgtggaagaaatatttggacttaacatgttttacattgtagcattaggatcagttttatgacagctacccagaactacaagtccatcacataatagtcttacgtagagaatacaaaatcctggtattttcctccctgtttgccatattgcaccttactgggccatttgaacacccatgcccactgctgagccttccaatgctacaaaaaagaccacagaactatttcaaatgcatggatatgaaatgcctggtactctgccaaaatccttctgtctttcgaatttaaaaaatgattcgatatttaatgcaaaatgtactacaaagtacacaaccatttctctgcaccaaaaaaagtattgttcatgtttgagactatgtagatttgtgaaagcaaagaagaaaaaaagagaagagttataaaaaaccaaatgttcttctcttttattatctatacagccaagactagatatttaaaacagtgtttacttggcgtggtgacttttttctttgcacgtcttaaatttcaagatgtccatagaacattctcctctactaactaaaatcttgttgtagtgaaaaatactttgttcaaaatttctacatcctgctaaaatggaatcactttccaaagaattttcacagctgtagatacattaaatatcctaatgtcactcgttgtttatctgacatactttgaatgagtagcaggtagaatttcaagagagatgaggaatttcaaggggtatgggggcattccaacagtattgaccccttctgttctggagaaacccctagcaaactcacctgccccggcgctataaggagtacttttcccagatgttttgctaacattgtggagggcccagagagaagccagatccaaataaagggtttctgtctgttcacaggttaacttcactacgccccaaaccagagttaattatgcctgtgaacacttctaaattcaaagcatcacataactgcacaatctaaaagaaacagccataaagccaatcattatcatcgtattcaaacacgttatatttctcaatataaatctcaagtggtaaatcagaaagttgcttctcacttgtgcattcattaattgaactgacatatgtaaagagcttgctatgtggtaggtgttatgataggctgggaataaatgataagacaagatgaaatgagatgagatacccttggaaaatgggttgtattaaaattaactgtttctgaccctttatctccaacatgttgtgagcaaatgaagagtagagaccacacctttttcatctgtatatccccaacctctaggacaatgctaatcaatatttattgagtgactaaatgagtgatccatatgagcaaaataattttcagataaaaaatgtgttatagtagaggcatgttgtggaagcagagggaggaagcaattctctccgttaattaagccaccaaaatgtgtgagaaagagcagtttgagtgctgtgcctctgcttatcaaaaatgcttaccaaatgtttttgtgaaatatgttggtaaaagaagagcttctgattttagtactcttaaatagagaaataattccttctgtctgtttaagaaagaatcagtcagaattgaatcttacttaaaagaacttcaagtttctcatgggattttgtaacttcaaacaggaaaccctgttggcaattcggagacaatttacctcctgtacttagcatccagccctaccgatcaatatctatttgttgttttatcttcttgtcaaaaacaaatattctcttccctgcaacttttccatataaataatatattcttagttggaagaaatcagtatgtctctttataagattatgggaaacccagggcagactaaagcagtttctcacttctttattatgacaagtcaaattttgaagtaattcaaatttttaacataaaacaccctacaaatcactatatatattttaaccaaagggtaagtgccttcctctttccattttcaatcagttgtcccctagaataacttgaaaagtctcagagtgagaaaacaaaatgtaaaggaagataaaagatttcaagaaacattgatttatgaagccatttcagtttgtgcttttgataatttgcatatattagcctggttctcttaaataccttgttacatgttaattatataccaatacacaattttattgagaatttttgaatgtcgatctagaacaagaaagtaaagtttgtataggcaaaagttccagggtaattggcttagaaacagaacatattccactatgccaaaagactataatggagaaaatgaataaagtatgtattatgcgctgttttctctctgcattgaaatggaaaacattacaaacaaaatactattattttattttaaaaataaaataacttttttttttttttttgagatggagtctcgctctgtcaacaggctggagtgcagtggcgcgatcttggctcactgcaatctccgcctcctgggttcaagcaattcccctgcctcagcctccgaagtagctgggactacaggtgcacaccaccatgcccggctaattttttgtattttagtagagacgggttttcaccatgttggccaggatggtcttgatcacctggcctcttgttctgcccacctcagtctcccaaagtgctggaattacaggcgtgagccatcacccctggccaattactattttaataataaaatgatatactaatattaattctttaagctttttctgtgccttttatattaccaaagaattaactgtactagcagccttaattcacaaagaaagacttacatggccatgtgattgaccacatcacagactcctaaggctgatcccgcccctaaaagtctgtgattcatccagacttgtgccctgtgatgcatccagtctctcaaacacatctggctcttttatgtcttgagatggcagtcagaattgcacatgaagttgaaggcatactgccatggcttttcataaaagcaagagaagtatacagactttttctgtgcacttcctgatgctgccccactcccaggctgtttggcctgaagttttagggaaaatctatgtttttcaacctcagcacacactggtggttggcttcctgggttgcagctgacagccagcattccatcggtgcagttttactaccttactgcaaaggcattgccagagacatagtcattttggagcaatatgctgctttcctgctcgtttgtacaggactctgaggagcttcccattatccatcctcatgcacttgtctttctgcttcctagacacttaacagattttattggctgtttgtaaatcaaactggtcccaactaatgacaattcctgatgagcatagctcctaaatttttccatttgggatgtatcagcttttctctactccttgcttcctgtgttaatgccagtgccttttttcacaatgaaatagggaccctggtcccatgttttgctcaaaatatgggctgataaccagaggaatatatgctacctaactgtggttggctaactagccaacagaagacgcttttcactttgggtttcataaaataattttgtgcagaataatctcacagtctctataatttatttaaacaaatcttcagaaacataatttttttgttagagaattcctgaatttgaaattagggtaactatagggactttttcatcacaaatttttttcaaccattatttcctactcacaatacaactgtgcttatgtgatatatttactcttcaaaaaaagctgatattttttaaaggccccctctttaaaattggacaccctcctcttcaccctgttatatttacaaataatgttcttttaaaaaagatccatttgtatttaagtctttagtgctcccattctctgttgtagagtcagtcatctctgctcactcctcaaaccgcataaatatttatccagtgcctgggataagcaaagtatgaactcacccagttttggtgtgcttgccacgacctaaatccctgcatacccccagaatccttcttcatgacagagtcacatttgcaatctggcacagtagcttgcataacaatagattccagtggcctaatttcacccttgagttcctgtaaaaccctcattcggctgccctccacttggtgatttatctagatttattgtgtcaatttggcagaacagctctgatataaccactgttggatctagtatcatcaatcttccatttccaggaacaatacaggactggcaatctccccatgatcttcttcattaaaagctgaggtctaagagtacacctatgagctatcattgtttcatcctttggagaactctctgttccaaaatcattggtggtcaatcctctccttttaaataaattattctctcggattcattgaaaggaactgtattgctcttgaagcctcacatataatgctcctcgatttctttgcattttgagggccacattattgctatgtgattgctaatcttccataccttgtagactttactgttgtcattatttgaaccatgttacagtttaggaaaaaagctaattacctcctgaggtcaaatgtttgatacttccagttatccatgtaatgggaggacaggaatgcttttgaataggctggtttttacaaaatcattgcatttctattacagctacctgctctaaaattaataactcactgagtggatggacactcaaaattctaggtgtaatttttataatgattactaatcatttcttaatataagaaatgtattagtcactaactctgtgtgagaccaagtgctaggcactaggaattcaagtaattcagaaaacatcatctctgcactgaaggatctcacaatgtagaatccagtcacattgtggacatgtaaaaatcacatcaaggtcattcattgtgacagatgccacataataagtaaaaagtgaagggcagagtgatttcctagacatctaggagaaaagctgttttcagagcagggtgaataatgatattgagtggcatcttgacaaatggatgggagggttgtgggcagaccatgttaggagggggaggggccaggaggcgttgaacagtttgaccatggtgtgcagtacaacaacagaaatggtagcagaggagactagacgagactgctgggtgtgccatgagcaaacgttagaacttcgtcctgagggcaaaaggcggccagagggttttaagcaatgaaataatatggtcaaatttgtgatatgagtgtgcaagcagagagatcatttcagaggttatgaccgtgttaaagcaagagctgatggaagcagtgacagtgggaatgaaaagaagggaatggattcaacatacaggtaacaagtctagctgagtccttcaaacatttgttcggagtggtagtaattaaggaagagcaagaaatcaaaggcgaccccaactcaggattcattttcaggtaactaggtacatggtgtttctaataaccagcagaaggactgcaggaggaacagcaggttagtactacggtgagtctgagtattatggaagagctctgtaaagataatgagttctcttttgaacatacttagtttggcatgaggtatctaagtgaaggtttcagataaatgattacataaatctggtgctgaggcttagaaataaatatgaaagagtcactagcatagggttcagtcaattttgcattctggctggttgtatttgaggtattacactaaaaatgacagcgacagtgataaataacaaatgatccctctctgaaacctagtaaggaacaaaaccacgattatttatatcttatttttcttatatataaggcatatgaatcttattcatataaattatttattccatgtactaaagctttgccaatacaagctttacttacctttcagacacattattattttaaataactcttttgaccattcttaagattagcaactatcaaataaatgaattactaatatgatacagtttctgattccaaagtataagaataaacagttgattccagctggaaaatcatttagctgaaacattatactttttatcatatcccctttatatcacatttgtgaaggacagatttgttatacttcctgaatcaatgaggatttggcagcacttgtgtcatttgggtagaaagaaagtgttcaaacagagcttttactttttttttaagacagagtctccctctgtcgcccaggctggagtgcagtggcacaatgttggctcactgcaacctccacctcccgggttcaagcgattcttatgtctcagccacctaagtagctgggattacagacgtgcaccaccacacctagctaatttttgtattttcagtagagacaggatatcaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaaaagtaaatatatcacataagcacagttggcttgtgggtaggaaatgatggttgaaaaaaatgtgtgatgaaaaagtccccatagttaccctaacctcaaattcagaaattctctgacaaaaaaaaaaaaaaatgatgtttctgaagctctgtttaagtaaattatagagattctggaattattgtgtgcaaaaatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagacagttcttcagatatgtgcattgaattgttttcacaaccttttataaaatggatgtgcccacataaggcatgcagctatgtatcctgtgatttctacagaatagaaaatgtcaaaccttgttgctggaagtactccaaatgacatcatggttttgttttgtttttgtttttgttttttttctattaccattaaacagggaaggccatggtaaaatttcagtatttgctgtcaaaatggctttagccacattgtgtggagggaagatcatggacaaattaagatgtaagttattattccttgtgtgtctgtttgcttttccttgctaggtaccacccttttctctccctcattcctctatgtcccctccccatttgtatctttcctcattctatgagagttgtttgaaatacatttttcactgatgtttggattttgtcatagcgatattttcatattagataaatgctaatgaaatgaatgttttcctctacttataacctgttgagtatcaccaactggcctctttctgaaattaaagtaaaataagcactctttgcagttaattgtgttatactgccttacacgtggtacaggatgataggcacgtgaaggcttagtgggaaaccttcccctttaaatcttctaaaagcaagactcttggcacatttcctcattcttctcagccagcactgttcaaatcactgggaactccaaaggtttcaaagccaacaatgtcaggaaagaagaataggaattacatagagacagcattggcagagttaactagatgccagtaaaagcatggtagctaaagtacattgagtaattgtgggccttaatgaacattttgtctctaaatatggtagagttccttaaccaacgacacactggggattgtttgtttgtttgtttgtttgctttaggtaaagaaactgagactcagttaaccatatggctaagacgatgccaggatttgaaccctgacttttttttctacacaggtggttcacaaattttagcatacatcagaatcaccttgagggcttcggtaaaacatagatttctgggtcccaccccaagaatttctgactcagtaggcctaggatgagggtgggtgaaaagcatatttatttctaactagtttaaaatgatgttgatgccgctgtttaaatttaaaatttccatttaaccctatccttttccctaaatagtatgagttggggctataatgctgtgttagaaagggcactgtcctgggaattgggagttccaggttgcaagcccagctatgtgactaatttgctgagttatcctttgtcagttacttcacttctttagtcctcagcctccttctgtatcctaaattttgggattttgtaagatacccatagaatcacacctggctgcatgcagccatctgtgtggctcacagcacaaggctcacctgctgcctgtcctcttctgagtgagatcgcttgcttcttgatccacccaaaaggaaagaataaaggaagacacagaacaccttttgttcctttgaaatttccctggagatgctccagggatgagtcattccagtggaccagtaagtaagtgaaagggacaacaaagcctcaggtagccacacagcttccctcacttctgggacttccctccatggagagccaaagacagccaggattcagagaagcctagccagaccttaggaggagccatgtagcttctcttttgttagcctgaaagatatagaaaattaaaaactatctacctcagtgcttatttgagagataatagctaaattagaaggtgctgacaccgagggcttttttttttctttttttttttcaaaaaaaaagaaaaaaaaaaagcttcagagtaatcctcgggcatttccttcagggttaagccagaaagagaaagtttagcaaaatgaaccaaggctaaggaaggaagttctgagaaccttgtctgccaaccccaactggccatttacgaagaggacattagataaatgtaaaaaacaaaacaaaagctaaacaaaaaaatccacttgagagacatctaaaaatacctgtttaatattatattaataggtacctggatagaagggtcccatattaaaataggtttaaggaaatctaagaaaaccagttttctgcatctcagaacgtctgtcaacctttaacataccaggctaattctgagccctcgaagtcctggtgtttgctgtctttccactcagctttgttcagtgtaagatttcatcctcctccaagagtaagggtggagggtgagggaggggggcttggtggaggtgacagtcacaggagtcacatctcactacagaggtccccaagcccttacagctcatcacctaggtggcgtctcagaccaattactaaactaattactggttagagaaaaagtatgacagcaatggccattgtgtaatccactttcacctcctgtgctcagaagggccatccctttccctcaacccatgagcaatccatgaacaaatgtgggtcaaataaagatgaagggaatggctggtaggtaagggactagcaatgtcagcacagttacaaagttcaaaatataactaagttattgattagatctttacaattgtgaaaacccttccagttctctcttgggcccaggagttcaaaggaaacagtataactgctacagtgctttctcctcaccccatcccatcaccctccaaaaagcactctctagtggccaaagtctatcctctttagggcagtgaaagaagcaacaaatgcatgtgtccccttggaggtaaactaagttttctagtctgcagaaacaagcccacaatatcacagattctgtagaaatacagatagtgtgaccccgataaatcgcattccccactttgagagcagtgcacctgaatcacacccttatgtgtccctggttctctgactgaggagtcactctttgtatagttaatcctgggaagatggttttagcagtttccaggtaacttggttaaaatcaatttgaccaaaaacaatttagttaaaggtaatttggtcacaaaaatctctccagaatgttaactagtcaaaaatgaatatcctgagttatgaatatttctagtttctgtgataattattaatggaatgagcgaatgtgggcaaatttacccacaaaatctgcccgcagagaccagtggctgccccttggtgagtgggattgtgggtgttcctattgtattcttttgctggcttgcattttaatgataaaacagataaggtagccaggcatggtggcacatgcctttagtcccagctacccagaaggctgaggcaggagaatcacttgaacccaggaggcagaggttgcgtgagttgagatcacgccactacactgggcaacagagcgagactccatctcaaaaacacaaatcaaaacaaaacaaaacaaaaaaaacaggtaaggtcatgattttctacgttgcttctgtaataagaaaaagtaaaatgaagggatatggaatgtttcaggcttgagggttttgttttcccttctttaaagtttttctaattcacgttaagccaaaatgccagctgtgcttgtttggcaatttttctatttttgtgcatagggttgagagatatttagctcgttccagctactcccttattgttggtgaacacagagcaagaataactggctgaaaataagtcggaaattttaaaaaacaaagagaaagcaacagaaaatttgaagttgattttcttaacgctttaaaatgcattagaagagaaaacaacactatgttgcaacataatttccagtaattagggcaccattcagtggtagggtgttccctgtgtaattccagggagcatcattgacacagcttaggagatgaagggcgccccctgcagtcatgtgccatggcaacctaaacataaacttacctaataacactactattttgtcagattgttcttggcccaattataagctgttttaatgggttggaacatttgtttatacttctgtcttagggctcctggatagttctaaggatcttaagggattctaaatccaatgctgtaagcctggtatgtcatgtgctgttctaaagctttggggaggactttttaagtctttttaaaagactagtattatggaaaatactgcatatttattgagtttctattactgaactggttgttttgcctctacgcctacccatagactttctaacgcactgacctactttaaattcttcagtatctccctcagcatcttctggacacaacctaaactcctcagtacaattcagccataaaaaagaatgaaatcctgtcatttgaggcaacagggatgagcctggaggacattatgttaagtaaaataagtcacgcacggaaagataaatactgcatgttctcactcatatgtgggagctaaaaaaaaaaaactgaactcatggaagtagaattgtgcttattagaggctgggaagggtagggggctgcaggaggttggggggatagggagaggttagctaatggctacaaaattacaactatgtaggaggaatacgttcgagtgttctatagcactgtagggtgactatagttaacaaaattttattgtatattttcaaaaagctggaagagaagatgttgaatattcccaatacaaagaaatgataaatgtttgaaatgaaggtaacgcccattatcctgatgtgatcattacacattgaacacatgtatcaagctatcactctgtagcccataaatatgtacattaatttttttactcagatagaatctctacagtctcatggttaataaactatttgaaacagcggaaaccctttataaatggagtatttaatgaaaatgagagtcaattcatgttctcaaaaccataatccgataaaagcctctgatatgcttaacatctgactttggtgtaaaaacaatgttcccagattatattttgaccttgaaaaattaaacctaaagtgaatagaggtggcacattcacagcagtttatcccagcagctgtgctggcctggtgacaagctagttagcatggtgacaaactatataatagcaaaccctttcattctaatagtgatttgcacagaggaattataaaacaccttgggaaattatgccattaatattcattaaatgcacatagtggcagaaattgaagaacagtggttcagtgaagccataggcccttcagagaaagatccaggaccctgactttacctcattgatcatccacaagaccaggcttcctcttcactacacgagtcagaaaacccttccctgtaaatcaagtgccttccacccagaaaactgtaattcatagaaagttttcttcttctgtaggaagttaatcaagtgtttgtcattacatctttatcctcaccgtgtctttgattttcaaatatcttacaccaaaatccgaaagttttagtgataatataaattggtaaatttctagctagataaatgaatatacgcacaccccaactttatagtaaaactctcattgtgtttcaaatgaagtcagcgtctctctcatatatacaaaaatttctcttgttgagctacatgagagttaatagttgacctcaaaacaaaaatgtagtgtcttattaaagacatttaataagtgtctctctcattaaaatgttaactttacccaaattacttgtgattgctatgtgccagaatcatctacaaaaagaaaccagagaaaacattatgccaggaatatttcagcataaaaattagcttttatattattctttcataaaaaatgtttattttgctacttttttgtcatttgtagcagatatattgaacaaaaacagtggagaatgttcatgtgatgaataatatctttccttttcctttcatcagatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacaggtaggagaaaaatatgtttaaggaagtatctctttcaaacagtggttgctctccttctagatgtcattccaggtcacagatactcagacaaattattctgtgtgatagcaacctgtattgtatttttcagcctctggcaaatgacctctgagccagtaactaaacccagcacatctggatcacaataatagacagtgtttactgaccatgaggcaggcactgtgctaaattttttcctttcattgtctaatttaatccctacaacaacccttctgtgttagtctcttttcacactgctataaagacatacccgagactgggtaatttataaagaaaagaggtttaacagactcacagttccgcctcaggaaacttacaatcctggtggaaggtgaagggaagcaaagacctaccttcttcacatggcgacaggaaagagaaagaatgaaaagcccaggggaatctgccatttataacaccatcggatctcctgagaactccctcactatcatgaaaacagcatgggggaaccaccccatgatccaatcacctcccaccaggtctctccctcaacacctgggaattacagttcaagatgggattgggtggggacacaaagccttaccatatcacctacaccctcagtgtcattatttttactatcactgcactttcaaaagggcttaattgtctcactcagcctcatgtgaaatatatgcttgacccggcaacaagctttaacattggtttagcaaaggataccagaaaggaatcccaacatctgccacatcatgacctgagaggcccaaaatatggtaaacacagctgcctgaatcttctacagcatgacacatttggggttccaagtgatgtgttttaactgggtatggctcaagctaccctgggaagctgcatagtttagggggctatctatgtgtgtacctctctggtcatgtagagagactccaggcccattctccagcgtagcccagtggtagcatagaaatccatacattaaaggttagtttaccattttttgagaatccaaactaacttttttgtcctctaaaaatgcctcttgactgggtgtggtggctcactcctataatcccaggactttgggaggccgaggctcaggagctcaggagttcaaaaccagtgtgagcaacatagggaaaccccatttctacgaaaaatttttaaaacatagccaggcatggtggtacatgcttgtagtcctagcttctcaggaggctgaggcaggaggatagcttaagcccggatggcgccactgcattccagcctgggcgacagagcaaggccctgtctcaaaaaaaaaaaaaaaggtatatccctgccccataaaatgcatacaacaaatgctcactacacagctttatggattaagagtcaggaagtcttttctttttactgaaattaacttttaaaagtgtcaataggccgggtgaggtggctcactcctgtaagcccagcactttgggaggccaaggcgggcggatcacaaggtcaggagtttgagaccagcctgtccaatatgttgaaaccccgtctctactaaaaatacaaaaattagccgggcatggtggcaggcacctgtagtcccagctagaagcaggagaattgcttgaacccgtgaggcagaggttgcagtgagccaagattgtgccactgcactccagcctgggagacaaagcaagactccatctcaaaaaaaaaaaaaaaaaaaaagtcaatcacttcaaaacacaaatctattttttcattcaattttactgctttccaacttttctcatggcatgctaaatgtatggctccttttatttttacagtgctttatgcctcacaaagtgaattatctgatttatggcttgcaacaaccctgtgacctaacaaggaaaatatgattcttttttaacaatataaagttcatagctagtgagggcagggggctgagtttttaactctggtcttctaattccatctgttaatgttattcttgtgttcttgttgttgttgcttttgttttgtgcactttcagttcatatttacaaatatgcagatgatctgactcaaggaaatgtaactacctgttgtattacttcacccagtcatggaaacaagaataatttcatttataactgaattcttgaattttagttagtgtattatagaataattggtaaatgtgctaatgcctcagaatatatgtctcattcaaaatcagctagaataataggactgggttttaaaaaaaaaatcttaaaaggacctatgctggtgtgatggctcacacagtaatcctagcactgagaggctgaggcaggaggagagcttgagtccagcagttcaagaccagcctggacaacatagtaagatctcatctctgaaaaaaaaaaaaaattaaacaattagccaggtgtggtggcacacacttatagtcccagctacttgggaggctgagatgagaggatccctttagcccaggtgttcaaggttgcagtgagctataattgtgccactgcactccagcctgggcagcagagtgagatcctgtctctaaaagaaaaaaaaaagagaaaaaaggacctatgtgttcaagaattatatgtgatgttgacatgttcaaaattccttttgaaatatcctatagactgttctgttatatgatttatatatatccttaatgataagcaacttatacatgttgaaatcataatagcattgttggaaacttccaggagtgctttttagcaagtatgacaaatagtcaaaatgaataagatcatttcaaatatgaaaagaggtaacacaaaaataataagaccagtttatttttgtacttaatgaattggctattaacagctactcaagagtctgaggtaggtaggaggaggtaggaagacagcttgagaccaggagttagagtccagcctgggcaacataatgagaccccatctttcaagcaaataaataaaatattttaaaaaataaataaataaaattatcccatcccctttgatattctagttcaaaatttcaagtagtgatttttgcatataaatatgtatttttttatttataccattacagtacatgtattaatatagctttcttacttttatcattttgaaagaaacttatagatacaatgcattccttttgtacatccaaaaggacctggatagtgagaaagaagcagactgaattgagaggaattatatataaagtaataaaaggagcaaatttttaaaaatgtagatggttctgtcctaacaggattccctcctgctcttgtataacagaaccattcacattaaccactaaatatttagtacttaaggaagttgaggaagctcagaagggaagttgttctataaatttagaagactgactgacaggaaaattgtagagtgagctatgatgcgttcttgagtaaaattccatggagaatttccattctttattttgcttcattatttttatactgtctttcatatatacaaatgatgctcttggaattgtttttctcctggtgatactattgactcagcctcagtggagagaattcagtcctatgtctgcttaggtataaaaagcaaacgatgttttcagttctaaactagtttaataacacatttggcaagttctgtttcttcagatattagacatttattgagtgctcttttgtttcagtctcaaatgatatgatatttacatagcaggtaaattgagatgattctctgtcctaaatttatggggggtttttttatgcagaaaaaagtcacgttaaatggtttcttggacacgcttatgtcagatcctcccccgcagtgtctggtctggttgcctcttctgcatcgactagcaaatgtggaaaatggtgagtagttactaaggagcaaaggtgattttttaaattattgaaattaggccattagttctacagttagtaagcccaggctgttgttttagggaagcctatttagtggctcttagttttgtttagggtagaactaacccatctccctgttcgggaaggccttaaaggaccactgaaaaattaggactgtcagttccaaaaataaatctcatggtcttcttctcaattacaagtcaggtgtggttaaaagacttggcacgatagaaggcgaacttcaacaaggagtgtgacattattttgtatttgttttagatccgaatttctcatatttgcatacacggtactgattatttcttcccaggcactcagccagaaataggtgggagaaatgagaaaaaaaaatagatgatagcaccctgttaatctttagtcatatgttccagattgtgagctttcaatagttgtacttacgttaaagataagagtaaaataactttcgtatcatgtctttttttaaagcaagtatttctaggataaaaggaactactgttggcatatccagatttaaatatgaaataccatttggggcaaaatttacagaaaattaaacatggagcagttcagtgcctccatctaatctttaggtgttcctacttattgttcaatgtaactctgaaatttctccagacttgacgaggaaataatttagtctctatctcttactgagatttaacttaagtctctatatattactcaacttctgtgtatttctttaatatacattgcagctaaagttagcttaattttaaattatcattcagaatttttagcatctgcccttatttatctgttagttagaagttatgaatttatcctgtttttctcatggagaaaatttaaagaatgaatttattttatttttttgcaatcactaacaatcatagtttttttatgtttatccatatgcagaagcgaagagcaatcaaggtccatgttattatgcaaaatgagttcacgttactgtttacagttctagaactagtcattttccaatcataaagctataatttctttcgttctctctcagcatttcctgctgcaggagatcagtttcttaggcaccatcccagaacagttgtccctagattgaagtcccactctagtctttctcaagagccgggaagaaaggttatgacacttgtttagaagacaatgcgtccagagctagttatgtctttgtttttacactttgctttttatcttcatttattattattttcattgtttttcctgactggttaggccggagaatagctttaccaaaggcaagaattgttattgttgttttagtatctagctcatagcatgtagacaattacttggatttgatcacttaaatctaatattttactttgcttcaaatctagtattttgctttgcctgctttataattcaaatttcctaccaaagaaagttaaccgtctcttgaggcatttgaattatttagaactgttttcagataatttgcacatcttttttagggccctatacacctgcctcaggaaagaaaaaaaaatctgtttgtcagatgtaggcaacaccactcgttaagtaagccattagtcactctattttttaaaaaataacttaattatctcatccacaccagttttccattctctgcccatcttcctttcttttttcttcctctcattctccgtgtctctgatattcgctctcttcccactggacaatcagcattcaccccttgtgcttctgagtcttccagtgagctgtgctggtctcctggagacagagagcagtttggggtaaaggcaagtctgtttggctaatttaaattcttgtaatgtgagagatgggaatagaaagagcaaatggcattacagagatttttgttgttaaaaggacacctcttctccatcccatttcatttcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatgggtaaggcaaggtccaggcaatacttggagttggatgtgtgagtgttgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacagtaagttaaaatcttttccaagttttgttttgtggaaacggcttaaaaattattgttagttttatttttcttagattctggagttcttttaagtgcgtgactagaatattaaagaaacaagtatgagaggagagtgtggacttaataatactgttccattttacttttctgcagagggtggggaggggagattgtggttatattagcaaaccatcttttcatgaagagtgtgagtgaccaacctggcaaaggtggcatgtgagtgtctgtgtgatagatgtattctcaggagcatgtggtaccaggtctgtgggaggaaatgtgactccatgtgctcactgttcaaatggattatgatttactgatgtttatcttcgttaaactcaaagatcagttccagcaatgttgccctcgtgcatctcttcaaggattggtttttgtaaggtgtacagattggttcttgtgggatataccatcagcccttccagcacctcttggaatagttccgtcacaagaaaatccaacctatttatgagtttttctatattttaatatatttcaattcaacctttagtctttacttaaagaagtcttcagaatatacatcttaaatcaaaatgttcttcctaggaattattattgggaaccaatattcagtgtaaatatactagtacttcatcaccggtcagattctgaattcaagcaacagttcttcactaaggaagagtatactgagaacttgccaattccaatgcaactcctcactgttgtttatgtcatgctgaggacagatagatacattaacacggatcatgaactacaacttagtttagaagaaaggagctaaaactttctattttcttattgttagcatattaccagttttcaaacttctaccccatatcctaaaagatttgatgtttgaaaactaatcagatttagttgttttacataaatgctaaatctacataaggagcctctttcttaggggttgtagacctaacattatattccagggcactatctgtacaaagaaggatcagactccttgagaggacagaaggccctgtggtttgtggggcaaagagctgctgttgctgctgtcttaactgttctaagaattacatctcctaacaaaagccagagggatttcttgagcaatgctcttattacttagcttttaaaaaatgaggacaatagtcacttcattatattaccaattatggactctaggtataaaagaaagtgacaaaatttgaaatggtttcttatggaaaggaaaaacatggttaaggttttattattatgttggtgcaaaagcaattgcggtttttgccattactttcaaatggcaaaaaccgcaattgcttttgcaccaacctaatgtatgtggtaggctactttttataaaattttgactgtataacatcaggataaatttcccaacaatctaaacgaagaagaggcagcgtgattctctggaaataacctgaattttaaattctgaagactcagattgaagttccattttcacttctaactggatgtgttcagccacacctgaaacatctttcttgcacctggattcccgcaaaatcttccactcatcttcattccaagcctatttcctcacaaaccattttctgttcttaagtgagagcagtccttctagaatcaggtctgatgctgtcatgcctgtgatgtaaactcttcatggtctgcctctgtcctggggataaagagacagttcttaacaagccatataaagattttgatgatctgcctcctgctttcctccccagaagggctcccttcactgttgctgcttcctccattctcgaatgaccttcccagtctgctgagtttttgtcagaaggattcctgcaggcccattaagtcccagcgcaggtgccccatgcacaatgcctgcttccatttattgtagcatttgctgacactgagcagcaggaggcagcttgttcggaaactcttttccgagcattgagcaaacttccagactcagaatcagcactgaaaaaggatttcttccgtaaatgaatatctattatgaaaagcaaatcatttgataaaatattacataaatattagctgttgtcacttctgccttccttcttctttccagaaatcacctgctaagaagctgactaatgcattaagcaagtccctgagctgtgcttccagccgtgaacctttgcaccccatgttcccagatcagcctgagaagccactcaacttggctcacatcgtgtgagtatccctaccctcccagtatagagacaattttcttcaagggcacatgtctggagccacacaaaagcaatttcctatcagtggtcagcaaccaagatttttaatttagtttaaaaaaaaaagtcagagtaatgccatcataattttttgttgttgttgaggtgtacagtacttccaccaggctggacaagtaaagtatgcaacactaacataattcacctggaggtggaaaatatttcagaaagcttagttataaaatacggatgttagtggtgtctgcacattggaagttaacaatgggatcactgtggtaaaaaatgatttacagtatattattccttaatttcatatgtgctttgagttccaaatataaaagctgtttgttttatttctctgcagacccagtttaagatgccagcaaacctagaaattacttttgtttttcatcccaagctgtataactttagaagaatcatagcctgtgcaggggaaggttgaagagggggagtggcgggaaaatttatcagaatatccatagattcttttcttcaaagtatgtgtgagtttcgtggcagaaggtgttgggccaacaaacagtccttccagccatccctgctacctcccagaagtttcatgcctttgaacctctctcaggcctgggtggccaagataacaagggggcttaggtagaagaaacaattttttccttggtgttacctggggctcataagaagaaagagtctcattacctgcttctatgcacaattagatgtcatgtagtcacagatgcctccttatgaactgcctgtagttttccacacttcagtgggacctatcacaccatagggcctgtgtttgcatgttgacatcaagaggtgggtgacgggacctaccggtataggaattcaacaatgcaaagttcatgcttcaggcagttcagcatatgatccataaggggcactgtggtgggtatgagaccttcgtggaagcagcaactatgttctctgatggaccttagcaaataccaccaaacgatttgtgttgggtcacgtctgtgagctttgtataaatactttggggctttgttttgcttgttcccggggatgctctgaggcatctctgacctcagcagtatacacagcctggaggctcctgtttctcagcttacaagctggcatgggctcagcctccagaaactaatgtaaactaattctgtagaatgtggctagcttatttttggaaattatgtttctataaataagccttaaaataagccaggggtaaataaatctggggaatgtcccaaagggccaaccacttgcagaaatctacctcacagatgcttattaagaaccttattaagatctagactttccttcccataaccaattagacacaatcactaagttgctaatgaatgaccacagcgaagtgagagcagccagtgctccctgagctctgccgagagtaatttcctaccagccctgctgggagtttcaccccaagagagcagccttcaacagagctgctgggtgtcatgaagatagagggtgtgggtgtgaatagcctggctctaagagctttgctgcttcccactcctccaaagaattagaacgtgatgcactgcaacgtaaaagtccatttcacagtgagtcccactggagtattatctagctcagggcctgtacccagtgggtgctaggattgggtggtgtgtgtgtgtgtgtgcacgtgtgtgtctgcatgagagagagaaagagagggagaaagaagtatttaattggctgagtaataatttttacattttgacttacggggcaatataatctgttttgttatttattgaattaactgagggctatagcctcacaatgcgttcttagtttatgttccatggagagattttaaaattctgtacaaaatgtgtcttctgagaaaaacctctatgtattttaccagatcctcaagagtccttgaatcaaaatactgatctctactcactgataacatattttcccaggatgaaagttttaattttaaaatgcaaattgtacaagatatttaattgttgaaataacatacaagacattctggatgtagaatgttaagtctatattagaaaagaattttttttctatttttagccatagaaattttttccatatttgtttctttttcaaatgctattgtcatgagtagatatccatgtcttttttctgagatttctaattttaaaatgcattgctcatttaactattctaaattatcataggcacatcaaggccattgaaatgaaaaaataaatggtattaagccttaatcatttacaaagaagaatgctctcttaatctgctataatgaacatgtacatggaattaatgaatattcacacttcttccaaatgtatgtaaataagattttgataaattagacaaaaatatatgacattccataccatgtcattttataataagcccactacttttatacagtgctgtacaatggaaataagtgaaatttaagaaataaaacacaccaatactcccacctccacttaatgcgcttaatttattactcccaaatatgacttaaattataaaggtcttatgcagaaggaatattgtcatagtgcagaaatgtgtatagtaagacactttatcattgagtctctagcaaaaatcatcctaaaagtatgttccttagaactatacatagcaataaacatgttttctagctatagctctgtcttggtcatcctcattccctctctgatctttccccttgctttactaaataatttattaagcaatctttaattgtagtacaaaccacatctttgtcattctttggatgtagtgtcacaaaaatatcccagtccacatcagttacacccatagataagcttacagacagaggtaagaagggagcagtgagtggggtgcaagcattggcaatattgatgggcatcctctgtcctgtactgatgacctgaggttctggacattgggaattatagcacagactcaaaataaaacatttttttgccactgtgaaaaagtgtgttgattttgtaaattaatacaaattcttcaaagacatattcagaaaaaaattccatgatgtacatgtttaagtgaaggataactgtatgtccttacatagtgctgaaatatgtagaacattatagagctcatggatataaaatttgatgttgaacattatacagtcttcttaaatgcacatcttgctgtttaatgattgtgttaaaaattgctggccaggcacagtggctcacgcctgtaatcccagcacttggggaggctgaggcgggcggatcacgaggtcaggagatcgagaccatcctggttaacacgatgaaaccccgtctgtactaaaaatacaaaaaaaatagccgggcgtggtggtgggcgcctgtagtcccagctactcgggatgctgaggcaggagaatggcgtgaaccagggaggcggaggttgcagtgagccgagatcgcgccaccgcactccagcctaggcgacagagcaagacgccatctcaaaaaaaaaaaaaaattttttttactacatggcacatgtatacctacgtaacaaacctgcaggttctgcacatgtaccccagaacttaaagtaaaataaaaaaaatgctgttagtcctctaatatatattgcatccaaaggtgagcagcaaaagcattataagatacaaataaaattaagaaaataataagtggaaaatgctttatcaatacattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagtaaaaaaaaaaaaaaaaaaaattaaatcaataggatttttaaacaggttgcggtactaatacacacacatatacacacacatacatacatttgtatatggaaatgaagcatgtgacacacagaaaatgccattttttttttaactatagccaagggactttttttttctacccaccttgtagagaggtgctgccagtcatgaattagtccttaaatagaaatgagcaggtggtgacattttggtattttgacatttgttcttagctattgtattgcttgtaaatattaccatgattaacggtctctattctgttcaattcttcgctgccaaaagtgatacttggtaagtagtgcagtcatttccagtctacttacaaagatgtataatcatgatcataagtggggatgagacacaaaacaagtgagcaatatgaggctagtttagaactaagtcttcttatgctgtacactcagttcacaaggatgccacttatataaaaatgtcctctgtgaagatcttgtccagaaggccattgtgacttactctcttttgtggagctgtttcttttacataaaaccaaatatgttcaaaattcccagtgtgagccatttgttagataaggtaacttgccatttgattgtggaagaaataggaatttcagtccctctgaaaaccatcatttggtgccagagctagccattctttgtccaaagttcaacatttcagtggtagaccttaaacaaagccatttgctgagaaaccttgatttcagctttgtagtgaccagattcaatagaatacatttatcaagctagttaaaaagcattctaaatccacttgttttctcatttttagacagagcaagaaggaaaaatttttaaaaaaagacaaaatcagaagtgtggggtcaagtatttttttcaactctttgcaaagctacaatgaagatattatactctgttcactgttttaaaatctaacagaccaaacttttcataattcacagaggacatttgtataaaattagcatccttcttccaaagtgctagtgttcaactcaaggcagaattagttttaaactagccttgcgttgctcccttatatatcaaagatatgtcttagataagtaatgcaaaacactaagattgttttcagaacttcagttttgtctagagtagataagtagctgttgttttggcttcatccaacagatgacatgtcttacaaaatctcagagtatagtttagcaccagctaccttgaaaaaagttttgatgaatttgttattttttatttttttatttttatttttccataagttattggggtacaggtggcatttggttcatgagtaagttctttagtggtgatttgtgagattttggtgcacccatcactcgagcagtatacactgtaccatatttgtgatcttttatccctaaccccagagacttattctaagtctcaatgaatttttgcatgtagtattgacattttaaagcctgcagagcttcaggtccattccattcaatacattgggatatgcaagtctacctttttcccagaatgtcttcattgtagaatccaaagctgttctctaaggtaaaaattaaaccatttacaaatttggatcttaattatgccaatataaattgattctttaggctgctataattaatgtctcatcttcaaaacgttctatactgtcaaactcaaatatagaattatagtgaaactgaaatttcctctgattcagaaaatgctccacctcattttccatcttttgaactctaagtcccatctcatattaccattcattatcctatattgaacctaaaaaagggtaaaaatggcttggagatgagatagggatcttagccctatcattttacctgaactaaaacattcatgatggggaaagaatgacagaatgaaatgaaaatcagatgaaggaagacagactccatgcagttggtgtgtagaaccatgaacaattctgaggaaaattgaattctgttttccttctcttatcataagaaaacaagtgaagcttatgggatgctgtacaccacatactctatcatatggatcacccaaacaacagaaactaacttcatatatccttgtggagcttacttgcatcttcacttagaacaaaggcaaataaggtatgatatgattttacagcctgtgtcctttcagaccaggcatgttggagaggcccatcatcatggagaacacagaaggaacctttcaaagcctcaggaatcttcctctttccaagagaatatagattcaatgatcaggtcttcaaggcttcttgagaaggcagtagaagtaaagccactaccttcttcaaaatccttgcttcattccagaatattatacaatgaaacatcaaggctcaaagctcatgcatcagtattcacatggtgtctggagatcttcctcccagtgtttacctgagattatatattctcaaggaaatgtaactttaaaacacttaaggaatttaattggaaaatataagatttcttgttgatcctgggaaaggtagaacccagatcttcccatcccgtttcctggagggatgagggagagttttaaatttgtgacttttatttgttttaactttccattcaccctgtgttttgttttaggcctcccagacctgtaaccagcatgaacgacaccctgttctcccactctgttccctcctcaggaagtccttttattaccaggaggtaagttccaaccctattataaaataagccctttctttggtaatgagccttgattctgtggtaagaaaaatattctcatgcaagccaagggcagaatattgttactagaaactaacttgcaaatatccattataagttttcaatttcattcatttgtatgcatttaaagaggggtagggtggctttggggattaatgtcatgtctggaaacctgcatttataatttacccacagtaagaatgtgagggtatgtttcagttttactactgacacacatgcatcccatctcattaaggaagtcacgttcatagtcctcagagttgaagtcaaagaactggaatttcaggatgcaatggtgtgttactatataaatggtgaaatgtgtcattatttaaagctaagatacaaaagaatcctttgttggtgaaccctggagttcctgaggctagaggataaagaccaaacttggaaatgtagtttccatataagtaatttcacgataataataagaacttttttaaaaggtggatctgcatctcatttctttgcacaagatccattgccatgtgagcaagaaacaggagaagcaaatatttctctaagagttagcatcagacatatgcagggtcaagaggtgctctgagtcatttgatcaaatattgcaaatcaagcaccagataattattttataaatacatggagaaggctcacgggaaagcaaaaacaaaggtaaggaaaattggagtgagtaattgaacataagatttcaaatgcctttcagcagaaaaaaagtacagcctcatatttcacaaaatgcacataattcatcttttccctgaagaggtttataaggtgccagtttcactgtaatatcctggtacattcaactgaggatttgaagacaatgagactaagaacacagctgattttttttcctctgagttcctgtatgtgcccatcaacaggaacctgagatgaagatgttccccataattgtaattagcagaataaacagaatatggcagaaaatggggtttctgatgtataaacgaggtctgtaacaagtggaaataaggaaacagttatacagcagaacatccacagtaaaataatatggtttaggccctcagtaacttccttttagcactcttttttagaatcaccagcaaatgcaaccattttttttttctggaatgaaatcataaactgtaaaatctgtaaaagacacaggtctgtgcatctatctagggaagacctgatgtgatgtttagaaatatgtacttttattaggaagctctgcattctgcaaatatcaagcagaggtagaccccatccttactgaaggtcattttatatcatttcagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctctctgagtgggccttgctctgtccatgggaagttttaatgaggtctcattgtttgactccctcaggttacctgagggaataagtgcatccagccctgtggctgaagagcattccctcataaagctgtacgtaaatcagcttgatcacggtgcacggtcagtatcccagccctgaattgctaatcgtagtagtagttccatagctagactgataagtcattctactctggcactaaaatcctctcatagtacgtcttattggagatagaggtcttctggggtttaatgaaattgtgttgagacttttcaacttgagctggactttgcagctctttcctctcctttccacatattttatggatttcatagcctcataccggtatataagagatgtatatatgtgaaatgtatcaagctggatcttgtttggacaagtctctgcttttgtacaatttgcaaaaaacccagatggtaatttctaagactcttgaattaaggagtctgttggaaagatctttagcattaactaggtgaggctaggacaatgtcatgtagctggacctctttgcagttaaagacttgaggacttgtacctttctgtcctattggacctggtccattttccccccagggagggaagtctgattcctaatgaagtaacaatttcaaaaacagtttcttgctctctgtgcttattctctatcacttgataatgctggtggtgaatcacttttgttttcttaatcgtgtcgataaactaagatggatagaaatctatcatgccagatgtaggcaaaagttaaaggttctatacttctatcattgaaacagaaccaaagaaatatgacctatggctctgccctcacccctagcccatcccaacaatgaaataaaacctaagcaagccaagtatagtgccagtcagtatagggcagcaccgagaaagtagagaagttctccatattttatttagcctaagtttagtcttttgtatcatgacagatcctagaaagataaagctgaatgaggctgaattgaaatccccactccagaatcctcaccacaaactcctggcattattcacctagggcccttcacaagcataccactttgatcttcaaaagacacagggatataactttgaagtcttttgacatcctagtaatctacttcacacagatttatgagtgtgtacctctggttaccagcatcatctgtcgcattccctgttcttacatcttttctagctctgtacttgattcacttttcccttacttaaaagaaaaaaaaagcgattctcaaaggcactctcccttggtccttcgaagtcttcttacatgtgtgtatgtctatgtgtgtgtgcacgtgtgcacatgtgtacattcagtgttggtcagaagttaggtagaatgtgggtcatataacataattgatggaccgattcacttcattcattttcttgattgtaaactgtatccctaatctattttgttttcttataaatttatgggaaagaatggctgatttgatggaaatctattatcaccactggggaaagagctctaagagctatgtatggtgagccagcaacattatctaagcttatgaaagttagtgtattattattattattgcagatattattgcaaggactgaccacaaagccaggtcccaaaggctctttctccccttcactgcccacagctctgtgcctcttaggatctgctatcttctttggcatcatgcctcctttttaaaatcttaattatcttgccataatcattacttagtttacatgagaaagttaaccaatactttttaatgtcaagtaagcttctttcactatggtcaagcttcttcattagtcagagtaaagactaatgaaaaaattagtcacacttcttttacctccaattttagaaacatcatttaaaggtttcacaggtattttcatagttgcaacctctaaagtggtaagcactcacaaaaggaatcaccttgactattctatataacatctagccaggtcttatcactccaccaaatattaggaaattgcttacaattcatatagcatgttgaacacaatctaatgtgctagtttctggtttgctgcaataacaagtagttaattaatcatattgtattagatggccgggcaaggtggctcacgcctgtaatcccagcaatttgggaggctgaggtgagcagatcacctgaggtcaggagtttgagaccagcctggccaatgtggtgaaactccatctctactaaaaatacaaaagttggccaggcacagtggcgggtgcctgtaatcccagctactcaggaggctgaggcaggagaataacttgaacctaggaggcagaggttgtggtgagccgagatcgtgccattgcactccagccgggacaacaagggtgaaaatccatctcaaaaaaataaaaaatgatactgtattaggctctgtagttcctatagggagagtgcacccaccccagatacttcccaaatcctgatccctccaagaggagcagaaattgtgagttattttttgggttgacttgttggtcaggtgattgataggtttgggttttcaaccaaagaaatgctaattcactgtgcctttttcatttttaaaaaatatttttgcttacccaaagattctttacttaacaaccgtggcttttaatctgactcaaaaagttcaagctaaattttaaatagttgtgatttgatcatcaaaagtagctaaaaataaattttggatactgattgtagcctctccttttgaaaatcaaagttttcttcatagctaattttttctaagattaatgcccatccattttcagtcataaaatagataaatttgtaaatcaacatctggcaccaccctgaagatttctcattcttttcaaactttctgggcatgttgtatgaaattttatgaagttgaaataatcactctctgcagataattctttacttcatgtagtcccagagctctactaatatgttagatctttccaaactggaattacaccagtctacacatcaaccctaataattttctatactatgcatcattaaaaccacagtcacctctcttgttcagttcagtaacctttactctcctactagagttgctttggctgttgtctctgcatgccctataccaagcaaactttcctagaggctctcctgacaaaagtgcaattgctgtgacttgatgatacctgggtacaatgtagtaaattaaatatgacctaagaattcttattttttccatggtacctgtttgagatggttgaacttctatgccagcctgaattgatgacagctaattttcccactgagacactaacctattttttaatactggtctatgaattttcaggtaatacatattttatatttcagatgtaagctattgaaatctagaaaaaaagaaacaatgtttcaagacattacttcttgacaaaacagatttctggatttttttattatatttaagttagtgtgatggcctcattactagactataattctagtgagaaggaaaattttatacactatagatagttacttaaggaggcagccaactttataagtcattcttcacaaatccaaatgtcatacaagcttattaataatttaagaatcaatagaaatgaaaatatctgttcttaatttgctatatttcaaatattgtttttcttttaaccattgcgataattattctatattaatataatttgtttctataatatttgttctctgtgagactgcagccaggcctttaatatcatgttcaataaaagaaaaaataatctttgtcaagggctaatatagtaactcaacattagcagaagtggtttttaaaaatatatttcaggtatccaggaagcatctgtgtgtgattttgttacctttggacccaccccctaaatattttcactgaagtaaaattattggcatcagtcgtcacccttcaaagctaaggggataatttttttaataagtatgaaacattttgagattgttctacttttccagaacccattgtgtcactgtgtgtgtgtgtgtgtgtgtgtgtgtgtgtgagaaaaattttggaaggttatttatctctagatatgctgctttccaaaggtctaaaaaggaagtggtgagaagccagaggatttttgttagaaaaacaaagtctgaaggaatatttcctgccttttttctttcagcagatatatgaacttcaaaatttaccatgccatgccctcaaaggtatggctgttcccacaaccatcagtgataatatgtatgtgaaaggatgtgctcatacagtggcaagggattagtgaaaagaaaaagatggcgataagaaaaagagatttgtgtgcacatgattttagaaatgatagtcttgcttctctttgaaactcagattagaaaaggtgtatcccatggtcaagttgaatgccaaatagttctcagtttcggagcttaaaaggaagaatgcattctgatttgaagacaaggcatgtagaacagaagcagctttaatgaagctcagtctgggttgtatgaaagccattgtcacattctgacacaatgatatgctggaagcactctttccttagtcaggaagtaggttccattgtacctgatcccaaatcccacaaagaattagaaacttaatttctccatgcaaacttccaagctacaaaatcaaagtttagaatctaaattagtccataaaatattgtgataatatagcaccttgaagggatcataataagccacacatcattactgttttagtccctttatgttgctgtaaaggaatgccagaggctgggtaactgataaagaaaagaggttgaggctgggcacggtggctcacgcttgtaattccagcactttgggaggcgacggcaggtagatcgcctgaggtcaggagtttgagaccagcctggccaacatggtgaaaccctgtctctattaaaaatacaaaaaaaaaaaattagctgggtgtggtggtgggtgcctgtaatcccagctactcaggaggctgagacagaagaatcgcttgaacccaggaggcggaggttgcagtgagccaagatcgcaccattgcactccagcctgggcaacaagagtgaaactccgtctcaaaaaaaaaaaagaggtttatttggctcatggttctgcaggctgtacgtgaagcatggcatcagcatctgcttctggtgagacttcaggctgcttccacttatgacagaaggcaaagggaagctggtttgtgccaagatcacatgaggagagaggaagcaagccacagacaagaggtgccaggctacttttaacaaccagccctcaagggaactaatagagtgagacctcactcattgctgtgagaatggcaccaagccattcatgagggatctacccccataacccaaacacctcccattaggacctatttccaacattgaggatcaaatttcaacatgaagtttggaggggtcaaatattcaaaccatagcaatcactattttcacagcaactcaagagaaaaaatttcactttgctgcctctcttcaagcttggaagctggagaagaggttctggtggaaagtacttcaagtgaaaagactttaaagacacaagttttaagtgaaacctgtctcccagtcaactctcgaggttcttgattcatttcattttgaaagagtggctatttttgtcttgttttcatcatgcatttggcctcctctgtacatagtcatatttttggcttcctggaaacagatgatgagaagaagaatttgaggctagctctagaaattacagaaactatgtgaacagtgagtatcaaaaagttagaagtgcttctggcactagaaattaagagctatagcaaaacaaaatagtttatttccagaaactcatgtatgttcacggtgtaactcccatattttccaagaattattttttctaagaattcacatgggaaaggaacggaagataaaaggttttaaactatttctttaaaccaacactggcaagggccaacacaaagaaaatgacaacaaaagttaagagatgtatatatatagaatatgtctcattcctttgagggaagaagggacctggttagaagaaggaagaaaaggaagaggagaggagaggagagacaggcaagtggagtagaggaaggaggagaggagcccaaagatttgaagaaaaaaaaaaggagaaggccaccaaaggaaagtccggcctatcgcccccttctctcagccctacctgtacacagtactgaggctagggctcctccatgcttgggctttgtcagtgatgggtggtggagccacatttctgggccttcactgacacatcttcctcccatagaagttcaccagaataatttgtggcaaacacatctttgtggttgacgttcctgtgtttcttttctctactgattcttgcttgttatcttgcatgttcagcatgagaggttgtccctgtgcaattattcggctgtttgcttaagaaattattgccacaatttctgagattcaaagaacaaagaagcataagaaggcagggagatactttagtttggagggaagaatcatggatgtttcacacagtgttttgaatggttttgcaagcatctgaaataaattatgtaatagattcatctatctttagttacaaaaaagaattggggggatattgggcagcaggggtactgtaggtactgcataatgaatgtatggagatctgcttcagtagacaaagtctggaatgcagttttggtggggtaactgtacatcacagaaaacagaaacagttttggtggtataatggtacatcagaaaatgatggctgaaggtggttatttggccctgatgggcaggtttcacagttttaaaaggaaaacatcaatatgctggaaaaagaaagttattgaggtcatcaggaaagtaaattatcctaaaacacaatctaatttatttttaaagtcaattttgggccgagcacggtggctcacacctgtaattccagcactttgggaggccgaggggggcagatcacttgaggtcgggagttcgagaccagccaacatggtgaaaccccatctctactaaaaattcaaaaattagccaggtgtggtggcgcatgcctgtaatcccaactactcgggaggctgaggcaggagaatcacttgaaccttgaaggcagaggttgcagtgagccaagatctcaccactgcactccagcctgtgcaacagagcgagactctgtctcaaaaaaaaaaaaaaaaaaaaaggtcaattttgttgggtacagttgaactttttaagtacagcaatactttatataacagatgcctttctgaagagctgagtgaaaatgtcattcatctgacaaacatgcatgtctactctttgctagtcattttctttacaaatcaaatttaatattaaatttatcagatacctcactattcaaggaatcttttaatatacactattataaagcaagaattccaactataatgtgcatagttctaatgtgttatgtataaatttatattttttagtacttcatggcctgaaagaatggtgctttatagtagagccctaaaacttgtagtacaaagtttttaagattttaactaatttataaaccattatatatatatttagtagatttagagtttcttgaaaatttttggtggaacctcataatttagatcccaatagttaaatatttggtattcaaacaaagacagacaatttatttttctattttccatgaagaaggagagggacaattttagattcaccagtgtgcaggacaaattcttacttaacctatagaggagcaaactttcttcaaacacattaccaatacaattgtaatactaagaatcaataccatagttctcgatgtagcatgactacaaattgtcacagtagattttggatgactttaccatagccacacttaatgaattattatttatatttctatttgtactttaataaaactatattttaaactttaaaattgtcatttaaattactaaagaaaatgagtagttcccataatgaatccataatgttaagaatttgctttagcaatgagactatattcactagctttgtattaatataaacataagaaataacaatatatatgtataagactcaaaggtgtatttctctgttcctctgaaaattttctttgtagctccacagccaagatcatgtggcttttgcttggagtagtaaaacacttctaatatgaagcaatctctagctaggtaattttcaagtctttctatccagaacagaaagttggaggatgtagggaaggctaagttcttgagtgggatctaaaggctggcaggacttagtgaactattggactgtttacatgatatgccatgataaatgttgaatgaattttcattatgtctagacatactcaatataaatgcttgcttgttaagcaaatagcagaggtcaaatctgggatcatggtgattgcgattgtggttctcaggctgggtttctattcctacttgaagtctgtggaaatctgaaaacatcttgaacatttcaaaataataagagatctgtctaaatgaaacttggatctagacttgggagtgtctgttgccagtttctattcttgaatgcattgccgtgtttacgctcttcttggctttcccatcttattaactagctctcctcccaaggacagtgaagtagagcagaacaaactgctggctagggctgctccagcttttctgaagggcaaagggtaagttacagccagagtgtactggaaccctgcattaactaaactaaaaatggagatttcttttgtcaaaaatgctttgtgtgtgaaagactgtctttgattcagtaaaagcagctctgctttaacccagttaacagcactaagtagttatttccagtagacacatctgtgttgttattcactttcccgaatttgtgtccttttcttttttgaaatgactaagctgaagactcgattttctgaaggatatttaatctttgcttgcaaccaatttcaatgtatttactctacagatgaataccttggccttagtggttgaaaaatgtaaatctgttttctaaaactttatttaacctaaatggaagtctttatttttaaagttagtgaaatcgaattgtggatttcattgcctggatttcacttgtgtttttcatagcacatcacttactacccttcctttacctgcttggttttctaaatgccttttctaccaaaaactcactcctacctcctctacttatttctgtccacctctcttaacaacacgctttctttccccctgccctgtttcaggatacagtacagcctgaatgtggcagacaggctagctgatgaacatgttctcatcgggttgtatgtcaacatgctccggaacaacccctcatggttagtgcaggtttggctgcttgactgtccttagagagggatacagtctgagctggtgacaagcagtctcagcaaggagcaaggtcactggatgccagtggtgacactgaagcactgttaactggttcagttaagaagtctctcgtgatgttagtttggatacttcccatgaaggaaccataggattcatatccttgtttatatattagctaaaacgaaaacttgcataaagggatgccttgctaaatattagccttcaggtagattcaggactccgggtcccaccaatcagttctgtgctacgtgtcatgtcaaattaccacaggatggtgataaaagaatttgtcttattccaaggacatggatgtctctgctgatttggaaaacaatgcctcattttacttaagagtgaaaaagagaaaatgcgatgtgattgaatcacaaaatggaaatcatttctttaacaatgataacagtgggaacaatcgtctttcagcaattctattacacatttttctgatgaccatcctgctaaagcctgctttcacatcttggaatacacaaaacttagtttcagatatgttaaattcaggaattaagatagccctgtgtacttggataaagccattcaaaaggcttttctccattttcattgtgacataggagactccttccattggttaaagttacttgatattaataataaatgtggatttgcagcttgaattaaaggaaaaggacaaactatgtatcatatgtatttttcaatctagttcagactattgttttataaacatatttagcaaaccaattccttgaaaatatgtcaatttttctcaaccacttcaattttctctcaattaagggcccatggattttccatagttacaattattaagaaagccaatgggttcaatttccattaaaatgtttcaaacctttagcatggcaagtcctctttcctctactattagaggaaaagtaattggcaaaattaatggcaattacattaaaagtgatgacaaaaactgcaattacttttgcaccaacctagtatttcaccaaggcattcctcagatgctaggccattgctccatgctccttgccctcaccacttgatgttattagccgctttgtttctgaacctctttcctcctcacttgagtattttcaaaattttcttcctattactgcttcttagatctatttttgcaagattaatacatgagataatttttagttctcatgaactgatgaacatttatgtgctttagtacatacatgtatcttaatttgtatttttaaaaatgtataaccagtacactagtttaattttaccttagatcctactgtttaaggggataaaaatgcactctttggctgacgtaaatccatctctttcttcaaattttgtgagcttctagattaaatagtatccactttttcacaactcaggctctcaaaactacaaaattgctttattcccaaggagtttggtactccagtgttacatggtagctgaagcagtagaactaagcattgaatttttttttaattgtattggtcatctttgaagaagaatacagtcagtgtagattcaattgtaagactatgatgcgatctcacatcatgtcctcttcccataattctaagcacactccagttatttctactgctcttctttgaccttttcttaattaaggttgttaacaaagaaatctccaaagagaaaagctcagagtttgtcactaccagccattttccctactcaagtgattaatcatattgacttgatggttacttaagaccataaatctgtctcagcagagacaccttgcgtctgcctgatgaaagctaaatgtgatttgtattttgaaaacaaagcagaatttaaggccaaccaatcaatgaaggaggctttgttttaatagctgcaccctccatatttctcatagttttttctatccttaaaaaattccaacttctttttcaaatttctcattttttcttcccttttctttatgtttaattagatcccaacaattcctcatacctgtcatggttctataagtaatgtaatgacctcttacctcctttaacatcattgtagctacaatgctttaccatcattaagttacagtgagacatataataatagtaataataatagtaagtgtttttaaaacacttacctcatgccaagctctatgttcagagccttgtatacataatttctcctagtccttaaagtaagcccatggagtaaataagatcatcccccttttatagacaagtaaaggtatcattttagagagcttacctgactctcccttagtcccacagctataaaaagtggggcagagattttaaccattatccatccaagttcataaccactgtgtttcatcacctcttttaaaatctgcatcaacacacgcctttcaggatcttttgtggatgcctccttcacactgcatcctccacgtatttactgaaactgtatatcttattctagtgtttttatttgattttagcaaatattttgagcacatactagtaacaggaatggtgattcttaacaagttaccttttatgtatgtagttccttgagttgtgacttctcatgttaattgtaagcttcaaaaagggcaagagttttgtcttcagtctcttttatcttattacaacagctggagtaagaataataaattttgtatttatgaaatgctccaaaaattacaaagcctttttccacacattatttaatttacttctcatagtcctagaaggttggatatgattatttccatttcactgtttaaaaaatatgagctttgagacattaagtgacttatccaaagtcacatgctagtaagggcttgcaaacaggtcttatgacactggttcccatctattttccaccccattccttggcctctagctgttctccatcaaaagctttgtttttgccattattcagacctaatcctgattaactctgtgtgggggtcttctaccctatattaactacttaacacactgggaaactgacttatttgtaatagtttgctgctaaagaaacacttatgtcattgctggttctgtcagataagtcaaataaataaactgcagctcaagggagaatttctgcttccttcctaattcaatgaagttttaaaagccttaataatttgtatgcaccttcctcattgcaggagaaggagtctgaaatgtgatacagtgtgggcttttactaccctcccccaaagcttgtcaaattcctgggcttgctagtttataccaaggtctgtagtagaccaaccaaatgatttgaaaccagcccagaacttctacctctaacattgtcacttgattagactcctgatgtcatatgactaggttaaaattgttctgcttatatttttctcaagtacaagaaagtgtacatttgtgttgtcaatagatttcttgttaagtggattaataatccatctagtttaaaattgctccacaatattttatgctttgggaaaaaagacatctaagaatgcctatttcagaatttcatttatgaggtctaaatttttattagcttgcatgcttagaactctttaatagattcctattggacctagtttacaacccagacccctcaccatggtgtacaaacctgcatgtgacttagcccttgcctactcctttctcagcctcagatctcatggggttctcccattcaatcactacatttagtcatgtcaatttttgatcaattcctccaacgaaccaagctctttcctgcctcaagactccaatactagttctcccctctgtctagaacattctttcccatttcacccctactatatgcacatgaacttgcttgtctagcttccaatcttagattaaagacacctcccccagtaggtcctctatattagtctctattatagcatactatttttattttcttcttatcagctgcagtcattgtttggttggttagttggttagctgtttggctggttagctcattggttggttggttggctgactggttagttggttggttggtggctggttggttggcttactatttactgtatcttcagtggggcagggaccctctccaacttgttcaccaccttatctctgacatctagcacagtgccaggcacatagtaggtgctcaataaacatctgttgatattgtagaatatcagtagtgcagtagctaaaaaaattccatcttcccctaaacaaagttgttaggagtagtcagaaactttactagcaaaattagaatttttactatttaaaaaaatcactattatagagtagcacttaaattgaacatttagtataggagtataaaatagatgaaaaattaaagtattaagctttgtgtagtggtagacatgggcaaagataagcaccagcaattcactgatgtgaacagagcaactaatagggcattctaaaatttttttaaaaacttaaagtgataattgggcaagaatttttttttaattttaatgcccccctagattcttcatctttgtattagtttgctaagaatgccaaagcaaaatgccatagacttgatggcttgaacaacagaaatttattttctcactgttctggaggctggaagtccaagactaaggtgccagcagggttggtttctcctgtccttgacttgcagatggacaccttcctgctgtgtccgcaaataaccttttttctctaccctagtgtctcttcctttccttaaaagaacagcagtcctatgagattagggccccacactatgacctcatttaactgtaattaaaggccctatctccaaatatagtcacattctaaggtactgagggtattcatatgctttagcatatgaatactgggggagacacaattgaatccataacccacttccccactgaatccactgaattgtatgcctttaatatttttaatgtgtaggtcaagatttgactgactctttttagtacattttgttgattttgaaaaatgtgagtttattgcaatctgttgaaagaaaaaagaaattataatctgttgaaagaaaaaagaagagttacctacacttactgacagtgtctcttttatatgagttttcatttcctgttaacacgactccttttgtttagtaaaatttttaggaacttcaattatagaactggacttctgagaaagatatttccttagaatcctggaaatataaatctaaagactgtcacatcaggaacagttggagtagaaggaaatggaggagtctgagagtttttagaagatagaatgcatgacctcaactgtaacatagggggttgttgaagtcagggtctcaataaaggagtttaaaggtctcctttaaggaagccattattgtggtaaattcttattgttatccatgaagattgccatttcatgatttcctgtctttttttgttgttattccaaaccactcacaaagggccactacactaagctttgagagttagtttctttccccattcttcagtactgtaaaaccatttctcggtccccagtgtcactttgttcctttctaccctgactctcttgagctcactgacttctaaatgccaaaaaaaagtgctctattcccttagcattttgctctaaaccaactgccaaagatagagaataatctaataaagcaatcttccatttgagttaactaatcctcttaatagaagagtagtacatgaaactcgatggccttctaaattaatttctagtgataaaattcccatcactagccagagtagtagaaaaaatatgaaaagaaaatatagaagcatttatatatgcttttgcttttgcatttatatatgctatatgctttggatcacagtattttctggttgactaccctaacttagaaagcagaacaggcccagaaaaaaatcaaaagaatgtgaacaaaccgtgagttcccaaaaatctttgctaaatcacactttcataagccctagctcagctggggccacttgagtttcctggaatgccattttgaaatcactggcaacagacactggccatgcatttcgggtagaatgtggagggctttcaaaataatggattttcctgctctgaaatgccgtcaacactgcaatcacttgttaattcatcatagtcttgtagcaagattactgattataaagtcctgaaatgaatagctagggctggagaaagtgttggaattggtatttattttaatgatttagggattgttgatcattcattttcaactatttgtaattgaagtcttgaaatagaggaatttatcagaagaatgcctccttcacccttgtataatttgaacatactgaaatggcattatgtggacccataaattgttcatgtgcacaaaggggtaatattatcacacaggccctcattcactcagtgctgggggaggaaaggcatggacgtatgagttatcacttgctatacagaatcctatatcttcacgtcttacatttccaggaggctttttaaaaatataaccttcatattacttacactagctagtcattcattttaaaagatacttttatcagaagtttttatcaagatttttaaaattatttatttatttatcaaaatacaaatgtttctgacaaagtcactttcaaggtgtcaaagatatcatgttcctgggcctggagcaatggggttatccgcaaaacactgtgttgaattagatgtatagcccctaatacatgagccagaaatgataaacatgttaaaatcaaattcagttgtctctttgtggggtagtttgacgtcgaaagaaaagacagtgtaactttctctttttcattgaagctgtaataaagaatttagttattatttttaaccattgcagaatgcagacattattttataaagacagacatctgctttaaagcatcagttttccagagataattctgcctttgctattaaaattattttcttactccaaatctaaacttgtgtaatgaataaaatctcaatccactgggattgatactaaacattatgtaagccgtatatcctacaattttctgtcttaagggaatgtttataacatatcacacatgctgtatgggtatctgttaaatactcttgaacaactctctcttttatatcgtttatatttaggtttcatttcacgtatttgtgtcttccattttgttttcgagatcttctagatccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctaggtgatatgcttacactttaaaatttgaaaagcactgctctagataattgtcagatggtagatgatattttgaaggggatgaggattactaatggatatgaacatgttatttaaaaggcaaaataataataacattatattaactaatatttttgagcacctcatgtgttccaggcatcacactcttttgatgctttttgcatacattatctcatttgagcaaaaggaaagagaagcctctttttctgaggagggagaaatcagttgttagataaggaaattcaggaatgttctagttatttattatagctcagagaaaagggctaagtctagagtggaagtattcatattaaaacagctatagcttatatatgcaaggggtgtaggctagagcagagataatgtagacaggaatgtcttatgaatgaccagaaaaaaaaaacaaacctgttatatagtggattcagctaaccagacaagagctatttggaagtgacatagccaaaatgctggaagaacataattactttcactcatcttctcacttcagaacaaaggttaaaacactatgtttcatgtttactctatttgtaaatgtacatataatagtatgttactttatatggatccaagtgattgcaatgaataattcttacaaccttaatattggcataagagggtgtctttacaatatgtatttatgagttaatttctttaaggaagagccgtaagtataagaactgatgcagaagaatataagtatgtttatgaatgagaggaactagtttctgatcttgattctgaactgatacataccacaataaccaataagccaaactacaaccaactagtttgttaacaagattagtgctattggtatgtttcatagaattatttttaatggcacccaaaacttagtcttgaatggagcacttcacagaatgaagttttctgaaatatggaagaattagtaacgcttctatttgcattagtttttagggactcagatcatccttattctagtatgaacagtttctgtaaatttataggaggcactaaaaaattccattaaggtcattgggagtcactactaaaattctgtttctctgaaagtaaatataaaaggcaggttataaataagtagtaatattatagatgagacttgtattagttaccttatgctgcataacaaattatcccaaaagttagtagcttaaaataacaaacatttatcatctcagaatttctgtaggttgagaatccaggtttggcttagctaagtccctctggttcaaggcttctgtgaggttgcaatcaagatgtcacttaaggctgtgatctcatctgaaggctctaccagtggggatccattcacatggtaattggcttgcttgggtttctcatcacctaggtctttccataaaggctgctttatgacctgacagctattttcccaccaaacagaccaagagagctaaagagaaaacaagcaagtccaagatggaagccatggtctttttataatctcatcttggaagtgacattccattccttctgccatatgctattcattagaagcagattagtaagtctagcccatcctaaaggggaggaaattacatgagaatgtaataccagcaggtagggatcactggacattgaccacaatgatgtttttctttcttcttgctttcctattttctaacatgtcaattttggacatgtgttacttgtgtaaaaaggaaagaaaaaatgttaaaggcaataaaagtaagagaaattcttctgatcagatgtattgatcagaatagtcacctctctgtgaggctttcttagtaagacaattgaattgactgaagacaggatttattaatgaccttcccgactatatattagatcatgttacaaattcaagtctgagattgttattctaacagggttttgtgtagtttgcaaatcttttgcaccaaaacattgaaatagtaaaaactccttgtggtaaaatgactgcagcaatctttctcagttgcctaacggtctccttcttgctttgttcttaatagcatgcttgagagttcaaaccggcttgatgaagaacacaggctaattgccaggtatgcggcaaggctggcagcagagtcctcttcgtctgtaagtagttggagtaaaaggattcgtctgttggcatctgggatccttgaattttatatgtcatgtttattgttattatagctggtgctgattaccaggacaatttgtgctaatttattgtgcatgtgtttgttgctaagtttgtggtgtcttggtggtgaatttacagtttaaaaatggaagacttgaggaacaaaaccatccacagtagtgtgaccctggagtcaagctggaatcctcgcatcccccttcattcagtgtcaaccccatatgaagtcccaaggaagggggcaaggactggttgtgattcctttatttaaagcaggtgtggttagtgaaggcactaagtttaaggcagagtagttgcaagtgacacttaaaatataccagtagaaataatagagctatagctttctccatttgtgtcagtctctaagacaaaagcaactgtcagctcaacacattgattcagaattcatctgtgctgactaagggtgagttgctattagtgcgtcacaaaggacaaagagtggcaggggagcaagtgaggaagctgttgcctgcacctctcacatcagatgttgcagttatcagagcccttcatgctgagcatttaacctaatgatcccagatgggagctgcataatgaccgactgcattagccctggcagttgctctctgtgacatccgtgactgtaacactgttagaaactaccatgagcaagatggaggggatccaggacaggctaaaagtgtactgtgtgcccccaaaatcagacatgataaaacagagacgtaattggagtatatgaaattttaagggccataagtaaggagcaaacatgttaaagaaaattaaaatatagaatcagctgagaatacaggagaattagattttaggacaagcaaccactccaggagtcacttgaaagtaaaggcaaaacaaggtttttggaaaaacctcttttccaagttttcttgcctttatccatgcatatacttctataaacagaggctatggtataccaagatatgggattagcaatgtgtgtcccagctctccatgacctcatgcaaagcagtgcttctttgagttcagtctcctcatctgtacacaggtgtaaatatgcttattatatatgtcagtgctgcctgttattagcatccactgagatagtaaaatgtgtgaaagtactgcataaaccagcaattacaaaatggcagcctgcagaccaaatttgtcccccagaaatgttttgttgagccccacagtgttttcaattctttattagatgtcaggacttacaaatcagatggttttccttgaaagtctggattttcatcttatcttaaaagactgaccagatcagatgcatgttccttctgacagcaggcagctggagtggaggcattactctgctgcttcggacagggcaagtgtgtggcactttgccacaacccctaccctggcccacctccgtcacttgagttacttccctgcccctttcagcatttgcattagtgatccctggcagactgctaaatctccatgcacatgttattatttatatgtgtactaaattctccagtcttgttccatttctttctggagaacattagtaacttgtgttccttgcctacttacactatatataatctttgtggatccatcataggaaagataccgtccacacattaattctagttcctttgtaaatctcttcataaccacatattaagaatagtatgattagctgagtaaatcatgattagtaagatgacacttggttagaaaggagatagaacggtcatttagtaaatgggtcaatgtttttctttataattcctgatcaattaatatacatagcaaagcaatgactgaaattcacaactggctcagataagtttctaccatttatcaatacataaagtatatgccagaaaaggaaacttatgtaatgaaatcagaagaaaatcttgaatcacaagtcaaagttgccatatgccagaattagctaccgaaagtcatttagaatctaaaatgtaggacctcaaaatttcttgttagctatataagtcattctttgctgaaaagaggtgtaaattaaaatgcatagacagctttataaaagcaaaacctttacaaaacttaatctttcctacagttaggtttatggacattaaaaagcaggacaagattctctgcatctggcttaggcaacagttgccatttttaaaagctttccattcttcggtagaaagatgagttgtgatttttaaaaatttgtttttaaaacaataaaaattggtgtggaggaatttctaaaatgtactgtaaggcaaagaaagcaagacatacataagtgtacataatatgaccccatttttgtaaaacaacaccaaataaatccttgactaaatatacataaacatacacaaacagatatatatatatggcatatgattaatgatatctatgtttatatgagaatggagaaagctgtgactgcatgtataccagtcgttaaagctgattgcatttctgaaaatgaggagctggagtggtgagaaagtagaaggaaatcaaagaatatacatgaatatgtgaattcatcaatctaaaattacatgtgtgaataaagaaagacataaaagtttgttgattagaagaatcagaaaagtaagtcttaccaactatgactttaaaactatatttttatttatttatttatttttgtgagatggaatctcgctctgtcacccaggctggaatgcagtggcatgacctcagctcactgcaacctccacctcgggctcaagcaattctcctgcctcagcccccctagtagctggtattacaggtgtgtgccaccaggcccaactaatttttgaatttttagtagagatgggatttccccatgttggccagactggtctcaaactcctgaccacaagtgatccgcccgcctcagcctcccaaagtgctgggattacaggcgtgagccaccatgcctggcctaaaactatatttttaattgtacattacagtaattgaacggtaactctagagaaagcaccctctcaacagtgcaacatcttttaaagccacctataatgaaagaataggtacaatggggacagtgtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatatcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattcaacacagattgactcacagtctacctccacagcatacaccccaaaaattgtccagctcatctccaccaccacccagttcagcctgtccttttcaaaaacatcaatcttatgttattccaggtttaaaccctctaatgtgttcccatcacacttcagttaaatcctactcctcttaccatcacctgcaaggtcttacctgacctgattccctcctgccattccagcctcagctcaccttgctcagcacactcccacctcccatgtgttcctcctgtctacagcctttgaattagtcattccctcagcctagaaagctcttcctccaggtctctgtgtggatggctccttctcatcactggggtctcagctcaaatatcatctcctaaaagaccacctgtctgatcctacctaattgcccctagcccagaaactagtctcaattacatacccctgtgtgtgtgttgggggcaggaggttgtcacttatcactatctgaaataatcatgtgtgtttgtttcttcgtttattgtctgtcttcctggactgaaacggaagttctttgagaacagaggccatggctaaatggtccctggagcccagaaccaggcctggcaattgtagaagctcagtagatatacattgagtgagaaaacgatgaatagctgagttaaatctcaaacttggttctgaggaaacccaacatggaacaacttgtactaggtcggtgcaaatgtaattgtggtttttgccattatttttaattacttttaatggcaaaaaaacgcaattacgtttgcaccaacctaacacattctagtaatatatttcttgaaacagcaccaaaacatttccatgcttaaccccattcttaaacactgatgtgacatttgaggtcaaactggaggagtaaaggaggaggttgtgataattatttcatgcctgtaaaatttgacctgagaatttggggataaatgatcaaagtattctttaaagttctcaagaaagaataaaaaggagggtgcaaactctggttggcactttttcatatttttttctagtaaggaaagcttttggcttagttgtcttgagacctggctgccatcattaggaaaccacaaattaggatagaaatagcttcataaatgtgacaccatgactccatcgcctttgaaactactgctctactctgacccccagggagatgtgctcacatcagagctggaataaaaaaatttaaaaataaaattaaaaaaaagtttgtcacatgtgatccctgtcaatgtagcaaataataggaggaaagaattaagaagggaaagagcagatgcatagtgacgaattataaaaaaaaatagccatacaaattggaatttgttcaggatactcacaagtctgtaaaattacctattctattttatgtatcatttattatatctactacgtgcaagtaattgtgccaagtcagaaaaaagcattgagagtgggagccaagtcttcaaatgagcaaaggcactttaaaaaggtaggagaaacaacccaaaaaaaggaaaagggtagttgggggatgcaagtaaaagtggggacaggcaggcattggagaaagtgtatgagctgagctagcaggcagagggctcgaagcaaacaatgtaaaagaaccattggactttgtggttcgtggaatgcttgtgtgagtattgatgacactgatgacaatggggagtaggagaatggaggggccgtcctcaaatgtactgatactttacatcaattcaggcactggaaagatcatggcaagaaaaagaagcaaaataagccagttttaaattattgacaattagacttaatccaaagtttcagcttttttggaacaaaatattacggttgataacctcagcaaatgtcagaattggaatgtaaagcagttttgttttattttgggttttatttttttcagtccacaaagtcaaccaataatatatggtggaaaggtttatttaaaatgactcagaattaacagatgtcagtaagtcagtgagtgtcccataataaaggcaacagaaagagctaaagaagaaaggaggaaaggagtgataaaaacaatcattttatctgctgttggaaggctgtgccagcttgaggccttaatgaactatgccagagttgaggccattttctgaagaaggacctaactttctatgtagtccgttcattcggactttctaccagacatcattccataatcccttctccatcccttagtcccttttctctaagacatattatgattgctaacaagcatggagccatccattggggaagggaccacagctgggattaataacatatgctcacaggttccaggtggcagcagtaagaaacctgggtttttgttttgaggggttgaagtgagaataaggacaactttaaaatacatttaaagtacatgtgtacaaatatagtttcatttcatcctcagaacaactatttaaggtaggcagggtgactattatcatccccattctacagatgaaaatttaaatgtgaggtgttatttctactctttttccccaacatgacccacttcaccatcattgtggtctaggttgtgtagggcaaacttcatggggaaggtgagtttttaggacatttcaggacagtgaaattttgcagtgaaagttgggagatagaattaaaggtaaaaatacacatagactttgagaaaagcaacaagacacttgccaggctagcactgaggaatcaaagaataaaatgaaaacatcagtatatgaggcttgtataccagaccaaagaattttaattctatcctgttatgatggacagcagtggtcaggcaagtgacagaatgtccgcatgtttatggcaaaataatcagctcactaaatatgcaggttgcatttacaagggattgactagaagctggtgggaagtgatgaggaactatgttagatagatggttccagaaataaaaataaaggaacccaaaaaggagatgattagacaaaaggcaaaatagtgctgaaatgttaatttacaagattctattactcatttctgaactttccattagggattccagattttccaacaacaaccttcacacaactcagattttactagcaatcctcttttctttcactctcttgttctttccttcctcctatccatctgtcccgatataaagagaagggataaaacatcaaggtcaaagggggctttgtggaatatcaaaaggaggtcaaccctgaccagagtttccacaagctgcagcatcacgcctccatcccttcttagaaagaaaagactaacagaaattcacaagcccacgaatattttatcttggttgcactgttaattaacctactcttccacttcttcagagcactttgttttcccttccaatactctgcttccactcgggcatgggggtaacacatttgaggggaaagcaggacttcttttgaggaaataccccagagatatctgcctccatgtggttctgtctatttctgattccagaatcagcatgaagcaccatgaaggccccaacaaccctggccatgccttaatatcactcttgctgcttgtttcctggatgtttttggatcgcactctctaaatgcatgtctttaaggactagagaggaaaaaagaaataggagtgagaagagatggcggaaagagagattcattctgtccctgagttcttttgtgggttctagagctccccaacccatctctgatgagcagcaagtacatcctaagctcatctctctgagccagcagcctggttctctagacatcccagggccaaaagctcctttaggtaatactactgcaccatggaaacccacccagggaactcatgtctctaagatgacaactcaataatcagatctgtgagtttaaggggaagatagagttcctcatttcatttaatgactctgtctaccccaggtaacacacagacatttcagcaatgatctttagaaggtaatggttccttatagcacctttggtggagccagtcagggttagtattaggagtaccaggaatcttcaaattatattgtatgggtcacagcctgtcttggctagacctagcaaagcaagtaccagaagactgaggcaggctgatatatgtggggtttggggctagccagcctggattcacatcacgtctaccacctacttgttatcgaacttggggaaatctttcaactggtctgtgcctggattctctcatttaataaacagagataataatggtacctatatataatagaactgttatagaatgaaataaaataacattaaagaagtcagcagagttcccaggtacagactgactactcgatgcacgttacatatctcttctttattttttcttaccagagctgttgctctcttttccttccttggaccaaatggctctgttgtgtttctgtctttagaatgaacaaagagaatagcaggagtcatagaatatcagggtgttagccctggaggaaatcttggaaatcccactgcactgattttcaggctgagctttatggcatcctgagggctctgcaggggcacctgggagggcacagcagggcccagcaacacagggacttgtcctcatttctttaaccccagcagcacccgaccccttaaactatctgacatgttgggtatccatggcatatttcttttaaagaaaggattccccgatggaatcacaaagaggagaaaacaaaaaaaagactgaaaaccactgaattacagttccatcttctcaccacacccacgaaatgtataatggcttactaatcattagcctcctgattctgggggctttgcgaagcaggcagttttaaatcagccctccaaaatggaaagctacttccttgtacaccaagttcaccttccattcgcagtgctttgctccgtcttactggcttctatgcattttgttgagtaggaaactgacacccccagctcccaagaatacatgacttataaccctgcttaatggcttctgactcacttagggataatttgccttgccaggtcacatatcctttatggctagcctaatgctcaccaaatgcagggaagcccaggctctgacatcaatagttgactgacacatctcacccccgacagaggtcacaccaatagcactgtatgtcacagactcaattactgtgaatctttttaaaagcactttccttctaaggtggacttccctgagatccattgttaaggctgagagatttaagaaaaaaaaaagagaaagaattttgtctaactggggttttctcagataaattcaatgagaagtcccttcttggtgagagaatgaggttacttagttttgtgaaatgagccccatttatccttattttcccttcaggctcctcttacttggtagctgcaggtactttacggtgtcagagtgtgatcgtaaataacaggaagatgcatttttgtctcttaagcagcatgctcttcaaagttggacacattaccttacttgctagtagtaatgcattacattacttgctagagagatgactggaccctggtgatttaactcaacgacatgctgcagaagcttctaggtttggatgtactggaaatgaagtcaatcttcccgtcacccacagcacccatctagctatagtcaaagcctcttaaatacactggaatctgttggttagggaaggtcggttctgctcctaaacataggatgatcccttctctctttgttctggtggccttgatctgctccgatgttagtttcctgaaagctaactaaccttggtttctcaccttcctcctctctcccaagagaaatcttacaggagatccagagacttcggctagagcatgaacaagcttctcagcccacgccagagaaggcacagcaaaaccccaccctgctggcagaactccggctcctcaggtaggagagagcacccatgtcatctcagggaatatatatgtgtcagatctttgagaaagtctagcagtgtctagccagaaaacagtcctcagctaccttagctgctgacatttgtttttttcatagcacacacgtaattgctgatatttgggggatttagagagaagctgtttatattttgttctttcatttggtacagggaaaagcagtgtgtttctgtttttgtttttgagacagagtttcactcttgttgcccaggctggagtgcaatggcacgatctcggttcactgcaacctctgccttccaggtacaagcaattctcctgtctcagcctcccaagagctaagattacaggcatgcgccaccacacctggctaatttttttgtatttagtagagacagggtttcaccatattagtcagactggtcgcaaactcctgacctcaggtgatccacccgccttggcctcccaaagtgctgagattacaggcgtgcgccaccacacccggccagcagtgttctttacatcaaaaacaacatatctcactaggaacaatttaaacatagctctttttagaaataatcagttaaataaacatcacaggtttttaaatttaaaaatttacccctaactcataaaaggagtctgattttctctaagtcttggtctctaatatctttctttatattcagatctttaaaaataggcatcacaccttcctgtactataaaggaacataaaagcctagtcttctttagtctgtcatcataaaatacttgagttagaagggactatagaagtcatcttgttaccagtgaagggtcttgaccacgaagttgtccagggtcttggcattttgaataaagaattggacaaaacgcacaaacaaagcaacaaaagaatgaagcaacgaaagcagatttattgaaacgaaagtacactctacagagtaggagccagctcccgtaagcggttcaagagccctagttacagagttttctggggtttaaataccctatggaggtttcccattagttatttgggtacaccctgtgtaaatgaggacttggcccaggaccactctgattgcttgcaggaggcgaccaatcagaggctgaagtgaagttacaaagtgacatcctatgcaaacatttgattggttgcaggaggggaccaatcagaagtactttccattattcatctgcctcaccatacaaagggagtagcctcggatccttttgttacttgggtgtggaaaggcgaggttttcctttccattcagttctaggaagtcagtacaaatcgtccttagtttcgctgcctccagtccctattctcctgactcaatcagattctgccgctgcatttcagtgcacttctcagagtcagaagctagggagtagcaggccttggaaaagaaatgtggtttctcctactactcccacgctgcaaaatgagtcttgctgtgggctccatttcagactagcttcttaccatgccttgaataaggctggtattccagtgtatttatgtggcaaacaacacaaaaataaattcaaagacattccctcgtataaatatcatactgttctttcacaaggcacctgtagttgggaagtattacattcttttctttttgtttttgtttgtttgtttgtttgtttgagatggagtctcactctgtcacccaggctggagtgcagtggcacgatctcgggctcactgcaacctctgcccctccaggttaaagcaattctctgcctcagcctccggagtagctgggattacaggcgcgtgccaccacgcccggctaattttttggtttttttttttttttttttttttttttgggagagacggggtttcaccatcttggccaggctagtcttgaactcctgacctcgtgatccacctgcctcggcctcccaaagtgctggaattacaggcgtgagccaccgcgcccagcccattcttttcatctttcagtttgggtgccaactatgttccaggtatatctataactctgagtcatactttttatagtaagtacagatgcctctttgcagaaacccttgtcagaattagtcctgttttcttcttccatacaaaaagacgaaatgaagcaagttctttatgactatgtttggattttaccaagttcctgttgattgcatggatgtttccggaggctctatctttgctctgctcttcagacactttaacacctgagcacggcagagctttgtttttcgttaatgcatactttcatttttgtcttaaaaccacaatgaactttctcaacgatcatgtttccctttcccttttcactttcgccacaagaaaactgaaagctgagtcacagccagaagtgacaatgaatatgaatgataggcatttctatgtgctaatctgacgctttgctgcatactaactctacatacactgtcccgtaaaattactgtaacaaacctaggagataggcagtattattctactcgtttaatggataaggaaactgagattcacagaagtcacacagaagttgcagatatcatacctttcacttagtgtatatatttatgtacttatatatgatttataaggagaaattttttcttagaaaaaaatttgtataattgtgtgtaatttatgtatatatttcctaagaaaaaaattatcttgtataaccatgataccatcttcaattcgggaaagttaatgttgatatatggtatttaatataaacccatattaaaattttgacaattgttctaacactgttctaaaagaaagtagcttttaacggccgggcgcggtggctcacacctgtcatctcagcactttaggagtgcgaggcgggcggatcacgaggtcaggagatcgagaccatcctggctaacacagtgaaaccccgtctctactaaaaatacaaaaatattagccgagcgtggtggcaggcacctgtactcccagctgctgcagaggctgagacaggagaatggcgtgaacccgggaggcggagcttgcagtgagccgagatcacgccactgcactccagcctgggcgactgagcgagactccgtctcaaaaaaaaaaaaaaaaaaaaagaaagtaggttttaacacacatatacattagaaataatctgacagactatcagaataaaggcacttctttagagatgaatacatgtagtgctaggaaaggaaaatcactatttagtcttgttttctcattctccttggaaggtggaggttacaccacagatttgttattatacctacatttggaaaacgctggtggaaacttagagaagattgaatgaagacactcttaaattaatttttaattgaattcgatgtcatatttttaagagattactactgtaagataaatgtacaattagatttttttagtgttgactaattctaaattaatttgccattactcttaatggcaaaaaccgcagttacttttgcaccaacctaataataccagttaacgttctctgatagtttttaaatgcttctcttagtgtttctcacctacagttttagaaggttgctttaaccctcttcccaaagtgtttctgtggccaaagggccaaaattacagaacagtatcaagaagagaactggaaagaaatcagaaacattatctattcttgtaccaaagactactgtggatgtacctggaacaccatacacagacaaggtcaaaaaaaaaaaaaaaaaaagagaaagagaaagaacacctcctgaatttgtcactgaggaatattcttgaatggggcaaggcttttgaaattagaatgcttcaacccaggaagacaaagactaaaataagataccattaaagcatataaaattatgatgtttctcatcctctggattcagaaaagaagcaattttaaaggaaattgaaagaaagattgcttcaagagtaagcagtccttactcttgtaaggattgcttgtaagtggcaataatagttaaaaatataaatttaaaaatttatattttatagttaaaaagttaaaaatataaatttattcaaaaagaattgtgaaatatttataaattttaaattcataattcattatagaagaagcctataagaaagtgaattagaaatgtcctccactgctttaggaggctgaggcaggaggagctcttgtagccaggagttcaagacaagcctgggcaacatagtgagaaaccatctcttaaaaaagaaaaaaagattagtcaggcatggtggcacatgcctgtagtatcagctactcatgaggctgatggcggaggactgcttgaacccaggagactgaggttacaatcagctatgattatgccactgcactccagcgtaggcaacagagtgagaccttgtctctaaaaaaaaatagaaaaaaatagaaatgtatcatttatatcactaacctgtcctcccacaaaatatctttcaattgagtgagtcattgacctagctcactgtgacatttttatatcatcagtttttcgttgcagagttcttgtcatagtttcatttaatatgctatcattgagactagccatatccatttatacattaatacatacatgtttaaagtttccatgcagttttagtatgtaagtatgaatatttcaaactcaaacagaaatctttggggcaatgggaaaattatatgtattacttattcagtaataatcattcagtaatggatttggaatttatttggaaagtatacatatacttcagaattgtgaaccattaacattcctcatcatactgtttcatttctttccccctttaaagatctttttggtacctcttagtgtcaacataaatgatcgagtatagattgtccttagttgttttcattcttgctgacagtttaataaaaggtctgtaaaacaaaacaaaattaagcatgaaccttatatatcatcttcacttgttgaacaagtatgtagaaatgcctttattttgacttcactttatgaaaccaaactcaaacccaaaaatttaaatggattgtatctacgtgctgttaatatctcacctctgagagacacctcaatgggtgctgaagatttcaaatgtacttttctaaatatatttccaaatactaaggtaatcaatattttctgtgaatttgcaaaagggttcttagatttggagaatctggaagatttgcctttttcagtgacaatttggtttttgtttgtttcaagggaccccatagcacatcacagggcccactacatagtaagcattcagaaaatatttcattcaatggttgattaattcagggtagaaaggtctgaaggaaacaaaagatctaaaaggactttaattctgatgtagtatgactgctaacaaaagaaacacttccagctgtaattgttcattcatttgacaacagttccctgcctggtaaccttgtcagagacccagagatgccctttttctgacagtccacaagtccctcaagaatggaaatgtgattagctcagagagttgcatgccgcttctgatgtcagctgcttctttcttagacagcgcaaagatgagctggaacagagaatgtctgctctccaggagagccggagagagctaatggtccagttggagggtctcatgaagctactaaaggtaagacctgccagataaattttcctgagcttattttccatgtcatctgtgaaaatttttgcacataatgtgcaatggtttttccaattgctgtatgtgatttccctcaacatgttgtttcaagctcagatgtaaaacaatttgttagaccagtgtagcagtagctgtcagtaatagaacacattcttttttttttttttttttttgagacggagtcttgctctgtcgcccaggctggagtgcagtggcgcagtctcggctcactgcaagctccgcctcccgggttcacgccattctcctgcctcagccccccgccgagtagctgggactacaggcccccgccaccgcgcccggctaatgttttgtatttttagtagagacgggctttcaccgtgttagccaggatggtctcgatctcctgacctcgtgatccgcccgcctcggcctcccaaagtgctgggattacaggcgtgagccaccgcgcccggcctagaacacattcttatccattcctgaaaccagactgctgagggccttcatggggcaacttcttcttggcttatttccagtttctttatgtctgcaagtaataaaactggatttatttagaaatattttatatttagtagctttcagcaattctgattaaattaagaggagtgactgttaatatcagtaaaatattttattccattagtatgctttatcagtaggtcacatgatttctagtgaactcagacacaaactctaagagagaatatctcattactcttctgtaagtaaaatgtttaataagatgatttatagaagtcttctgtagagtgctgtaatctatttttctcattgggaagtggcattcttcttttagtaaagccttattcccttctttagtatacattaaattgcatttaaagtcaaaagcaggcaaattatggccacatgtctacagtcagcccatgtgatcagtgccacatgatcatcctgcctgatataaacaagcaagaagcagtatggattggaactgtgacatgtcaaaggcaggaagtgaaacttctgataggagaatggtaaagggaagaccctggggcagctcatttgcgagagagggtctcccaactttcagtccgtggatgtcccacggccccaacacaccaacatttgttgtttttattttgtctgtcctttctttctctcttttttttgtctgtcctttctttctcttttttttgtctacctttctcttttcttcttccctttttcttcattttttttgtttctttcttgattgccccctctttccttctttgttttattttttgaaagctactttgtcccagccactgttcttgtaaactttcttttgttttccttactctattttattccttttccctccatcagtgtcctctttaacaattggtattgggaatactttatctttactcaacaaaattgacttttcagtaattagatatgtacagtgtagaattcaattcttgttgatctatcttgggtaagacaagactagatagttcataacctgctgctgtttctggcctgttaatctcatttgataaccaaaaataaactctttctgcttccctttccaaatataccaaatgaaaaggactgaacctatctttcccctcagtgaatgacaggaagctttgaaaactgccccctatgtttctattgcttctgtcaccattagctatgactctttccctatgggatagaagtctattcaccaccagccatgttggtatcaacctagcctaacagagtactgccttttattgagatgtacacataccaggacagagaggtggattgtgttgaaaaatggttgtacatgcagagaaaagagatgggcctgtagtctcaaataaccaagtagacttggagtgatagtcactgaggtggcagaggcctggacctgccgtcaaaggtgtgttgatgtttccccatcttgcgttccttcacactgtgtacatgctcttattggaaccctgggtaatctaactgttattgattcaatctttctgtaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaaggaaaattatcggtggttttatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttgaattgaagttatcctaccctctttcttctttgtgtatctttaagatttattgaaggaaccataaaaagaacactcataaaacgtttaataatgaaggcagctggggtataattgcagtaccaatatgttccagagtttctggtacacttccagttccaaatattatgtaccagtctaaaactgagtagactgactttgactccagaaagtaaggtctcaatattagttttcttagcaaagttactggaattagacctgaattacagtggtaccagatctttgctcacggctgtaagcttaactttcatgttcattaatttcaaactattgataatccatggctaataggattattgtatagattttgatagatactggatgtgaaagcactttgtaaaatcttatacgtcagctataagtatgaatgtatgtatataggtatacatacacacaggtatatataaacttttcaaatttggtccatattttacacacactcacatacacacacacacacacattcacttctcttccttacagttcattaacagtgtctccatcagggaaagaaatttgaaaaggacttttaatttgttcagatctcttgtaattgcttttaacagtagaaaaaaagagtcatttttatgttagagaaagtgacagacaagtccagtaagtttatattttcctatttctggtaacattagatatgatcctagatatactaatatctacagagtgtggctttcgccataatttgagtaggtatattaaacagctaatacagtgaagggctgccagtaacagatgttctatatgagtgcaatgaaacatctgatattttttcttaagttttatctataataaacatttttgtgtgagagaggtgattagtacagggtgcatattttagtcaaggataaaactaaggccgtgcacggtggctcacgcctgtaatcccagcactttgggaggccgaggcaggcagatcacaaggtcaggagatcgagaccatcccggctaacacggtgaaaccctgtctctactaaaaatacaaaaaattagccgggcgtggtggcaggcgcctgtagtcccagctactcgggaggctgaggcaggagaatggcatgaacccgggaggcggagcttgcagtgagccgagatcgtgccactgcactccagcctgggcaacacgacacagcgagactccgtctcaaaaaaaagggggtaaaattaagcttatgctaatttgcaggactttttttcagacttacaataaggatccatttttttaaactacattttaaactttgggattgaattgtttcttatttgggaagataatgtctatacattggtattatgttaagtaatacaattgttctaacttggtggggaaaaaaagtcaagcatcattccaaattccatctcctacccttattctcttctctgtttataactggatggtccaattaagtcaggaaattgtagtcatcaggtttctacttcttccaaacacttcatggaatactagcaggccagcaataacctgcttgggcctcaccttcctggcttttcctagctcatcctctctggtgggtattctatgcaggcatgaaccagtcaaaagcgagggagagggataattcacctcagaaatgatcaactgcaatataaagatgatcgtctagtgttcaaaaacataccctcccagactctctctttttaaaattaagtattgattattataattaattctaagtaagtaaatattatttctctgcttaaaaacctaggaagatgactctctggttcacaataaagtctaccctggaggtcccgagacctgcccatctccctcttctagcctcatttctctctacacccagcagccagcctgacaccagagccacaatggccttcccaccctctccacaatacgtgtcacatttcccatgccttgctcctgctgttcccaggttgctctgctcttctcttctccccacactttctcatttctgcctgcaaatcttcactgttaaaacccaagtcaaatgatgcctcctgcctgaacagtcggaattaatcacctctcatgtacccccacaacactctatacacaatgagcactttaaaaggcctgattataaaaattatcatcagtgtgatgatagccagtgaatttatattggaagaaaggataaaaacagggctgaatgctgctaagcactgctttgctgcaccttcccaagctgctaggtgcggccaggcatgaccagactgcattctcagccaaactgagaggcagactcttcaggtctagcggggagggggatatataattctctgctgtttcaccagggtgtcctgattcaacaattagacatttgctcctttccttgaagcatccctcatttctggtggtgaatagaaatcaaaacacttcctggaaaatatcagaaaatgtatgaatcttgtcagactttttaaaaaaatggatacaacagcaagttgagtagacttggaggatggtgcatagagattaatttttcatttattctccaggaagtgagctattttaaatttgccaagtgtgatatatgttttccttcttccataaatcaactctctccttgggaattttagatctatatattgatctgcatggaccattgtcccttaagtctttgctccattaatcattgagtaatttccaggaaaggatattcacagagattattcactctaactcttctacagttgttagcagacaaccatgcctcatgaccaggctggaggccaccatcccaccgaggccacttcctgtgaaaatgaaactcagtgacatcatcactgatctgccccaatgccaagaggccactgccttttcctagtgttcctacaagaacagaacagaaaggaaggccagagatggcattcctcacagtgggtaggcactaggaagatgctctgcatcaaactggacagtgtcctgacatggagaggtggggccgtgatcacccagggtgtcagtgtcctacccccaaaagtctgggtaaaggctggatgtgacatgggagttgccagttgtgggaaagatgcaactgattattctcttcagcacaggatcttccacctaaattcttcacataatcaaactgcatgaaattgcaccaattagagattcctttgggaaatggtggctattcatcattcacacattggtgtaatttagattcagtcaactgtttttcccttaacacacaacgagagtcaatgattttcttcttattgcagaaccactaatgggagttttgaaaaagaatgcccacagaaaggagtagcaaaagttgcctttgagaccaggaactgagcagggagaggttgggtgaggcatgcctcagacccacaggaattagcagaacagcccagtgcactaggagatggggagaggcttacagaaaaggaggtggaagggccagacatatgagtcttcttacaaatgctgcctagagggaggagcccccagcaccctggagaacctggtataagaggtataagcaaggctggtgtgcactacagccccagaacagacattaaagtagtgaaatatggtccatagccccatatctcaaatcactagatccagatatgttccagaatttggcatttatctgattttgaaaagcaatatgatgcagatatcgtatcagttacctcacatccattaagaccaaattcattatggaatgaccagtgtttgtcagagcttttttggctttcagaattgcaaataagagattgtaggcctgtacttctgtaccaattgataaacagtccaaggccctcccatcaccctgagcacccatacatcttttccatgatccagcaactaaaaggtattgcctggcccagtagcaggaagccctaggacgctgctccagcaccacaaggtggtcctactgggtctgtgccctgtgtcttttccctcttcaggctgctgaacctttctatagtagtgaagcatagatggaagcgtatgatggctggtcacagtgcccacagtccttagactcagcatggcaaaccctgagcttggagtctaaagactggggatcaattttatctctgccattctcttgctcagaaaccttgggtaatccagttatctcctcttagcctcagtttgctaatatataaaatgggaataataatacttcatatggttattaagaggattacatgaagtattaggggttaaagtgctttatggactgcaaattgctattcaaatataagatattaccacttgtaccactgtactaggaaaatgaaacaaaacagtgtatgtaaaagtgctttgtacattgaattacttacaaaagtggagttatattattattgtgaacttctcaccatggaagacaatctgagttcccagggatgagacggtaacccacactgatagccaagagaatcctacttcttaataaccactctgtccaacttcccttctctagtccccactcccggctgtgtttggtcccttgataaagaggacagagacaagaggctcaggagccttgctaaggcctctgccttaaaaagggtgtacaagaggaattgccaaagtaggaagagctcagggcatctgaccagcgtctgtctccattgagggactttttgccagccatggccagcaaggctcccgcagcccagggcactcagagcccctgggctcagccccagccctgcccctctgactccgtctccagataaagcaattattttcacctctctgagtactgggctccacaacttcacatttagagtaagaatgcatacttcccagggtcatggagagaaatcagtgagagtgtatgtgaaaaccctttgaacatcataaggcacaacgcaaatgtgaaattatttattattggcatgggaaggtcaaggatgcagtggtagctcagaagcagaaggtttcaaggtaatggggctgagctgccagagtttgctggggaaaactagacccctccttgagcaggccgagggaagcaggctgcaaaaacatcacaaccgggcaaagttctcttccttgggcctggacagaccattacaaggtactgttgagagtgaaagaatgggaccctcagcccattgggcaccccatgggttattttctgtgctctgttctgttttgcttcatttttaattctgggtttttctcagtttatggctttaacaattatgcgtgatgctgagcctggagagctaacagcatggcatttttcaggattgatgtggtgtgttttaaccacaagccactgagcccaaagcaaatatctaaatggaatattccagagcattgctctggtggtatacatctaggagtttgaatgggttaatgatgactctctgggccttgctggagaagaattctcactctagcaaccacagcaaacagactgggatggaattgatgtgaacacctaatctgttgtgtatgcactcaagggtctccttgcattttcttacgcatgtggctgacttcttttgtcaactaattattaaaacagggagaatatttccaaggcacctcatttagagacaaatccttaagattcaaagtgtgacagtctcagaatagtttcatgccaaaaactgtagtgcaaagataagttccttcagttgttttctacttttttctttacttgtctttaaatcctactattcttattgtcctgctagaatactgctttttcataggagaagagaaggacatttcctgcaggaaataataccaaaaaattagaaaacaaggtttcttcttcttcttcttccccattggaatccctgagttactaatttgacaaaatcagcttttactataaaatagggataaaacaatttacacttcatttgattcttaatttgagacttaatatgcacaatattgtatgacatgatttaaactcttatcctctaaagataatgctagtacagtcaggttgaaaattcagaaagcatccattgcaaatagtcttctagtttgtattttaaactttctccttaatgtcttcttagtcctcggagaccttccttcaaggagaaagtatccacaccttgtaattatctgcatttaacagtaccttcattttatgggcacatgtcccatatactgtagagcaatgctgtactaatagttttagctttcaatatttaacccaaacttcagattacatacaataaggtcctaaattatctgcacctgcaaattagctttaggattaccaacacaattacctaggatttcctcctgctttgaaatttcattgtcactgttttcaacaatcaactgaggcattggggatgacatatgacattttcttgggaaagcaaattaatgacctgcattgtctctccagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagtaagtggctttatttcttgttgtggtctgcttttatgtggcaaataggtcaccaaggtctattgagtggtcaagagttgtcagaaccacatgtgactattgtagggtctttcatggctggtgtcagagcctggcctgccagccattttgggaactccctacaccaatttgttctcacttcacgattttaccttcctttggcttttgttgccctgccttattttttagtaagtctttgttcatcaaaagacaggaaatcttttcaccaatacccccagaaaacttcataaatgtaatctattttttttaattcttagagattttcttatctcatattgtcttttctttatattaaagtcaagactgagataagtaatcacagctctttagcaatgaggtaaccaagaaggacatttagtcatttgacagattccctgttctgatgccccgaagagttgaatcattgcctctgtaaggcagggctacagggttaagcctctgcagttagaggagtacaaagagggatggggatgccagccagcactttcccatgacagggagagtaactttattaatttagaaatatttttaacactttttaaaacctcttcttactatcactttttaaatttatagagaataataataaaaaaatcattctgtagaccttcaccggcagctttcattcccagaagtaaccactattaacagtttgatccttcccaaagttttgcttttgtgtaaatagatatgtttaaggatgtgattatagacacatactctttttttcacacaaataggatcatgcattgcattttggggtctgcaatttgcattttctttaaattagcaatatatcattaacattcttcgaagtcttcacatagagatctaaggaaaagagagacatgtttgaatatgggttttaaggcaaaagagatcataaacaaagttaaaagacagaaaacagtcttgaggaaaccatttccagcatatgtgtcaatcaagtttcataatttcagttatacaaaaatcatgtagagatcagaaagaaaagacaccaccaaaacaaaaacaggtgaaatatacgaatagacagaagaacaaagagaaattgccaataaatatatgaaaagatgttcaacctctaattacagaaatataaattttaataagtatcactttttgcctagaagattaaaaaaatgttttgaaacatcataatatccagggatagcaaaagtgcgaggaaaaaggtactctcgtccatgtagaggggtgataaaatcttaacacacttcaatgagagagaatgatgaactctctactctgagggaaaaggaaggatctatattagaactttttcttctaggcactgaatataactcaagagtttttaaaaatgtaattcacaaaataacttttaatttttagaaagaaaatatcccttctcttaatcatattttaaagaaatgtactatattttaaatcaatttgtgatttccattataattaatgtttttacttaactactctgatttttttaatttaaacatttattattttatttagttagtattactttctgaaaaatgacggaatgaaattccattaacccttagtgtgcctgaaacaaaataataatctttctctgccataaagaaacatagtctaagttccaatttatagtaccagacatgcatctgcccatgtcttggcagaagaaacaagaatcctcacccctttctcacgctctgggggcattcagtgcatgtgggtttcccattcccaagtggtacttacactggcaggaagagctccaagagccctgataggagacagcgcatgtcctagtagagaccagaatctaaagggctcagccaccaggtaagggcaagaaaaataatagcagctaggaaggcgcagctctcctggaaaacctgatttttcatctgtgtggattattcttaagaagggtgaccacacgcactggtttacctggaaccatcccagttttgccaggtcagccagccttattcatactgctctctttcaccttcaaaattgtccccatatggacaaataatatatgaaactccatcattagccatgtcttcttactgcaggacccactgccctaagcagtgttttgttgttgttgttgttcttgtttcaggaaatgaactaaagcacttctgaaaaggagaagtcttagaagttttcttgctttaggttattaatgggaaggataaataaacaacataaaaatttaggatagaaggaagctttggttttttaaattatttcttcttccctgaaggttcaagaagaaacttaaggaatgacttgctagtggctgcagattccatcactaacactatgtcctctcttgtgaaagagctgaattctggtgagttcctgattccctctcatttgtctgctcatcatggagggatccataagtgctaggggtctctcttagagatctgcttattgtctaatatcaaaagattctttaaagctctatgtgatattttgttggtctattcagatttgaggggttttttttttgtttgtttgtttttggttttttgagacagggtgtctctgtgttgcccggctgaagtacagtggcaccatcatagctcactggtatgtcaaacacttgggctcaagtgatccccctacctcagcctccctagtagctgagactacaggcacatgccagcacgcctggctaattttttgttgttgttttcatagagacagagtctttgctatgttgcctaggctggtctcaaactcctggcctcaagtgatcctcctgcctcggcctcccaaagtgtgtgagccactatgcctggcctattcagattttttaagtaatgtttatattttgcttattaaaagactattaacacatactcaatgtagaaagtttgaaaaaggcagagaagaacaacgaaaaatattcaaactgacctataattctggaatccaaagacagccactgttaacatctatggtgacctaaaacaacatgatgctaaggttattttatagggtcaagtgtattatttatctttttttgagatggggtcttgccttttttccccaggctggtcttgaactcctgggctcaaacagtcctcctgcttcagcctcccgaagtgctgggattcccagcccttatctatttaggtttcattaatttggaatgcctgatcatttaaatttgaatttcaaactgaaatttacctttgcaatgtctctgaagatagatctgcccagaaataaatagcataaaatttaaggagactttttatccttttaatactacaaagagtgttcaaaactttagcagtatgaatatgcaaataaatatcttaccagtcactaatacatctccatctattccttaaggccgacctaccaagagatttgtctggcaagactatggtcttacagctgagattgcaactataagaaataaaacttcagttttaaaaaaatcctggacttcgctttcttaaagcctctcaattgaaaattgttgctgctaatttagattaagattaccaaacggaataaaaagatagtagttaatacatcatgattaatggcaggtaaccactgccctagcaaatgatgagtacaaagttattcttggtgtagaagtcttaagtactgttagtttatactcataattctttaaagtattaagtgatagggttcacttaatattttaagttcatattttaagcattttaggtgaatattttatggttaggattaggttttaactcatagttcttaaattagtgtaatattaagcaaaagtaacaattttagttaagtctcttacagaaaggaaaaagtagaagtcttaaagagttaagtcagttactaagatggcaaaaattcctcataacatttctgagattttaaaaatgctgtataccaaatgattttatagtaattcatgtcaatatcaattcttattttgaaacaataaaaatgtatttgattaaaatatgataactggttaacattttacacagcacaggttgatttgtgaagcctactcctttatttgcaggtcataaaaaaatctaacgagtcattctttatttcttcaattgtatctgctagaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatgtgagtatcttccgcttggaagcattttctcagtaacaaaacaatctgtaggagacaataagaaagtaaaagcataattgtttagggtttttttaaccttcagaaggggtgacatagttttctgttctgccagagatatagaagggtgctacatttaaattcggcattgtaatatttcccctcttacaatttccagagagttatcaataacctaaaccaaccagtgcctatcaagagcctgccttgcccaaggcacattgctagtgctatacaaaatagtattaaaaaactgctgccacccttttaggactcacagactagttcaggagataaatcatcctatcttctgaacttattgtatttgcacttagaggataccatgacattggagaggtctctgtccagaattggtgtaaacaacatcacataagtatttggaattgaaataagtacatgtataaaatctcattataaagaaatccagtttggttgacttgttgaatttgtatgaatctgaccctccaaagacttatttgcaaaagttttcacccagttctggagcttgtcagaaaccagcagcatcagtaacgtccccactagactttctgtgaccctggatcagctcaaattagtcaacagagaaaaccaaagctgagaaacaaaggcaaagctgggacagagctgcagagcccaacttgggagaaaaaggagaaaaacaaaagaaatgaagaaagtggcccattaaatgaccatggttcatggagttatgggaaatgtgggcaaaggctgacccaaaagctgggggagggagtttctgaatgctaaaaatacttcagaagggtgatgttgcttaatatgaaaagtacttcagactagtctataaaaataaactggccattttaaagactcagagaagaaactaaacagaggcctttctggtgtttggctctccatccaagcagtgaataaacaatcagtaatcatggagaattatcaagaggtgtggtctgagagtcagctatgaagcagcagagagtaggatcaaaacaaaaccattatcatgggacttaacatggcagtacgctgctgcttaatatagtttgctttcttgtcctttcttctgtattctagaattgttggatttgttattcaaaatggtgaattagttgtcatctgttttgtctggtaaattcatatctatttgactttttattattaagcatttatatggcagttagctagaatttccttgtcctaattctaaaatccaagactattgaggccaccctaatctgctagccctggtatgctgagtagcagtaccagctaccaacatgtgactcaggagttagggaaggaaagttaacagagtcctgggcagacccatttagcctggccccaaacctccaaaaataaccagaacatgttgtacagctataaataaacgcaaacaacgacatttaagttccaacctagaaacttcttcttgaccacttatttcattttagggaataatttaatatttctattgtctaaacatgtacttgtgttttaccctgagactcttttagtcctatgatttaggtagtgagtttatgtccagccccatgaaaagctttgcatagtctaggatgaatagatggagacagagtcccacattagggaatgaggtcatttttatctatttatttgatagtggaattggataattaaaatgctttttttttttttttttttttttttcagatttagagctaaggtcaagagttatgggttagtagccctcctggcattgactagctgatattctaagacttaattctataaaaataaggcatgaatgtggtatgcatgcatatgtgtatgtgcatgtatgtgcgtatgtgtaacacaaaagaggttaaattataaccaaatgtccttaagcattatttcactagagggctcactctccacacagaaagtgatcttgggttctattttaaacaagaataaaaagagc

SEQ ID NO: 14983 - DNA, 10289 bp, Human
tagttcactgagaaggctatcttatttcagattccaggtaagcagaatcacttaaatttaaaagagcacgctctgtgttgatatgcaaaactttgttaaagtatacgttttgatctttaattcatttattagttacaaatgttatttactatttagtaagcacacgcaaatgtggtaatcactgcatttattaggaatacactgtaaggttacaggcagtgtgggtgtggattttgactgtatttgaagttttcttaccttgaaacttacttagcacttgtaaacctataccatagagtttagcctttatttcctcttaagagacttgaaaatcctacaccatctagtgtagtgctaatcctaaagaaaacaaccaacgattaagtgttaattgttgattggtatcaccctatgatcaattgttttcaccctaaggctcaagtgaaaccaaacggttggtcactttttcgatttagtattttttcaatttcttagatctcaggatatttttagtagattttggatgagacaacaaggatgtctgacgaccatcattctcagaaaatatctggcatcacctcaaatctggatttcgaacattacagagggatgaatgaggagcagtaccactggactgagggcctggcccactttgccatcttggtattcttaatctttgtcctagttcctggcacgataagaattttcaaataaataaataatttttgtattaaaaaagtagtatttagaaccgaatatcttctataatatagaaaattgagtcagctttcccagtaatgattctttaagttggccttctgaaatatgagaaaatgttaccctgatagtctcgatgatattttgcaccatgggtagggttgtattttaaagttaaatgactacatatattgttttttgtttttgtcgagagacctgagatggggctaattgaaaacgtctggagcttaaagacccgtgcagtttacgcagcaaggatattattgctctgaatttcaataaatcaacatttcactatatatcggcaaagtctacagcctttaaaaaatgaccaatatagacggaatcaaaaccgatgtagtcccaaagcggcacagagctgtatctgccaaagcgtccatttaaattcgtgcgttccaaggaaaattactgcttagtttctatccatttgcaaaagtttatgattttttcaggcattcctcacacctgttaggttaaaatcagtaacactcttaaaaagaaagcgagagaccggaaatgatatgagaatagaattggccactccagagacatctgcaaatgacactccatttttccttctcgcgctgcaaaatgtaccggtaaaccggacttcccgggactcgctgggtggccgacattttccctagcaggaattttacgtttccaagatctgaatggatgttaacggtcgggctaaatgccaggcaggtcttcattgtggaattaaacagcggtgggagcaagcggaataaccgagttcccctcccgcacctgagtgccggcagcgagccgcgagccgggacctgtcacccgcgggaagccccggccgcccgacgaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcaaggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctccctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggtcctaccagatccctccttttaattgtccatgcatgcagggagtttttgttgaaagttttaaaagaactgggtatgcaggtatggtttgtagggttgtatactaatagattgagaatccgaagcgctctcttggatgtactagatctgtccccattttttaagtttgaatgcagttgtgcaacatgaaaactgcagtgacatgttaccatttgactgtctccgtagttcgtgatgcatctgttgcatgctatgttttcaaagctcactgctatattggctttgaagtaaaccttcctaataaagctgtaggctttattgaggtcaggattatataaggcacaataccctctgggggaaaaaaatcatttgccctagctgtaattacagaacataaatttcactacgtactccctacctacagtgaagaataatgtaggaaacgttattcttgaattgtctagctgatgcgtggagcagcagcatcccaagtttgacaaggcataagaaagacattaagggaattttaccttgcagcagttaggtcgtctgcattttaagcttggaagtagttttgtgctgtgcatgcataaaagctgttggcagaccagattatatttgcctttatgctttaaaaattagtcattgatcctggagttctgcggaataataattaaggcttgggttttagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttgtaagtattgtctttaagagagtattttttttaaaactgttaacatagttgaaaagtcaaattgtatcactgagtagatctagaaatgacagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgctgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctgtagcagccagggacgcttggtctcatacatgttgattaaaattaaataccgacctgactggtgattcttgaattaaggtttattaatttgcagcatggtgacatggaccagaaggagagagatgttatcatgagggaattccggtcagggtcaagtcgtgttctgatcactactgacttgttggtaagtctcttaatgctttttaaaaatctaccaaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaaattcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagtgaaccctggtttagttatagtggctttatccctaaataaattgaattgtactttgttatatgatgtaaaaaaagactttttaaaaaatacaggagtcgatagcagcagttggtgacgagatggcactcagaaacggcgttgacgtaatttaggacgtggaatcataagcgaaacagcacactgtttgaataaagagcgagtcggtatttatatttgtttttcttttgtcatgattatttgatttttaagttgctccagctaaggcatttttttgtattagtatttctattagggaacctttcttattaggtggtttgtattgtctggtttctaacatgcaggtagctgtttggcagttaaacacgtttagagtaatttgagttacaacgtgtgaaactgagcaaaaaagcagtgataagtttgggttaccataccaaatatttgttttcccactggaaaaaagtaagttttagaaaatagttaacctttgcagcatttgtttacagtttacagttccagaagtgcgtcgaaatggattacataactgctcttttattcctggtgttcacatctgtcccaggctgacacctgctcttggctggcccactttggtatgggctttaatttcactaccccaaacacgatactgtcatctgctttataataatgctcaagatgcctgataaaaatctcattttgcagccagacaagccttgaatccttttggcactaactgcaaaggaagatttttttctctagatatgcattagcagctagtgctccagttagaagcacgaactataaccttgataagtaaacagcagctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggtgcttttggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcctacgagaaaaatttaagaaattagcatccttcaggtagttaaatgttccattgacatgtgcaaagtacctacttacggcaagtttttctgtgataatagacttctgtttatcagataagttattttctacaaccacatcatggagttgattgacgagctgagttgctgcatgaccctcatctattaaatcctataataaaaaaaacttttggtatgatgacttaatattcctttccccaaagttagtaagctgactttaccttgaccacagcttctagtttgtcaaaagagccactctgacaggcagcaaatactccatcaattttctcagctggtattacctaggtaattgaatgttcggtattaaagatgtttctaggtgagactagacatacactctgccaactggcccccgtgcccccagtcatttctgttccacacctaagttccatacttttctgggaaggctttgggagaacggaaagggccagagtaactccagccaccactaagcaaccaaggtgctaacaactgtgcttttaaagccctttaatggctttgtgaacttccaagtttgggcacacatggattatagcttgttctggtcagtggatgaagattaagttttcccctagcggctataacgattcctcagaacagtggccaagatcaaccaaaaagactgatttctttaaaggggaagtgccctttctctcaatgtctccatgtaaagatgccactaatgagattggtttaaaaagcccacaatatccagaaaattaaagaggattagtggtaccagtcttgtcatatggaaggcctaccgtgaaggtgaaaaacgtcatagaaacaaagaggattagtggtaccagtcttgtcatatggaaggcctaccgtgcaggtgaaaaatgtcacagaaacaaaagttgttaagtagtagtgattctgaagtgagtttttacatgggagtatccaaagacaagtggggtactccattctctttaataaatgattactgtaagttggatatgccttttgtttatatacaactggcaaaatagttttcatgtataagaacatctgctaaaattgatttaactgccaaaggcatttcttataaaatctaaaaactgaaggctgggtgcggtggctcccacctataatcccagcactttggaaggctaagcggggggcggatcacctggggtcaggagttccataccaacctggtcaaccaacatcgtgaaaccccgtctctactaaaaatatacaaattagctgggcatggtggcaggtgcctgtaatcccagctaattgggagggtgaggcgggaggtggaggttgcagtgagtcggtattgcgtcactgcactccagcctgggcgacacagcaagactctgtctcaaaaaaaaaaaaacaaaaaaactaacaactgaaagtgtccttttctttcctgaaatgtctgttacatgcctgacaaactgaaaagtcagtgctatctcctcacctcaaacactctgatactcccaggttattcccttatacttcctagtgcagtacttggcacttgctaaacacccagtatttgttggatgaaaatttcctaaaagccacaaaaaagccaactaaaaagaaattcagaatatccagtactcttaccccagcaatgtctgtaatcactttctctgtgatctcctttccacctgttaatcgagtagcgctttgaagaaatgtaatggcttttcttaagtctccttctgacactttaacaagataagctattccctgaagagaaaagagttgtttttaacctatgatggccaattaaggattt

SEQ ID NO: 14984 - DNA, 10304 bp, Human
acaaagaagcatttatagttcactgagaaggctatcttatttcagattccaggtaagcagaatcacttaaatttaaaagagcacgctctgtgttgatatgcaaaactttgttaaagtatacgttttgatctttaattcatttattagttacaaatgttatttactatttagtaagcacacgcaaatgtggtaatcactgcatttattaggaatacactgtaaggttacaggcagtgtgggtgtggattttgactgtatttgaagttttcttaccttgaaacttacttagcacttgtaaacctataccatagagtttagcctttatttcctcttaagagacttgaaaatcctacaccatctagtgtagtgctaatcctaaagaaaacaaccaacgattaagtgttaattgttgattggtatcaccctatgatcaattgttttcaccctaaggctcaagtgaaaccaaacggttggtcactttttcgatttagtattttttcaatttcttagatctcaggatatttttagtagattttggatgagacaacaaggatgtctgacgaccatcattctcagaaaatatctggcatcacctcaaatctggatttcgaacattacagagggatgaatgaggagcagtaccactggactgagggcctggcccactttgccatcttggtattcttaatctttgtcctagttcctggcacgataagaattttcaaataaataaataatttttgtattaaaaaagtagtatttagaaccgaatatcttctataatatagaaaattgagtcagctttcccagtaatgattctttaagttggccttctgaaatatgagaaaatgttaccctgatagtctcgatgatattttgcaccatgggtagggttgtattttaaagttaaatgactacatatattgttttttgtttttgtcgagagacctgagatggggctaattgaaaacgtctggagcttaaagacccgtgcagtttacgcagcaaggatattattgctctgaatttcaataaatcaacatttcactatatatcggcaaagtctacagcctttaaaaaatgaccaatatagacggaatcaaaaccgatgtagtcccaaagcggcacagagctgtatctgccaaagcgtccatttaaattcgtgcgttccaaggaaaattactgcttagtttctatccatttgcaaaagtttatgattttttcaggcattcctcacacctgttaggttaaaatcagtaacactcttaaaaagaaagcgagagaccggaaatgatatgagaatagaattggccactccagagacatctgcaaatgacactccatttttccttctcgcgctgcaaaatgtaccggtaaaccggacttcccgggactcgctgggtggccgacattttccctagcaggaattttacgtttccaagatctgaatggatgttaacggtcgggctaaatgccaggcaggtcttcattgtggaattaaacagcggtgggagcaagcggaataaccgagttcccctcccgcacctgagtgccggcagcgagccgcgagccgggacctgtcacccgcgggaagccccggccgcccgacgaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcaaggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctccctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggtcctaccagatccctccttttaattgtccatgcatgcagggagtttttgttgaaagttttaaaagaactgggtatgcaggtatggtttgtagggttgtatactaatagattgagaatccgaagcgctctcttggatgtactagatctgtccccattttttaagtttgaatgcagttgtgcaacatgaaaactgcagtgacatgttaccatttgactgtctccgtagttcgtgatgcatctgttgcatgctatgttttcaaagctcactgctatattggctttgaagtaaaccttcctaataaagctgtaggctttattgaggtcaggattatataaggcacaataccctctgggggaaaaaaatcatttgccctagctgtaattacagaacataaatttcactacgtactccctacctacagtgaagaataatgtaggaaacgttattcttgaattgtctagctgatgcgtggagcagcagcatcccaagtttgacaaggcataagaaagacattaagggaattttaccttgcagcagttaggtcgtctgcattttaagcttggaagtagttttgtgctgtgcatgcataaaagctgttggcagaccagattatatttgcctttatgctttaaaaattagtcattgatcctggagttctgcggaataataattaaggcttgggttttagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttgtaagtattgtctttaagagagtattttttttaaaactgttaacatagttgaaaagtcaaattgtatcactgagtagatctagaaatgacagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgctgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctgtagcagccagggacgcttggtctcatacatgttgattaaaattaaataccgacctgactggtgattcttgaattaaggtttattaatttgcagcatggtgacatggaccagaaggagagagatgttatcatgagggaattccggtcagggtcaagtcgtgttctgatcactactgacttgttggtaagtctcttaatgctttttaaaaatctaccaaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaaattcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagtgaaccctggtttagttatagtggctttatccctaaataaattgaattgtactttgttatatgatgtaaaaaaagactttttaaaaaatacaggagtcgatagcagcagttggtgacgagatggcactcagaaacggcgttgacgtaatttaggacgtggaatcataagcgaaacagcacactgtttgaataaagagcgagtcggtatttatatttgtttttcttttgtcatgattatttgatttttaagttgctccagctaaggcatttttttgtattagtatttctattagggaacctttcttattaggtggtttgtattgtctggtttctaacatgcaggtagctgtttggcagttaaacacgtttagagtaatttgagttacaacgtgtgaaactgagcaaaaaagcagtgataagtttgggttaccataccaaatatttgttttcccactggaaaaaagtaagttttagaaaatagttaacctttgcagcatttgtttacagtttacagttccagaagtgcgtcgaaatggattacataactgctcttttattcctggtgttcacatctgtcccaggctgacacctgctcttggctggcccactttggtatgggctttaatttcactaccccaaacacgatactgtcatctgctttataataatgctcaagatgcctgataaaaatctcattttgcagccagacaagccttgaatccttttggcactaactgcaaaggaagatttttttctctagatatgcattagcagctagtgctccagttagaagcacgaactataaccttgataagtaaacagcagctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggtgcttttggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcctacgagaaaaatttaagaaattagcatccttcaggtagttaaatgttccattgacatgtgcaaagtacctacttacggcaagtttttctgtgataatagacttctgtttatcagataagttattttctacaaccacatcatggagttgattgacgagctgagttgctgcatgaccctcatctattaaatcctataataaaaaaaacttttggtatgatgacttaatattcctttccccaaagttagtaagctgactttaccttgaccacagcttctagtttgtcaaaagagccactctgacaggcagcaaatactccatcaattttctcagctggtattacctaggtaattgaatgttcggtattaaagatgtttctaggtgagactagacatacactctgccaactggcccccgtgcccccagtcatttctgttccacacctaagttccatacttttctgggaaggctttgggagaacggaaagggccagagtaactccagccaccactaagcaaccaaggtgctaacaactgtgcttttaaagccctttaatggctttgtgaacttccaagtttgggcacacatggattatagcttgttctggtcagtggatgaagattaagttttcccctagcggctataacgattcctcagaacagtggccaagatcaaccaaaaagactgatttctttaaaggggaagtgccctttctctcaatgtctccatgtaaagatgccactaatgagattggtttaaaaagcccacaatatccagaaaattaaagaggattagtggtaccagtcttgtcatatggaaggcctaccgtgaaggtgaaaaacgtcatagaaacaaagaggattagtggtaccagtcttgtcatatggaaggcctaccgtgcaggtgaaaaatgtcacagaaacaaaagttgttaagtagtagtgattctgaagtgagtttttacatgggagtatccaaagacaagtggggtactccattctctttaataaatgattactgtaagttggatatgccttttgtttatatacaactggcaaaatagttttcatgtataagaacatctgctaaaattgatttaactgccaaaggcatttcttataaaatctaaaaactgaaggctgggtgcggtggctcccacctataatcccagcactttggaaggctaagcggggggcggatcacctggggtcaggagttccataccaacctggtcaaccaacatcgtgaaaccccgtctctactaaaaatatacaaattagctgggcatggtggcaggtgcctgtaatcccagctaattgggagggtgaggcgggaggtggaggttgcagtgagtcggtattgcgtcactgcactccagcctgggcgacacagcaagactctgtctcaaaaaaaaaaaaacaaaaaaactaacaactgaaagtgtccttttctttcctgaaatgtctgttacatgcctgacaaactgaaaagtcagtgctatctcctcacctcaaacactctgatactcccaggttattcccttatacttcctagtgcagtacttggcacttgctaaacacccagtatttgttggatgaaaatttcctaaaagccacaaaaaagccaactaaaaagaaattcagaatatccagtactcttaccccagcaatgtctgtaatcactttctctgtgatctcctttccacctgttaatcgagtagcgctttgaagaaatgtaatggcttttcttaagtctccttctgacactttaacaagataagctattccctgaagagaaaagagttgtttttaacctatgatggccaattaaggattt

SEQ ID NO: 14985 - DNA, 7769 bp, Human
gttctcactactcattgtatttgaacaataatttttctttgttgtaatacccagtagaataaaattttgtgctttgtttaaaagaggagaaattgaacatgttcaggatgctggcctgtcttcaatttcatcaccatcatctcgtagattgattgatggggagaataattagggatatgcagcatgtttgaaatgtatttgaaaacaagcaaaaacaacaatatgactataagttgtaagtctaagctttttttttctttttttttaaatgattcacctggcagtgttcttgaagtcattacttactgagaaaagaatcactatccaagatgaaaaatcaggaacttcaacaacagctcctttatttccatttctacttctgttggtgattacactgttccattttttactccagctaagtcattttcacctctgtattttttctcctatggggcaagatctgtgatatctgatagtttattaacaggtgtgctggaaataatctatttcaaaaataaaacactaaatatagcacacaagttcaaggcttttgaatgttaccatggttttaaaaaatcaatgtcatgaatgctttacactgaaatcatttattgttaggaaactgggtggcaaatgatacatatatcctgtagctctgtcatcatggctaatgctctcctgactcagattacatattagcatttccaccatatggctgaaagggtagagaatgtatgtgcagaggaacagagttggtaatatttttgaccatctgataaataaatatgtaagtaacaggaatattaatatttatttcatcatatgatgcaagctttaacctgaaataaccactaatacaacaaagtagtacatttgtttctcaaataatttcaatctaatttattaaatatttccatagtcaattaatgctcttagaatgtgacttctaattatgtttcttatgtttattgatatagtagggttccttatcatgccaaatttaaaaatctttcctgagaggccacacgattggacccagcatatgggcatgagcgccaaagttctgctctgccagtgaccactgtgtggcctgggataaattacctgacctctctaagcctcaaattaatgtgtaaagagtgaataatctattatcagacagtatccctcaaagggtgggccatggaggaccatggattaacacatcagaatcacatggggagcttaaaatacaaacatctgggccccacccgcaatgattctggttcatgtatctggaagcagtccatgaatctgcaaatatatatatgtattaatacagagtcttactcttttcgcctaggctgaagtgcagtggtaagatgatctcggctcactgaagcctgtctcccaagttcaagtgattcttgtgcctcagcatcctgagtagctgggatcccaggcgcacgccaccacgcctgggtaatttttctatttttagtagagacagggtttcgccatgttggccaggctggtctcgaacttctggcctcaagtgatccacccacctcagcctcccaaagggctgggattccaggcacacgccacctcgcccggcccgcatttttagtcactgtcccgagtgattgtgaggtacactgaatcactcccatagagacgagattaatatagagcacttagctaccttgaaaaatatgtagctaattttaataaatatactttttataccatagaaatttaacacccaacagcatttgtgcttaaaatactctaacttcatagaaaatgggaggtcagcttgctaagtaatgctgctgatcattaaatataccccacaattctcctttttgtttaattagatcctttatctttttttctcttgcataggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggtttgtacctttggtgcttgcatgtctttcctcaagtattagttgtttgtgtttctttccactatatttttccatctcagtatcacatagtcctgggtggcatttagcaccctgaggcttgaggaagtctttgatacttgagtcacagacatagccatttagaatatatggcattatttacttgaagcagaaaataatcaagagccttaatatttcatcttagaaatcaaattacataaagtatgaatttgtttatgtgatatgatatttgtttcctaattactgaaagtcgagaagaggatgatgtcagcttgaattaatagaatacttatattggcgtgcaaaatattttaaagactctttgatagggctttcttttaagtaacagaaaacatttaaattttattattatctttttttcttcagtaaattctagcaattgcccatgagaagcaggctggggagacacttcaggaacatatatagaaatctaaactttgaaaacaggccaggtgcggtggctaacacctgtaatcccaaaaacacctgtaatcccagcacttttggaggctgaggcaggataatcacctgaggtcagcagttcaagaccagcctggccaacactgtgaaactcccatctgtactgaaaaaatagaaaaacaaaattatccaggcatggtggcacatgccagtagtcccagctactcgggaggctgaggcaggagaactgcttgagcgtgggaggcggaggttgcagtgagctgagatcgcgccactacacttcagcctaagcaacagaacgagactctatctcaaaaataaaataaaataaactttgaaaacaaagtttgggagaggaaacaataatgggattactcatggttttcaaaaagttaaaaatgtggcttacaggccaggcgcggtggctcacgcctgtaatcccagcactttgggaggccgaggctagtgggtcggtcacttgaggtcaggagttcgagaccagcctggccaacatgttgaaaccctgtctctactaaaaatacaaaaaacttagctggacatcgtagtgcacgcttgtaatcccagctactcaggaggctgaggcacaagaatcgcttgaacctgggaggaggaggttgcagggagcccagattgtgccactgcactccacgctgggcgacagagtgagactctgtcaaaaaataaataaaaaataaaaatttggtttacagaggtatttgcagaactcctctatgttcttaaatgtttccctacttaatttaaaatctgacaaagtccattaaaatgttttattgaagtataatatgcacacataaatggacatatataaatgtacaacttgatgaattttctgatgaatttcactcaatattccagaatcctgactgtataaggaacatgataacatgaatcttacaggacattatgtcacttattataatgtatgaatttaatattttgcctttcaaaatcataaagggcaagagtcatcagggatctgaaatacacttcctctaccccccacccctccccaattatgtgctctctttctccttcccttataaatgttgttcttgtgttttgataggatcagagtgacagttgatggcgaatttctgcattacattttcccccttcagttcctggattctcctgagtgggattcactgagacccacagaggaaggcatttttcaggtaagggataccagaacacacagttagcactccctctttcaaacagatgtttgtttaaaaataagtaaacaaataaacaacagtggataagacaagaatattttaagactttggaatgtactttgcagcatacatgactttcccaattctgctggactcttgatgattaatgccactttataggtccagcgatgagaagaacaggtgctacatatgacaggaaggaggctgtgatcaatactttaagctttactttgcataactgcgtatttaggaattaaaatataattgagatttgactaaacactgctaatgcgacgtctagaaaacatcaagaacaaaaaactgcacttactaaaaaataaatgatttttaaaatttaaaatgccagtggatttcagttgttttacagcaacagaatgctaaacttactgtcattactctgctgccacgtctggcagttttgaaagataatcatttcagcaggtttcatttattttgttacacagttttctaacaaatatatgtgtgtatgcaacaaactcaaatatgtatgcaaattaggtatataaattctgttttctactgcagaaactgcattagggttaaatgtccacagtcttcagaagtgacttggaaatatttctgtaacatcagccaactttttttttttttaagatcaagtagttctcccttcaataaaagaaatgtagatactggaacttagaaaaacagacagattgaagatggctagaacattgtgattattcatattataaattacgtatgtagtaacgaattttgtagtttctatttttgcaatatattgtaggtcagtgggctttttcaacctaaaaaaaaggcagcacgtgaaattaatttaacaattggggtactaaaaatgtggcagaagttttcttgcttccacatctgtttatgtgtggtcttgtgttttttaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgtatttctcattgttataattggggagggggtggataactatgggcagtttgcccttttctgcatcaaaactgggagaatgaaattccactttctcaattcttttctcacatttactcaaatgcattgtcttgccctatagactcaggagttgcttctcaagaaagagccagcaagtattctcagcctgagggtgggttgctactgtccacataggcatttccggaattcacttttttgctacaacctccagtgaaagcaattattttaaatgtgcagttacttgatgtgactaaaaagtagaataaatgcaagagataataatatgtgaatcttgaagcctattttattgctacaaataaaataacatttaaaaagaagcatttcctggaaaacaaagctgcctgatcattactaagtcaaaagagtactcctgaaccaatagtaaaaatgttgcacggtgtttcagtttcacgtgttcagcagaaagagctttcagtggtgtgaatgggcagcgagggttcacagggaatgctcagcccaccgcacaaacacaagggtctgcctcacagcgagtgcttcagctttgtgaagagcttaagaaagaaccctagttggagatctgatcccttcctttggaaaactggttttctgaagatcacatgcagactatgttctttgatacagagatacattatcaaatatttaacaagtgtgtattgagcaccttctatggctgacatgggcatggggatacatcaggtaacagatggagatcccacccctcataaagcttacattctggggatgcgggaggacataataaagtaaatcagtaaatgtttagaaggtgatagtaccaaggggagtgataaattagagaaggtgggtaagaaagggcattgcaattttaatagggtggtcaaggaaagtatccacaaaaaggaatgtctgaatgaagacctgaaagaggcaatggaagaatccatgcagatatctgagggaagagcaatttgggcaaaggggacagcaactgagcaggcccttaggcatgaacatgactggcctgttccaggagcagctggaaggctagtttggctggcacagaatgaacagaaagtaaccgtgggcagactgggtaaggcctaaataagtcatggtaaggactttgatttttttctaagagtgaccagaagccattgtagggtctgaagtagaagagtgatatgatctgccccatggtttaataggatcactctggctagcctgctgagaatagactagggggaagagagaaaagagtggacttggaaagtaaaatgaggattaagagtgagatgcctgctagacgctgaagtagagtagacagctggagatatgagcctggagtttcaaagaaaagtctgcgctgtagagacagctttgggagtatttagcatatacatggtatttaaagccatgagtctccatgagatggccaaaagagtgagtgtagattcagaagaaaaatggtctgaggcttaccttggagcactccattgttaaggggacaaagcgatgggggaagaatcagcaaaggatctgaggaagagcagccaatgaggtagaaagaaaatcaggagagcctgggatcctggaagccaagcaaagagaatttctgggagaagggagtgatgaactgtctcagatgtggctgagaggcctgagaatgaaccatcgggttaagcaacatggaagtcactggggaacttaacaagagcagttttggtggagtgagcaggaacaaaaactcgactgaagcaggttgaaggagaatgagaggcaagaagttggaacagtaagggtaggtaagtttttcaaggagttttgatgtgaactgaaatagaaatgatcagtagcctgggcagaaagtggggtcaagagagggggttgttattgattttcagataagatggtgcatttgcatgcagatggaaataatccataagtgaggagtgaact

SEQ ID NO: 14986 - DNA, 13027 bp, Human
  misc_feature (1)...(13027): n = A,T,C or G
ctttttttttttttttcttgagacggagtttcactcttgttgcccaggctggagtgcagtggcatgatctcggctcactgcaacctccacttcccaggttcaagcgattctcctgcctcagcctcccgagtagctgggattacaggcgcgtgccacccagcccggctaatttttgtatttttagtagagacagggtttctccatgttggccaagctgatcccgaactcctggcctcaggtgatccacccgcctcagcctcccaaagtgctaggattataggcgtgagccaccgcgcctggcacttttttttttttttttttaagatggactctggctgtcgcccaggatggagtgcagtggcgcgatctcggctcactgcaagctccgcctcccgggttcacaccattctcctgcctcagcctcccgagtaactgggactacaggcgcctgccaccatgcccagctaattttttgtatttttagtagagacagggtttcaccgtgttagccaggatggtctcgatctcctgagctcgtgatccgcccgcctcggccttccaaagtgctgggattacaggcgtgagccaccgcgcccggccggcactttttttttttttttttttttttttttacttaactagttatcttgagtaagtaatgatgcggctgatgggaaaggggaagctacaggccagacaagtggactctcaatcacaagcacgccatggagcagggagccagggccctgaatgtggaagaccagccagactcaggtatatggagggaacatccttactgtccagcctctcctgatctctgttggcaccttagcccagccaatcctgtaccacgtgcacagggaacctgcctgcctaggttttttccacaggaagctccctggtcctgggtggagtctgagcccaccaggcctttcacacccaagagctcagggtgaggcctggggaggaaggcagggacccaccagctcacggtccccaacaaggtgccactgagaaggctgggtaaaggctgcggggatagatagctcttgcggcaggcctggcgactgataagtccgggcagcaccctaagagttggcacccgcccctctgccccgcaccccagggctttgcttcgcgccctccgcccggaccctggcccttctcttcttcgtctgcgtggaactccctccagggcagggcctggcactgtgtagtgaatgtcggcctcgtggtggacccgaaggaaccctacagtcagccccagagccgcgggagatccacgctgcggccggctccgccccgcccaaccctcaccctcacgctcacgctcacgctcacgctcacgctcacgctcacaggctcccggctccacattcctcgcagggctccaatcccgacccgcccgccttgcccttcatcctcaaagactcattggtcccattcccctcgggccccgcccttcgcgtgcttgggccatgcccgtccgaccgcgctgcttccgccttgcagcaccccctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgagggctcggcccgcggtccccgtggtccctgcagcccgggccgggcctgaccctggtgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactggtgtgtgtgcgaaggggaactggctggcgacggggtcgcgcactggggtgggaaggaagggggtgtggagggctcgctgcttgacagtgcgtaagggtatatagggagccggcctggacttggaggttacactcccacaggtccctgcacacaggtgtgtggagggggggagggggcgtgcggggcgttatcgaatggcggccatgagtgcacgagatgacggcgtaggggtagaagtcaaatctgggctcagggcgtggaccttgtagggctctccaccaacacgccatcccatacacatgccaggctgccctcaagattccagggtggatgctggggttactagggggttctctcaaagaggctgtcagctcaggctctggaggcctggactagggttgtggccaagtgttgtccagcctgcagccagggtgtcagtgtctggagacagattgagagattggggaagatagatctaggccttcctgggtcaggtggggctgggggcagtagccaggagtagccaagacaaggtgagcagtctcatgcctcccctcacagagtggacccagagggacctggaacgcatggagaacattcgattctgccgccaatacctggtgttccatgacggggactcagtggtgtttgcaggacctgcaggcaacagtgtggagacccggggggagtaagtttgagggaggaagcttgtgggcaaggccacagccgtccgcaatgcaagccttttatgaatgctcaccatgtgcctagaagggaggccagcagccaggttcttgcccccttgggagctcattcagtttctggtgacatggcctgataagcactggaagcttgctccaaactcagcctggactagagcccatggtggcctggggagttgcagagagtagagtctctgcctcagggaggaaaggcaaggtggggctagaggtgctccagaagctggtgtggggccagagcctcaagaatctctcctaagaggtgtgcccagtagggagcaggaaggggttattgcaagataatcctgacctgtgctaccccatgtccacagactgctgagcagagagtctccttcaggcaccatgaaagctgtgctgcgcaaggctggaggcacgggccctggggaagagaagcagttcctggaggtgagtctgcatgggaccaggtagtgggtgacaagagagaggctctgccccacagataaggctctgttagcgggcaaacagcctaatgcccagatgtcctcaggtctgggagaagaaccggaagctcaagagcttcaacctgtcagcgctggagaaacatgggcctgtttatgaggatggtgaggcatctggctggtgagcaggcagggtggacaggaggggtagccgtagccctgggccccccctgattggccctccctgcacccagactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggtgctcgtggtcaatccacgaaggcccggcagggcagccctggggctcagtgtgctcccttcccatactgtgcctgtcagacctggggaggcactagcttctaggaagcagagcaggtcctatagacaggctgggcattgagtatcttgtgttctcagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgtttgtgggctggtggcatgagcccttccggttgggcatccgcttttgcaccaatcgcaggtgagggagtggggcaaggcaaggggccttgcagcccagctggccttgagactgagtgtctgtctcgtggttccaggtcagccctgtattatgtggacctcatcggggggaagtgtggtaagtggctgatgcccacctgtgctttgctgacacatgttggccctgccagcctgcgtgatgctcatgtttccatctggcccagagctcctctcggatgactccctggctgtctcttctccccggctgagcccagaccaatgtcgcattgtctacctgcagtacccatctctgatcccccatcaccaatgcagccagctgtgcctggtgagctggaggtggcagggatgggagggtggtcagcaagaagatgggatggtggatgagagctgaagggccagtatcatctccccataggccctcagtaggtgcccttctgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgaggccccttgggcatctggtccaggtcaccagaaaagagatacatcaggcttattccagttcccccatctcctggggctacctgaggcaaaaggggataggcacagggcactgtgccctaagggaactgcctgtcccctactggacctgaccattgtgttctcttgcagtatgactggtataccaaggttacctcagtggtggtagatgttgtgcctcggcagctgggaggtaaggcatacctggctgggtgggtgcagtggggcctgtagctctgctttcctgccgtctgttgcatccctgccccgttcttctttcctaggttccttctgagggccctacctccctgctgggccagccttatgcccagcatcctcagggagcggggctgtcaccatagggagcggggctgtcaccgtagggaacagttcaatagcaaggagtggtaggaccaagctgagatcagagtggcccaagttgatgatgtattatttcctgtgctgcaggtcataattagatttttcttatttttccaatggctggttcaaaccaaaaccatgactccttcaagtgggtctcaggaagtgcactaggttggaatgtcacactcaagaggctctggacccgagggcatgatattatcccatccaccatcctaaccccagcaacctttgtccagtctaagccctgaagtcagctgggtcttcaggagggtggctcttggctgagaggctcccgtctcgagtgttgatagctctgcttggatcctcctggaccatctcaaggatgagtctcttgttttctcaggccacccggtcagttccaggagttcagtggacaagggatagcctctttgtcttctctttgggttgcagggatgcagtggtgggaacctagtatgaatcccagctctgccctaaattagctgtgtcctcagacagggtcctggcctccctgagctcccatttcttcatggaggggtgattgtgtctgcctgcctcataggatcatagtgagtgttaagtgagtgatgatattaaagggtaggatttactgagccccctgtgccaagcgctgtgctaagcaccacagtggagataagacggacagatgatatcttggttaaagcacctggtacctacctgggttcaactggaattactcaggagagcaagtgcttttcctctgagcacccatggtttctctctggagctcttgagctctgcctctctgggtcctctctgggtcccaagaggcctctgcccctcagccacctactcaggcagctcctcatcgcgtagcgtgcccccatgtgtgctacaagctgcaggggcctgactggtgcctgagtagggccctgggtgaattccccagtaccctagccttccttgtagactaccctccctacctccactcctggatgcagcctcagccctcctatctttacagagaacttctctgggatctactgcagccttctgcctttgggatgctggtcagctgacagccagagagtggtctttgactcggctcagcgcagccggcaggtgagggacgctgattgtgttgaggggcagcccctgtggtcaacccccaggagccctgggggttgcatgtgcatgcccctgggtggaatgcccagccacaaagtctcatcagccccttaaaaccctgcctgcccatcctggactcatttctcctggaggggactggctgccctggtgcaccacagcagaactcaggccttttcgtctgaggcagagatgcaacccctcccaggcatttctagctgggggtcaaggggactgccactcgggtgggtccctgaacactctgtaatggcagctgatggggacaggactgaggccttcccccagggatggagtaaagccactcacagtgtgccaggctccttttgggtgtgatatttggtccttgtgccaactcaaaggggctcaaagccattccttaccttgcccagggtcacccagcaagttgtgatggtgctgggatttgaacccaggccctcacactactccctactgcactgagtaaccatcaccatagctgtccacagccttggtctggccagggctctccaagagggtagagaggaggtaggggagggacccataggtagagggagtactcttggatgtggtcgcacctgtggccttgcctctgcttcaggacctgtttgctgtggacacccaagtgggcactgtgacctccctcacagctggtgagcaaggctttggggatgggggtaagggcagggctggtgagcaagccaaccaggcagcgggggactggagctccaacatgtggggcagtgatggcattctcagccactcagcaccactgactgttccacagcctttactaacaggtccccaaggcccctgtctgtgcagacccttacccaaccaacagactagcttccctgctctactgccctttagcactcaactctgttccatgtgtcctggcccagcctcagcacggcccccacctctgctcctaaaacccacaaaactctctcttatcaagatctgccagactcatccttctcgctctgcaaaccttgggtgcctgtctcaggcagaggcagctctgccacctgagggcccaggaaaagcccagtgttgactcccccgtcttccccatacttaggcctggtgattctgcctttgaaatgtgttttgagtcctccacctgacctgactgtatccgctcctccacaaagctaccaaagtatcattccaaagctacatctcattgtacaactgcttggacaccactgccccaaatcagcacgctccccgacccccaacttcccggtcccagctgccaccctgcacacagcagccatcgagggacaggcagatgtgcctgcatggtctgatgtgtcttaaggtttggcagttcccagcccagccagtgtctgtcagatgaacaacagactgagagcaggaggctcacccggggccatgtgcagttgggtgtttgtgaaaggcacttctcggggagaaaagggcacctttccatagagtctccagcctgggactctgttacagagaagcaggtaagaaaggtgatggctcctgctaagcacttaatggcatctgccttttccaggagggtcaggtgggagctggaagttgctcacaattgaccaggacctcatggtggcacagttttccacacccagcctacctccaaccctggtgagtgtcggtgggtcccaggctgtggaggcaggggttctgggcaggcagagctcaccaggtcagggaattggccccagagtctgacctggctggtcagcatacagacgggccaagacacaggcccagcttggcatggtccatgagggtttggcactcacagggacgaactactaggctagaatctgctccgtacaaaacaaggtgcctggggaagtgctctgtcttggtattacagagcaaaggagacagcagagcctagaagctgaggagggaggggtgtgcctgtgtgtgattgtatgagtatgaataccttggtatataccatcccacaacaggaagccatgctgtaccttctggaggtgggtagagggcccagcatagtgagagctgcctatttcccactgtgggcagaagggaagggcagggaggcagccaggccacctatgacacattctttccccttggcagaaagttgggttcctgccttctgcagggaaggagcagtcagtgttgtgggtgtccctggaggaggccgagcccattcccgacatccactggggcatccgggtgctacagccacccccagagcaagagaatgtgcagtatggtgagctgggccaggggcagagggatgccttctccaggttccccagcacaaagcctctgcggtgacctttgctacctcctctctcacattgtggggtttctggtgatgacctctaagaggttttctgttcctcttgtggatgggcatgggaagtagcatctagacatctgagcgcctgctctggatatcacctgggcttcaccaggccaaatcatctgtggttggaagacccaggtccaaagaaaataggcctcatacaagcctcagtgaccacacctcatcccgaatgctgttgctgcaggatggggttccctgacgagggcagaagaagtatgagccttctggggtccatgtgtcatggtgtggactaccttggccaggtctctgacccagaggtcagccccacacctgcagctagagatggggccttagttggggaagcccctaggctcaccctgctgactgctgccctctccctgcagctggccttgactttgaagcaatcctgctgcagcctggcagccctccagataagacccaagtgcccatggtggtcatgccccacggtaggcatctggcgttaagagcccttgccctcccagccctcttcctagctggccctttcaccctccgctccctgtctgcaggggggccccattcatcctttgtcactgcctggatgctgttcccagccatgctttgcaagatgggctttgcggtactactaggtgagtgagcagggacccacagttctgttaggactacagtggagtgacgggggtggacctggtttgtataagtaccatgggtgccactctagtctccaggactttctctagcctagacctagtaaccactaccaggaactgctggggcccagcctctggttctgtggcatagtgataacaaggactaactcgggacttccaaggaaagggcgctgtggtcactgggtggcagcctcaaatctctgagtcccttccccttgaccccttgacagtctgtggtatagctggccccagggcctacttcacagatgtgtgaaaagagcgtcgagggggctgggaatgttgcctgactacactgtctggtccctccctgccctcagtgaactatcgtggctccacgggctttggccaggacagcatcctctccctcccaggcaatgtgggccaccaggatgtgaaggatgtccaggtagcaggggctggggcttctggacaggctgaaacatgggctgccagggggatgcctccattcagctgagcgggcagctggctgcagcatgctttgtcccaccctgcagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtaggcatacaccacaggtccctgcccttccctcctctacctcaaattctcatggagccccgtagccccagaattcctggggctgcaacagctcggtgtcttgcaggtgcgtggtggaggctggctttcctttcagcagtgactgcctgccagacctcagcgtgtgggctgagatgctggacaaatcgcccatcagatacatccctcaggtatgcagccccctccttgccctgtgtgctgcccatccatccagaatccagggcccagctcaacacagctccccactcttccccaaacacccaggtgaagacaccactgttactgatgttgggccaggaggaccggcgtgtgcccttcaagcagggcatggagtattaccgtgccctcaagacccggaatgtgcctgttcggtgagtgcagcatgaaggccctggcagctggtgggcaggtgagcacaggaggaccctccaaccttaaatgttgctgactaatccctacaggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggttcctgctggtactttgtaccaaaccatccccaaccccacctcccactctggggtgcagagaccctaggttctgggtgtggcagccacaagggcttcatctgcctccagtgtgagaagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagaggaaacatggctttatgtctgacaagaagttttgtcctccccaaggcatatggcatcaaggctgggcctaacccagtctcatgaccttgtgaatccagtccacaaacacagagacacgcgtgaagacagctggccagcgggaccttgcgcatactcggttggggattataattccttccaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcactctcacgcacacgtcctcggtgcttgatgttacactcctggttggagatgacattcagcaaggccacatttaggactgtgtcattacccgtacctgnnnnnnnnnnnnnnnnnnnnagccatcacattacccagccaagggccctggctaggcattcagactccaaatctgggctctcacctgcacaaaggcatatgctaggttagaggggtagatcaggctcaggaggggtcactgcctgctgtgtgcgtgcatctgtgtggtcctgacactgcttcagtgctagagcagacgtgctaatagaggcctaagtgggcaatgtctatgtgttcctagggcttcccagctgtgctcaagagggcaaggtcactgccccatgcccactgagcctctggctccccgacttttttctcatcctagaataggagaatggggccaaccccctcctgaaggcagatggggatcagggttgggggcacttaccagggacccctaagcattgagtcagaagcagcaggagtgggagccaccccatccttctggctggaggctgcactgtgacccaccacagccccatccgggaagttgtgaaacctgtccctacgggattgggtggctctggctccacacgtcagctcagggcctgctggaccctgacctgagacctggtgacaggagccatgaggggccaggcctcaggtcccataggtcagttgcaagggcctagtacagcttagtggacaggtgttaggaaggtttggtggggacacttgaggtgccctggggttggggtgaaacccctctgcagcctagtcagcccaagggcattgtgaaagtgagagctgccagaggtctgggctccagcccctgggtgacattaaacttttctgaatttcggtttttccctgtaaattggggaaaattacttgccccagcttcaacactgcctcccctccacccttttgctgctgccttatcaggccccagctgtaggcaggtcagcccacacccggcggcagagcccagagaggctcgctcatctcagccgccagaagtgtcatcccagggaaggtgagcgaggctgtccactaggactaaataggggtggaggtaacaggtagcagggactctggcaggaacggcctttcag

SEQ ID NO: 14987 - DNA, 13347 bp, Human
  misc_feature (1)...(13347): n = A,T,C or G
cctccttaccgaagtcacccagagttgctagacctttttttttttttttttttttttttaacacagataaacaggaatcccagcttcacctctggccctctccccagaattaacattttgatgcgtgtccttctttcctgtttgttgttccagtcttcattttaaacagaagccagaaggtgcaatatatcctgttttctagctttctgtttatttccacgtttatttcaggtacttaaatgttcgtcttccagtgctcaacctccagagagatacaccattagttcatagccagtctaccacacacaatctaaggaacaggcactatgttcccagtgttcctattataaacaatgcttgatgaacatcctattttccaatctttccacccaaattggtggctggggccactcattctactcctgtttctggccttgatacagtcctgtacatactgacaaatgcagtggcgtcagaaagttgggactctttttttttttttttcttgagacggagtttcactcttgttgcccaggctggagtgcagtggcatgatctcggctcactgcaacctccacttcccaggttcaagcgattctcctgcctcagcctcccgagtagctgggattacaggcgcgtgccacccagcccggctaatttttgtatttttagtagagacagggtttctccatgttggccaagctgatcccgaactcctggcctcaggtgatccacccgcctcagcctcccaaagtgctaggattataggcgtgagccaccgcgcctggcacttttttttttttttttttaagatggactctggctgtcgcccaggatggagtgcagtggcgcgatctcggctcactgcaagctccgcctcccgggttcacaccattctcctgcctcagcctcccgagtaactgggactacaggcgcctgccaccatgcccagctaattttttgtatttttagtagagacagggtttcaccgtgttagccaggatggtctcgatctcctgagctcgtgatccgcccgcctcggccttccaaagtgctgggattacaggcgtgagccaccgcgcccggccggcactttttttttttttttttttttttttttacttaactagttatcttgagtaagtaatgatgcggctgatgggaaaggggaagctacaggccagacaagtggactctcaatcacaagcacgccatggagcagggagccagggccctgaatgtggaagaccagccagactcaggtatatggagggaacatccttactgtccagcctctcctgatctctgttggcaccttagcccagccaatcctgtaccacgtgcacagggaacctgcctgcctaggttttttccacaggaagctccctggtcctgggtggagtctgagcccaccaggcctttcacacccaagagctcagggtgaggcctggggaggaaggcagggacccaccagctcacggtccccaacaaggtgccactgagaaggctgggtaaaggctgcggggatagatagctcttgcggcaggcctggcgactgataagtccgggcagcaccctaagagttggcacccgcccctctgccccgcaccccagggctttgcttcgcgccctccgcccggaccctggcccttctcttcttcgtctgcgtggaactccctccagggcagggcctggcactgtgtagtgaatgtcggcctcgtggtggacccgaaggaaccctacagtcagccccagagccgcgggagatccacgctgcggccggctccgccccgcccaaccctcaccctcacgctcacgctcacgctcacgctcacgctcacgctcacaggctcccggctccacattcctcgcagggctccaatcccgacccgcccgccttgcccttcatcctcaaagactcattggtcccattcccctcgggccccgcccttcgcgtgcttgggccatgcccgtccgaccgcgctgcttccgccttgcagcaccccctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgagggctcggcccgcggtccccgtggtccctgcagcccgggccgggcctgaccctggtgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactggtgtgtgtgcgaaggggaactggctggcgacggggtcgcgcactggggtgggaaggaagggggtgtggagggctcgctgcttgacagtgcgtaagggtatatagggagccggcctggacttggaggttacactcccacaggtccctgcacacaggtgtgtggagggggggagggggcgtgcggggcgttatcgaatggcggccatgagtgcacgagatgacggcgtaggggtagaagtcaaatctgggctcagggcgtggaccttgtagggctctccaccaacacgccatcccatacacatgccaggctgccctcaagattccagggtggatgctggggttactagggggttctctcaaagaggctgtcagctcaggctctggaggcctggactagggttgtggccaagtgttgtccagcctgcagccagggtgtcagtgtctggagacagattgagagattggggaagatagatctaggccttcctgggtcaggtggggctgggggcagtagccaggagtagccaagacaaggtgagcagtctcatgcctcccctcacagagtggacccagagggacctggaacgcatggagaacattcgattctgccgccaatacctggtgttccatgacggggactcagtggtgtttgcaggacctgcaggcaacagtgtggagacccggggggagtaagtttgagggaggaagcttgtgggcaaggccacagccgtccgcaatgcaagccttttatgaatgctcaccatgtgcctagaagggaggccagcagccaggttcttgcccccttgggagctcattcagtttctggtgacatggcctgataagcactggaagcttgctccaaactcagcctggactagagcccatggtggcctggggagttgcagagagtagagtctctgcctcagggaggaaaggcaaggtggggctagaggtgctccagaagctggtgtggggccagagcctcaagaatctctcctaagaggtgtgcccagtagggagcaggaaggggttattgcaagataatcctgacctgtgctaccccatgtccacagactgctgagcagagagtctccttcaggcaccatgaaagctgtgctgcgcaaggctggaggcacgggccctggggaagagaagcagttcctggaggtgagtctgcatgggaccaggtagtgggtgacaagagagaggctctgccccacagataaggctctgttagcgggcaaacagcctaatgcccagatgtcctcaggtctgggagaagaaccggaagctcaagagcttcaacctgtcagcgctggagaaacatgggcctgtttatgaggatggtgaggcatctggctggtgagcaggcagggtggacaggaggggtagccgtagccctgggccccccctgattggccctccctgcacccagactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggtgctcgtggtcaatccacgaaggcccggcagggcagccctggggctcagtgtgctcccttcccatactgtgcctgtcagacctggggaggcactagcttctaggaagcagagcaggtcctatagacaggctgggcattgagtatcttgtgttctcagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgtttgtgggctggtggcatgagcccttccggttgggcatccgcttttgcaccaatcgcaggtgagggagtggggcaaggcaaggggccttgcagcccagctggccttgagactgagtgtctgtctcgtggttccaggtcagccctgtattatgtggacctcatcggggggaagtgtggtaagtggctgatgcccacctgtgctttgctgacacatgttggccctgccagcctgcgtgatgctcatgtttccatctggcccagagctcctctcggatgactccctggctgtctcttctccccggctgagcccagaccaatgtcgcattgtctacctgcagtacccatctctgatcccccatcaccaatgcagccagctgtgcctggtgagctggaggtggcagggatgggagggtggtcagcaagaagatgggatggtggatgagagctgaagggccagtatcatctccccataggccctcagtaggtgcccttctgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgaggccccttgggcatctggtccaggtcaccagaaaagagatacatcaggcttattccagttcccccatctcctggggctacctgaggcaaaaggggataggcacagggcactgtgccctaagggaactgcctgtcccctactggacctgaccattgtgttctcttgcagtatgactggtataccaaggttacctcagtggtggtagatgttgtgcctcggcagctgggaggtaaggcatacctggctgggtgggtgcagtggggcctgtagctctgctttcctgccgtctgttgcatccctgccccgttcttctttcctaggttccttctgagggccctacctccctgctgggccagccttatgcccagcatcctcagggagcggggctgtcaccatagggagcggggctgtcaccgtagggaacagttcaatagcaaggagtggtaggaccaagctgagatcagagtggcccaagttgatgatgtattatttcctgtgctgcaggtcataattagatttttcttatttttccaatggctggttcaaaccaaaaccatgactccttcaagtgggtctcaggaagtgcactaggttggaatgtcacactcaagaggctctggacccgagggcatgatattatcccatccaccatcctaaccccagcaacctttgtccagtctaagccctgaagtcagctgggtcttcaggagggtggctcttggctgagaggctcccgtctcgagtgttgatagctctgcttggatcctcctggaccatctcaaggatgagtctcttgttttctcaggccacccggtcagttccaggagttcagtggacaagggatagcctctttgtcttctctttgggttgcagggatgcagtggtgggaacctagtatgaatcccagctctgccctaaattagctgtgtcctcagacagggtcctggcctccctgagctcccatttcttcatggaggggtgattgtgtctgcctgcctcataggatcatagtgagtgttaagtgagtgatgatattaaagggtaggatttactgagccccctgtgccaagcgctgtgctaagcaccacagtggagataagacggacagatgatatcttggttaaagcacctggtacctacctgggttcaactggaattactcaggagagcaagtgcttttcctctgagcacccatggtttctctctggagctcttgagctctgcctctctgggtcctctctgggtcccaagaggcctctgcccctcagccacctactcaggcagctcctcatcgcgtagcgtgcccccatgtgtgctacaagctgcaggggcctgactggtgcctgagtagggccctgggtgaattccccagtaccctagccttccttgtagactaccctccctacctccactcctggatgcagcctcagccctcctatctttacagagaacttctctgggatctactgcagccttctgcctttgggatgctggtcagctgacagccagagagtggtctttgactcggctcagcgcagccggcaggtgagggacgctgattgtgttgaggggcagcccctgtggtcaacccccaggagccctgggggttgcatgtgcatgcccctgggtggaatgcccagccacaaagtctcatcagccccttaaaaccctgcctgcccatcctggactcatttctcctggaggggactggctgccctggtgcaccacagcagaactcaggccttttcgtctgaggcagagatgcaacccctcccaggcatttctagctgggggtcaaggggactgccactcgggtgggtccctgaacactctgtaatggcagctgatggggacaggactgaggccttcccccagggatggagtaaagccactcacagtgtgccaggctccttttgggtgtgatatttggtccttgtgccaactcaaaggggctcaaagccattccttaccttgcccagggtcacccagcaagttgtgatggtgctgggatttgaacccaggccctcacactactccctactgcactgagtaaccatcaccatagctgtccacagccttggtctggccagggctctccaagagggtagagaggaggtaggggagggacccataggtagagggagtactcttggatgtggtcgcacctgtggccttgcctctgcttcaggacctgtttgctgtggacacccaagtgggcactgtgacctccctcacagctggtgagcaaggctttggggatgggggtaagggcagggctggtgagcaagccaaccaggcagcgggggactggagctccaacatgtggggcagtgatggcattctcagccactcagcaccactgactgttccacagcctttactaacaggtccccaaggcccctgtctgtgcagacccttacccaaccaacagactagcttccctgctctactgccctttagcactcaactctgttccatgtgtcctggcccagcctcagcacggcccccacctctgctcctaaaacccacaaaactctctcttatcaagatctgccagactcatccttctcgctctgcaaaccttgggtgcctgtctcaggcagaggcagctctgccacctgagggcccaggaaaagcccagtgttgactcccccgtcttccccatacttaggcctggtgattctgcctttgaaatgtgttttgagtcctccacctgacctgactgtatccgctcctccacaaagctaccaaagtatcattccaaagctacatctcattgtacaactgcttggacaccactgccccaaatcagcacgctccccgacccccaacttcccggtcccagctgccaccctgcacacagcagccatcgagggacaggcagatgtgcctgcatggtctgatgtgtcttaaggtttggcagttcccagcccagccagtgtctgtcagatgaacaacagactgagagcaggaggctcacccggggccatgtgcagttgggtgtttgtgaaaggcacttctcggggagaaaagggcacctttccatagagtctccagcctgggactctgttacagagaagcaggtaagaaaggtgatggctcctgctaagcacttaatggcatctgccttttccaggagggtcaggtgggagctggaagttgctcacaattgaccaggacctcatggtggcacagttttccacacccagcctacctccaaccctggtgagtgtcggtgggtcccaggctgtggaggcaggggttctgggcaggcagagctcaccaggtcagggaattggccccagagtctgacctggctggtcagcatacagacgggccaagacacaggcccagcttggcatggtccatgagggtttggcactcacagggacgaactactaggctagaatctgctccgtacaaaacaaggtgcctggggaagtgctctgtcttggtattacagagcaaaggagacagcagagcctagaagctgaggagggaggggtgtgcctgtgtgtgattgtatgagtatgaataccttggtatataccatcccacaacaggaagccatgctgtaccttctggaggtgggtagagggcccagcatagtgagagctgcctatttcccactgtgggcagaagggaagggcagggaggcagccaggccacctatgacacattctttccccttggcagaaagttgggttcctgccttctgcagggaaggagcagtcagtgttgtgggtgtccctggaggaggccgagcccattcccgacatccactggggcatccgggtgctacagccacccccagagcaagagaatgtgcagtatggtgagctgggccaggggcagagggatgccttctccaggttccccagcacaaagcctctgcggtgacctttgctacctcctctctcacattgtggggtttctggtgatgacctctaagaggttttctgttcctcttgtggatgggcatgggaagtagcatctagacatctgagcgcctgctctggatatcacctgggcttcaccaggccaaatcatctgtggttggaagacccaggtccaaagaaaataggcctcatacaagcctcagtgaccacacctcatcccgaatgctgttgctgcaggatggggttccctgacgagggcagaagaagtatgagccttctggggtccatgtgtcatggtgtggactaccttggccaggtctctgacccagaggtcagccccacacctgcagctagagatggggccttagttggggaagcccctaggctcaccctgctgactgctgccctctccctgcagctggccttgactttgaagcaatcctgctgcagcctggcagccctccagataagacccaagtgcccatggtggtcatgccccacggtaggcatctggcgttaagagcccttgccctcccagccctcttcctagctggccctttcaccctccgctccctgtctgcaggggggccccattcatcctttgtcactgcctggatgctgttcccagccatgctttgcaagatgggctttgcggtactactaggtgagtgagcagggacccacagttctgttaggactacagtggagtgacgggggtggacctggtttgtataagtaccatgggtgccactctagtctccaggactttctctagcctagacctagtaaccactaccaggaactgctggggcccagcctctggttctgtggcatagtgataacaaggactaactcgggacttccaaggaaagggcgctgtggtcactgggtggcagcctcaaatctctgagtcccttccccttgaccccttgacagtctgtggtatagctggccccagggcctacttcacagatgtgtgaaaagagcgtcgagggggctgggaatgttgcctgactacactgtctggtccctccctgccctcagtgaactatcgtggctccacgggctttggccaggacagcatcctctccctcccaggcaatgtgggccaccaggatgtgaaggatgtccaggtagcaggggctggggcttctggacaggctgaaacatgggctgccagggggatgcctccattcagctgagcgggcagctggctgcagcatgctttgtcccaccctgcagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtaggcatacaccacaggtccctgcccttccctcctctacctcaaattctcatggagccccgtagccccagaattcctggggctgcaacagctcggtgtcttgcaggtgcgtggtggaggctggctttcctttcagcagtgactgcctgccagacctcagcgtgtgggctgagatgctggacaaatcgcccatcagatacatccctcaggtatgcagccccctccttgccctgtgtgctgcccatccatccagaatccagggcccagctcaacacagctccccactcttccccaaacacccaggtgaagacaccactgttactgatgttgggccaggaggaccggcgtgtgcccttcaagcagggcatggagtattaccgtgccctcaagacccggaatgtgcctgttcggtgagtgcagcatgaaggccctggcagctggtgggcaggtgagcacaggaggaccctccaaccttaaatgttgctgactaatccctacaggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggttcctgctggtactttgtaccaaaccatccccaaccccacctcccactctggggtgcagagaccctaggttctgggtgtggcagccacaagggcttcatctgcctccagtgtgagaagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagaggaaacatggctttatgtctgacaagaagttttgtcctccccaaggcatatggcatcaaggctgggcctaacccagtctcatgaccttgtgaatccagtccacaaacacagagacacgcgtgaagacagctggccagcgggaccttgcgcatactcggttggggattataattccttccaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcactctcacgcacacgtcctcggtgcttgatgttacactcctggttggagatgacattcagcaaggccacatttaggactgtgtcattacccgtacctgnnnnnnnnnnnnnnnnnnnnagccatcacattacccagccaagggccctggctaggcattcagactccaaatctgggctctcacctgcacaaaggcatatgctaggttagaggggtagatcaggctcaggaggggtcactgcctgctgtgtgcgtgcatctgtgtggtcctgacactgcttcagtgctagagcagacgtgctaatagaggcctaagtgggcaatgtctatgtgttcctagggcttcccagctgtgctcaagagggcaaggtcactgccccatgcccactgagcctctggctccccgacttttttctcatcctagaataggagaatggggccaaccccctcctgaaggcagatggggatcagggttgggggcacttaccagggacccctaagcattgagtcagaagcagcaggagtgggagccaccccatccttctggctggaggctgcactgtgacccaccacagccccatccgggaagttgtgaaacctgtccctacgggattgggtggctctggctccacacgtcagctcagggcctgctggaccctgacctgagacctggtgacaggagccatgaggggccaggcctcaggtcccataggtcagttgcaagggcctagtacagcttagtggacaggtgttaggaaggtttggtggggacacttgaggtgccctggggttggggtgaaacccctctgcagcctagtcagcccaagggcattgtgaaagtgagagctgccagaggtctgggctccagcccctgggtgacattaaacttttctgaatttcggtttttccctgtaaattggggaaaattacttgccccagcttcaacactgcctcccctccacccttttgctgctgccttatcaggc

SEQ ID NO: 14988 - DNA, 8199 bp, Human
  misc_feature (1)...(8199): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagtagctgggactacaggcacacatcattgtgcccagctactttttgtatttttagtagagacggggtttcaccgtgttggccaggctggtctcgaactcctgacctcaggtgatccacctgcctaggcctcccaaaatgctgggattacaggtgtggtgagccactgcgcctagcccctcctcttactttggggaacatcctactctgtctatggagcagctgttgtttcaccactttactttcttaataaacttgcttatactttgcactgcgactcgccctgaatctttcttgcatgagatccaagaaccctctcttgtggtctggattgggacccctttcctgtaacaaatgcattggctgataggagaataaagaaaaaaaaagaggaaaaactagagtaacttctctacataatcatattatatgaccgttttgttaaccatgataacagttaacaaaataattttcttatgtctaattctcagtccatgtctgtatgtcccaaaatgtctttcacagctggtttgttcaaccattcaatgaaggaccaaacattgcagttggttgttatgtatctagtctctcaatcttgatcttcagaccaccttcagcccatctcaccacatccgtcccaagccctttgagccagccaaccccaacctgccatgtactttacaaaatgctccttttttttccacagtcgactgcttctctgtccctggagctctcccctttattctccaaggtcaccttgagcacatccttctgctccgtgaaatccattctcctctccctttccctccctctgagcttaaccagctgccaccgcaggcttctgcctttcttcacagtgtggccagaactcggttctgcctgctagcagagggcagggccgctgtcttcctctccttgcagcccccaagcctagcacatgcctggcatctagtggcagcacaataaggaacctgatgaatactcctttcttctgctctccgctcctcctccacagcctgccagccatggtcaggaagagcaagatccggaatgggcttggtgtgtcccgcgggaaggccgtgatcctggaagatgcttctcagcccagcccggatctccttcctttagctctagagacttctttcattctttgtgtacacacatacactaagactcaggaagtggttcttgaggcaggaccttaagagcccaaggagtggggccgaggctggaggtgtgggggtgtgacggccggtcctactctccggcctgttcagatcagctccttctggggaccacccctggcacacaagggagggaggcagcttgatccccctagcccgcttccagccctcacctggctttgtcttctgggataagacggggaaatccagaggatgtaagcctctcctgccttcgtgtcttcccccaagccctcgctatcacagacggatgcaggagctgtctgggaggctggaagcacagaccttgtcaatcctcccccagagggcgggacccgacgcggacgtgtcttgattgactgggtagcgtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggtatagcgccagaggggggccccaggcgccccgaggtcttgcccttgcggctttccctttgcgggggtgggcgccttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggtgaggccgcggggacccggcggacttcggcgcgggctgggagagaccacccgcagtcccttcctccagggctcgccccaggcccgcggagactcgtccggcgctctccagccgccctggagcaactttgcttcgaagttccctgggcccgggcagggtgtggcgggggtgctggctgcactttttttttttttggtgggcggggaggtcagagcccaggggaaaggggctggggcgggggtcggggttgggctgaagaccgtttctccaggctgggtgttgggtggggaaagggtgtttgacgcccggagactggcgggccgagggtcggcgtcaggctcaagcccctgccggcgcccttggatctgtcctgggccccagaggcggcggggcggggtccgggcttcgcggccgtcgcccccacccctctcctgcgggtaaagagggggctgggagacgtggatccgaccgcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagttcttgctctacgtcctcctgctggccttttgcgtgagtggcgaggggtcctggggggcgcgccggcagggtgcggggagacctggctccacagtggtgagggctgagggaatgagaattaaggcagctggagaccagatgtggaaagaaagccagggaaagacagcgcagccactccctcctccagttttcctggacacctgaggcttgtttccaccgagaatggccatcctgggtgtgcagcaacccctacccccatccctcctggcccttcctgtctggtgacccaaccacttgtgatatggggcagtggggcaaccagccaaccgcctgatgctatcgccatggggcttcccttcgctctcccttctcccctctctccctccccaaccctctcatccctgtccagcccctctccccctttccctcctcccagcgcttgggggtgaggaagggctctgcccacttcaatttgctcctgccctgggctcctggcttgagaggctactgtttgtctagggagggacacatcactcttgctcccttttcctcttcccttctcctggcctaactggccagaggaaccttagtcacagctgatgcgcgcgtgggatgtgcactggaggatagtgagggggcagttctgggagagaattgagctgggagccctggaggcctgtagaaagcattattctaggtcagaaatacgtgtcttgaggtcaaggctttctgggaggtttttgaatttggtcatgtccctgattaaagagccgggaggggatcaggggaggtaggggcaggcaaggatgggtcatccccctaccccacagccaaagaaattccctagaggtgtgagaatctctcttccggatggggtcaagtctgtgtcctaggtgtaccccctgccctccaccatggagggccactgtgttgtggatatggcctaatcctcacctgattttctcttaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacggtgagttgggggcgggaccaacatgggcggtctgggactgccagagcagcttggttcgggctcaggaaggtgggtgaggtgggtgggtgaggaagacctttgtgagtgtccagggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtaagcagggaataatgggaagggcctgcctcagccgggtctgggaccctggtgcttgaattctgactgcaacagtgctcctccgtactctcaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctcagcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaattctcatctccatattgaaggtgaaggttcacttaacaaccttcttctccatatttcttccctcccccagtttaagtgctgtggggctgctaactacacagattgggagaaaatcccttccatgtcgaagaaccgagtccccgactcctgctgcattaatgttactgtgggctgtgggattaatttcaacgagaaggcgatccataaggaggtagggaggagactgtgtatgggacttgggaaacctgggaaatgttttagaatgcaagagacccaggatggaggtggacagggtcagggatggggaggggatctggaaatgctaagggtggggtgaaaggtacaggggcagggaagagactgatggaccaagggagggggttggggtgggaagtttctgatggtgcttttgtcctttgtgcctgccaccttcagggctgtgtggagaagattgggggctggctgaggaaaaatgtgctggtggtagctgcagcagcccttggaattgcttttgtcgaggtaagagataaccctgagcaggggctgggactctgtccagggtgcctggagggaaggggctgaggggaggagggtgctgaacaggaggtactggcctgggagtgtgtgtttggagtctcttgcatgggtctgaggtagctagcccttctgactcctctccacccctgtccccatctttccttctaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttgctggaaggctggattcagtagactgcttgggcaggcttgggaaggacccaggtgagcacagcatccaccaggctggctggcaggtaggaggcaggcagccagagcagcttggcatcccaacctgggctgtagcgggttcgggggtgtcgagcagtcagggcatgctccaggcatcggctcaccttggttaggtccgggtcacagatcaggttcatgatgcgctgttgcattttcaggtctgcagccccataggtggttgcaatcagtttcccttcctcactccagcccatcttaggtactgtcttctggggccctgggcttgtcaccctcagtcccctcctcagtgtggggagtgggcaggttccacatggcctgggcactcttgtaacatcctgttcaccctcaaccctgccctgggtgccccacccacctcctagcaggcttatgcaggactggcctttctggtacttgtttcccttcatgtgcccctgtgtgggcctggctactcacacttggtgaggaaggcccccccatagtgggcctgtgtggcaggaggcagccgtgcccagcaggcctgcagggttttctccagactctccaggttggtcacaggggttcggaagaagccaggctccacgatggagactcgtatcccaaaatgagctacatcccgcctagagtcggggcagagcgaagttgctgggttcttgccctatagggaggggactttgagggacatgggttggggagctgagaaagttaccacagaccagggacaagagttttgacggagatgcctactgccccgggacaagggtcaagtggggtagagggaggaaagtatttttgaggtttgttttctttgatctagagcaggggtcagcacgtttttttcttaaagggccagagagttaatattttaagcatggcaggccaagaaacaaaattaatgatattatcaggtacttatataacagtttacaatgtaaccatttaaaaataaaaaaaaccattatcagcttgtaggcagctggccagatctggcttgagtactgagtttgccgattcctgacctagaggaaccccattcccttgctcccaaaacacatggt

SEQ ID NO: 14989 - DNA, 12513 bp, Human
aacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagcttcctgtctgtcaaatgaagacatttcgtatgttagataagagatctgctcctcagcagtggatactcacctttctgtgttctgacagtgctactctgtcccatgcagctttctctagtcctactattacttctatttctttagaacaaccatagcgcatagtccttttcattaagggttttagtaggaatctacaaggcaaccaattgggaataacaaaaagaacctacgtgctttaggacttataaaaagccctataagccctccttcagaggccaaacactgaaacctccagatgcttctgaattcattatcttagaaaagtcatcaaatctttttattttttcacggtaagaactctcaacaaacatgtctttctgaacacttcccttaggtgctccatccaggtgcctgttattggaacaataaagtcatgttacttcattaggagtccggcctctagattgcgaggcctttaaatggatgatccctccggtgtctggctgcccagttagcccccgttaccagcacccttggtcttcttccacctgtctgcccctccctgttctcccagcttcggaggacgactggaccggctgggcgggtttcgccagccgacccagggatccgaagaagggcgcacccagcctccccgacctaggtgtagacactgcccacccgctgcggctccactctactccacccctgcccgctcgactttaaacctatttccccgccgtagctccgcccctctcccctcagcccgcccctctctgttactggctctcgctcagcgttctcggtggaagtggtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggcaagacgtgttttctcttgttcctatccttcattcccgattattgcttcctctgattctggcagcggcgaggccacctcgaaaaggaagcgcccagctattggcgacagaagtgcccctctgtttttgtagcgtctccggggcgtcaggagccaagccggcacgtgttgctgggtcccattgcggatggctggcccccttcttactccgctagtgtccctgacaccagcttccccaccaccagcttccccaccacgtgctttgctggagcctttccttctttacttcagctcttaccctggtgggggcccccttctaccttgggccagctaaggagaccgttggagagcactcctggagcttctaatgcaagtcttggagatatatatggcttttcttgaagttactcattactaccacctttccaatctgtgcagatagtcttagttagcattcacatttgttgttctcagtgacttgacaactcaaatgttttggggtctccgtcttatcccaactaggcaagcttgtgaacattactggaaaagggaggactgattttaggattttcacaagtcatccttactccaggtgtgctctgacgatctcagcagttgcctgtcactctaggcagatgccactttctcttttctctctttccagttagcctttccattttattccagttagggagatacaaactgcttgtcattgtgcttttaaatggttttaacagcaaagatggtggggaacaggtatttaggatgcctcccgtcctgtgggtgaaaatctgagttttaccagctttcaaagaatcaccaaaactgagataccaaaagtcaaacctgtgctttatatcacagtggacatttagtatcgtaccctggtttttggtgccttttagtatttgagatactagtggtttgaatcagaaaatctcttacagtttataactttggcctcatatttcttttagataagccatgatcccccgaaatgaaacccagggaccttagattaagtttccttggcttatgcacttgtttatgaggaaataagtctatatagattgagattcctaacacctaattagagtgtctgagaaaggaatgcggtaacatttaacagtgcatcggcttcgagtcagcaattctgtctaccttcttgtccctgatgcctataaatttcatctagtctttgcgtgtatgtggggataccatggcaagaaccctctgaagttcataactctgtcctgtcacaccaaaggtagcatctttggaaagtctgaggccttgcctagggagatggattgtatatacccagttgtcacataatgtaaggaagagaagggaatgttgacctttcagcctcagggcaatggcaccagggagtattatggaaactcttaaattcaacttccaggtattccttgggtggtaactagacaatgaatacatacaaggctgacatgatgggattctgtcctcaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtaaaaaaaaaaaatccctcactaattttccgtttgacccttatttggtcctatatgtttttatttttttcactgtaatgacgcagtccccaccccagctctggctgaggtatttggaaatttggaatggcaagtgggatacaagcagtttcctacctaatccaaactgatgaaacttaagcaagaccctgaaaaaatccttctacatttctgaagggcactagggctcccgggagacagcaaggcagtaggctgatgattctttctttacaggtattgcttttcccaccagcatttcggtaaataactgtgtatgtcacttctcccctttgaagagcgaccaggattatattctcaaggaaggtgacttggtaaaaatgtaaggttaaaccgttttaaagcatttttctttttttaaagcatttacaaaatgccagttcctaatgcagtactctgatcttgcctttcagtgaccttggggtccatgtggatggcttcatcgctaatgtagctcacacttttgtggttgatgtagctcaggtaggtggcctgcttttgatctctgtttagccttggggtagagggaatgcactgccatttgcttcttatccccacccccaatcaccacgtaagttgagagagtctctagagaagcaaaaggagaaaggtttttgttgttgttgttgtttttaccctcctgttcattggctggtcttcgcatatgggctcacagatattaaccagatagccagctgagttaacagactttccaggaagatactgattgcatgtccttatctacaggggacccaagtaacagggaggaaagcagatgttattaaggcagctcacctttgtgctgaagctgccctacgcctggtcaaacctggaaatcaggtaagctattttatccaattccaaagctcgtttgaaccaaagatgcattaggcacctatagctactctatatgaaactaccaacctcccctacagaccccttataaaacagctttttaaaattagctatatttagctgggcacagtgactcacatctgtaatcccatcactttggggggccaaggtaggaggatagcttgaggctgggagttcaagaccagcctgggaaacatggtgaaaccccatttctacaaaaaatacaaaaattagctgggcgtggtaacatgtgcctgtattcccagcttccagggaggctgaggtgggagaatcacctgagcctgggagattgaggctgtgctgagctatgatcatgccactgcactccagcctgggcaacaatgaaaccctgtctcacaaaagaaaaaggaaaaataagcatttgctgtccccacaaaacagattagaatgccaggtaaaaaaggataaacactggacttaatattataggcatgtggtggcacatgcctgtaatcccagcactttgggaggccaaggtgggaggattgcttgaacccaggcatttgagaccagcttgggaaacatagcgagacccgtctacaaaaagaaaaaagaaaacccaggtttatgaccaagttctttcacttaacactcatttaacctggggcaaatcatttaacctgagactcagtttccttgtcttctagattgggatatacatctgccctgttcacatgcaaaatttattgagttagaccatctttgtgaaagcactgggtaaaatgatatgcagttacagctggtcctcagcttgatgctacattcagtagaagctatactttgagtacccatacaaccattctgtttttcattttccatatagtatttagtaaattacatgagatattcaacactaatataaaataggcatgtgttagataattctgcccaactgtaggataatgttttttaagtgctctgagcacatttaacataggctaggctgtgatgttaggtaggttaggggtattaaatgcatttttgacttagtgatattttcaacttatgagttttttggagatgtaaccccattgcaagttggggagcatctgtataaagtatttttagattgtagggataatcaagctatgaaatgaaaaaccagtgaatgacaatcattggggcttgatggaggatattagaacgctcagttctgccaggtgcaatggctcatgcctgtaatcccagcactttgggaggctgaggtgggcagatcacgaggtcaggagatcgagaccatcctggccaacatggtgaaaccccgtctcttctaaaaatacaaaaattagctgggcgtggtgttgcgtgcctgtaatcccagctactcaggaggctgaggcaggagaatagcttgaacccgggaggcagagattgcagtgagccaagatcacgccactgcactccagcctggtgacaaagccagactccatctcaaaaaaaaaaaaaaaatgctcagttcttttatgcttcttattctcattgtagagaacttattagctcctgatatctcacctttcatttgatgttgtacttctagaacacacaagtgacagaagcctggaacaaagttgcccactcatttaactgcacgccaatagaaggtgagaacagataacagggttgagggtctaagaatgagtggctttgccaggtgcggtggctcacgcctgtaatcccagaactttgggaggctgaggtgggcggatcacctgaggtcaggagtttgagactagcctggccaacatggtgaaaccccgtctctactaaaaatataaaaattagctgggcgtggtggtgggtgcctgtaatcccagctacttgggaggctaaggcgagataatcgcttgaacccgggaggaggaggttgcagtgagccaagattgcgccactgcactccagtctgggcaataagagcgaaactccatctcctccatctcaaaaaaaaaaaaaaaaagaatgagtggctttgcagaattgaggcttttgctcccttgaagatctatcctggctataacccagtctaagccagaaatctcagagccctgtgtttccataaccaggtagttgtctcactgcctaccacttcaaactactgaagtgggtggatttggaaaccttttgggatactggatagcttgttccataggttgtgtactatctacaggtatgctgtcacaccagttgaagcagcatgtcatcgatggagaaaaaaccattatccagaatcccacagaccagcagaagtaggtgccaaccctacttattaccttctaccacacaagactagtcatcaggtttttttctatactcccaactgaatcttgtccgccctctactccatgttttcaggagtgacctgttgctcttaatattccctttctctaggccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaattcctttctctctattccttttaggaaggaccatgaaaaagctgaatttgaggtacatgaagtatatgctgtggatgttctcgtcagctcaggagagggcaaggtgaggagagtaccagagttggcaaagaggggtgactgagagtgttcaccagaccaaatgttacttaaattactctttcaggccaaggatgcaggacagagaaccactatttacaaacgagacccctctaaacagtatggactgaaaatgaaaacttcacgtgccttcttcagtgaggtggaaaggcgttttgatgccatgccgtttactttaaggtactaagcaatgatagtacttggaaccagtctgactcacagaccatacacccaggaacactttttcctctcccttcctgcctagacttgtagcgtgcatgtgctcactccctccctctctctccccatctccttctcattgaaggtaatgtaaaagagcaatcctaagcatgatttctgcctgagggtaggagctattttaaaatatgagcaaaatggtaagacttgatggggagttaaagatacctctgaatatcatcttccctgccagagcatttgaagatgagaagaaggctcggatgggtgtggtggagtgcgccaaacatgaactgctgcaaccatttaatgttctctatgagaaggagggtgagttccaaaaagagcttcactttggattccctgattataagatatccttcctgtaagttcagaagagctaagtatgacaaaggaactttttatcaaaacacatcttcatttttgccataggtgaatttgttgcccagtttaaatttacagttctgctcatgcccaatggccccatgcggataaccagtggtcccttcgagcctgacctctacaagtctgagatggaggtccaggatgcagagctaaaggttagtatggaatagaaggtggtgagtatgtacatggtatcctgcttgggagtgagggctaaatgccagcaaagtcctgaaaagagctgcagtactgaaagtaaccctttatttttaatttcctccacatttctcaaaatttttttcccttcttcctgttttccaggccctcctccagagttctgcaagtcgaaaaacccagaaaaagaaaaaaaagaaggtgtgttattaacgatcattcctctctggcagggtgaacctgatccctctttctcccactgtgttaagttgtagtgaaatacggatttttatacagatgctcctcaacttatatgatagaactttgtcccagtaaacccatcataaattgaaaatactgtaagtcaaaatggattttaaaatatatatatatatatatttaagagacagagtctcaaactcctggccttgaacagtccttccacctcagcctcccaaactgttgggattacaggcatgagctgccatgcccagccttgctttggccgggcacagtggctcatgcctgtaatcccagcactttgggaggctaaggcggatggatcacctgaggtcaggagtttgagatcagcctgaccaacacagagagaaaccccgtctctactaaaaatacaaaattagctgggtgtggtggcacacgcttataatcccagctactcgggaggctaaggcaggagaattgtttgaatctgggaggcagaggttgcagtgggccgagatcgcaccattgcgctccggcctgcgcaacaagagcgaaactctgtctccaaaaaagagatgatctcactgtgtcacccaggctgacgtgtagaggcatgatcatagctcactgtatcctcaaactcctcctgggttcaagtgattgtcctgccttgacctgctgagtagccaccaccatgcctggctcaaaatggatttgatgtaccttaacctaccatgaacctcatagcttagcctggcctaccttgaatgtgctcaaaacatttattgaacaaattatcatgtatcgaaatatccatattgctttcacgccattgtgaagttgaaaaatcacaagttgaccattgtaagtcagagacctgtatgtctttatttcagctgtgacccagaggattgagataactttatggctgggtgtggtggttcacacatataatcccaacagtttgggaggcctaggcaggagcatcacttgagcccaggagttcaagatcagcccgggcaacatggtgaaacctcatctctacaaaaaatacaaaaaagttgtacatggtggcatatgcctatagtcccagctacctgggaggctgaggtgagaggatcacctgagcccagggaagtggtaccactgcactccagcctggaaaacagagtgagactgtctcagaaaaaaaaatacttttatctctggtcccagacatccccaagtagttagaaactgacaggtcttctccctctccttttcttgcatataggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataatgatgtgctttgtatgctgctcttgtttgatggaggtggggagaatgtcagttgaagtggtattggaactgttcctccacagtgccatgctctaccttcccaaaacgaggaatgtcttgacttgcagaagacacaaatcttagaatctttgatgatatagtaatctgctggagttgggtggtgtaattttctaagtagaaacagtcctcactgctaagatttgtttggggctaggacacaatgtctactgcaaaaacagtactgcaagtgtttatcttgaattcaagaagccaggaagaatggtacactagttttcagggccagactaaggtcagatgggtaattagtttatcttactacatgtcaggaattgctaaactagagatactacaagtgaacagaactgaacacaggtcaaatgtgtaatgatgtatatctaccattaaaatagagtagttttagtgccctaaaaatcctctgtgttttgcctgttcatctctctctccttgcttacgcatttgtccaaaggcaaagaatgtacaatgccaatgccaagagtgaaccctagtgtaaactaaactatggatttggggtgataatggtatatcaacgtaggttctattgttaacaaatgtaccactctggcagggtggagtgatgtttataaagggggaggctatatgtgtgggaaatgtctatacctttctcaattttgctgtgaacctaaaactgttctaaaaaattaagtctattaaaaaaagaaaaaaacagccaagtgcggtggcttatacctgtaattccagcactttgggaggccgacgcaggcagatcacctgaggtcaggagatcaagaccagcctggccaacatggtgaaaccccatctctactaaaaatataaaaagccaggcttagtggcgggcgcctgtaatcccagctacttgggaggctgaggcaggagaatcgcttgaacccaggaggcggaggttgcagtgagccaagatcgcgccactgcactccagcctgggtgacaggagtgagattccattccgtatcaaaaacaagcaaacaaaatttccctcaaagagcttataaactagttggcaatcatcagttgaaatcttggtggaattgatacaaaataattctgctaggattttttttgtttcaaaaaaattgtcatatatatttgggtggtgacaatactacaactacttagaaggaacctaattttaaaaacgtttttca

SEQ ID NO: 14990 - DNA, 12246 bp, Human
acatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagcttcctgtctgtcaaatgaagacatttcgtatgttagataagagatctgctcctcagcagtggatactcacctttctgtgttctgacagtgctactctgtcccatgcagctttctctagtcctactattacttctatttctttagaacaaccatagcgcatagtccttttcattaagggttttagtaggaatctacaaggcaaccaattgggaataacaaaaagaacctacgtgctttaggacttataaaaagccctataagccctccttcagaggccaaacactgaaacctccagatgcttctgaattcattatcttagaaaagtcatcaaatctttttattttttcacggtaagaactctcaacaaacatgtctttctgaacacttcccttaggtgctccatccaggtgcctgttattggaacaataaagtcatgttacttcattaggagtccggcctctagattgcgaggcctttaaatggatgatccctccggtgtctggctgcccagttagcccccgttaccagcacccttggtcttcttccacctgtctgcccctccctgttctcccagcttcggaggacgactggaccggctgggcgggtttcgccagccgacccagggatccgaagaagggcgcacccagcctccccgacctaggtgtagacactgcccacccgctgcggctccactctactccacccctgcccgctcgactttaaacctatttccccgccgtagctccgcccctctcccctcagcccgcccctctctgttactggctctcgctcagcgttctcggtggaagtggtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggcaagacgtgttttctcttgttcctatccttcattcccgattattgcttcctctgattctggcagcggcgaggccacctcgaaaaggaagcgcccagctattggcgacagaagtgcccctctgtttttgtagcgtctccggggcgtcaggagccaagccggcacgtgttgctgggtcccattgcggatggctggcccccttcttactccgctagtgtccctgacaccagcttccccaccaccagcttccccaccacgtgctttgctggagcctttccttctttacttcagctcttaccctggtgggggcccccttctaccttgggccagctaaggagaccgttggagagcactcctggagcttctaatgcaagtcttggagatatatatggcttttcttgaagttactcattactaccacctttccaatctgtgcagatagtcttagttagcattcacatttgttgttctcagtgacttgacaactcaaatgttttggggtctccgtcttatcccaactaggcaagcttgtgaacattactggaaaagggaggactgattttaggattttcacaagtcatccttactccaggtgtgctctgacgatctcagcagttgcctgtcactctaggcagatgccactttctcttttctctctttccagttagcctttccattttattccagttagggagatacaaactgcttgtcattgtgcttttaaatggttttaacagcaaagatggtggggaacaggtatttaggatgcctcccgtcctgtgggtgaaaatctgagttttaccagctttcaaagaatcaccaaaactgagataccaaaagtcaaacctgtgctttatatcacagtggacatttagtatcgtaccctggtttttggtgccttttagtatttgagatactagtggtttgaatcagaaaatctcttacagtttataactttggcctcatatttcttttagataagccatgatcccccgaaatgaaacccagggaccttagattaagtttccttggcttatgcacttgtttatgaggaaataagtctatatagattgagattcctaacacctaattagagtgtctgagaaaggaatgcggtaacatttaacagtgcatcggcttcgagtcagcaattctgtctaccttcttgtccctgatgcctataaatttcatctagtctttgcgtgtatgtggggataccatggcaagaaccctctgaagttcataactctgtcctgtcacaccaaaggtagcatctttggaaagtctgaggccttgcctagggagatggattgtatatacccagttgtcacataatgtaaggaagagaagggaatgttgacctttcagcctcagggcaatggcaccagggagtattatggaaactcttaaattcaacttccaggtattccttgggtggtaactagacaatgaatacatacaaggctgacatgatgggattctgtcctcaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtaaaaaaaaaaaatccctcactaattttccgtttgacccttatttggtcctatatgtttttatttttttcactgtaatgacgcagtccccaccccagctctggctgaggtatttggaaatttggaatggcaagtgggatacaagcagtttcctacctaatccaaactgatgaaacttaagcaagaccctgaaaaaatccttctacatttctgaagggcactagggctcccgggagacagcaaggcagtaggctgatgattctttctttacaggtattgcttttcccaccagcatttcggtaaataactgtgtatgtcacttctcccctttgaagagcgaccaggattatattctcaaggaaggtgacttggtaaaaatgtaaggttaaaccgttttaaagcatttttctttttttaaagcatttacaaaatgccagttcctaatgcagtactctgatcttgcctttcagtgaccttggggtccatgtggatggcttcatcgctaatgtagctcacacttttgtggttgatgtagctcaggtaggtggcctgcttttgatctctgtttagccttggggtagagggaatgcactgccatttgcttcttatccccacccccaatcaccacgtaagttgagagagtctctagagaagcaaaaggagaaaggtttttgttgttgttgttgtttttaccctcctgttcattggctggtcttcgcatatgggctcacagatattaaccagatagccagctgagttaacagactttccaggaagatactgattgcatgtccttatctacaggggacccaagtaacagggaggaaagcagatgttattaaggcagctcacctttgtgctgaagctgccctacgcctggtcaaacctggaaatcaggtaagctattttatccaattccaaagctcgtttgaaccaaagatgcattaggcacctatagctactctatatgaaactaccaacctcccctacagaccccttataaaacagctttttaaaattagctatatttagctgggcacagtgactcacatctgtaatcccatcactttggggggccaaggtaggaggatagcttgaggctgggagttcaagaccagcctgggaaacatggtgaaaccccatttctacaaaaaatacaaaaattagctgggcgtggtaacatgtgcctgtattcccagcttccagggaggctgaggtgggagaatcacctgagcctgggagattgaggctgtgctgagctatgatcatgccactgcactccagcctgggcaacaatgaaaccctgtctcacaaaagaaaaaggaaaaataagcatttgctgtccccacaaaacagattagaatgccaggtaaaaaaggataaacactggacttaatattataggcatgtggtggcacatgcctgtaatcccagcactttgggaggccaaggtgggaggattgcttgaacccaggcatttgagaccagcttgggaaacatagcgagacccgtctacaaaaagaaaaaagaaaacccaggtttatgaccaagttctttcacttaacactcatttaacctggggcaaatcatttaacctgagactcagtttccttgtcttctagattgggatatacatctgccctgttcacatgcaaaatttattgagttagaccatctttgtgaaagcactgggtaaaatgatatgcagttacagctggtcctcagcttgatgctacattcagtagaagctatactttgagtacccatacaaccattctgtttttcattttccatatagtatttagtaaattacatgagatattcaacactaatataaaataggcatgtgttagataattctgcccaactgtaggataatgttttttaagtgctctgagcacatttaacataggctaggctgtgatgttaggtaggttaggggtattaaatgcatttttgacttagtgatattttcaacttatgagttttttggagatgtaaccccattgcaagttggggagcatctgtataaagtatttttagattgtagggataatcaagctatgaaatgaaaaaccagtgaatgacaatcattggggcttgatggaggatattagaacgctcagttctgccaggtgcaatggctcatgcctgtaatcccagcactttgggaggctgaggtgggcagatcacgaggtcaggagatcgagaccatcctggccaacatggtgaaaccccgtctcttctaaaaatacaaaaattagctgggcgtggtgttgcgtgcctgtaatcccagctactcaggaggctgaggcaggagaatagcttgaacccgggaggcagagattgcagtgagccaagatcacgccactgcactccagcctggtgacaaagccagactccatctcaaaaaaaaaaaaaaaatgctcagttcttttatgcttcttattctcattgtagagaacttattagctcctgatatctcacctttcatttgatgttgtacttctagaacacacaagtgacagaagcctggaacaaagttgcccactcatttaactgcacgccaatagaaggtgagaacagataacagggttgagggtctaagaatgagtggctttgccaggtgcggtggctcacgcctgtaatcccagaactttgggaggctgaggtgggcggatcacctgaggtcaggagtttgagactagcctggccaacatggtgaaaccccgtctctactaaaaatataaaaattagctgggcgtggtggtgggtgcctgtaatcccagctacttgggaggctaaggcgagataatcgcttgaacccgggaggaggaggttgcagtgagccaagattgcgccactgcactccagtctgggcaataagagcgaaactccatctcctccatctcaaaaaaaaaaaaaaaaagaatgagtggctttgcagaattgaggcttttgctcccttgaagatctatcctggctataacccagtctaagccagaaatctcagagccctgtgtttccataaccaggtagttgtctcactgcctaccacttcaaactactgaagtgggtggatttggaaaccttttgggatactggatagcttgttccataggttgtgtactatctacaggtatgctgtcacaccagttgaagcagcatgtcatcgatggagaaaaaaccattatccagaatcccacagaccagcagaagtaggtgccaaccctacttattaccttctaccacacaagactagtcatcaggtttttttctatactcccaactgaatcttgtccgccctctactccatgttttcaggagtgacctgttgctcttaatattccctttctctaggccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaattcctttctctctattccttttaggaaggaccatgaaaaagctgaatttgaggtacatgaagtatatgctgtggatgttctcgtcagctcaggagagggcaaggtgaggagagtaccagagttggcaaagaggggtgactgagagtgttcaccagaccaaatgttacttaaattactctttcaggccaaggatgcaggacagagaaccactatttacaaacgagacccctctaaacagtatggactgaaaatgaaaacttcacgtgccttcttcagtgaggtggaaaggcgttttgatgccatgccgtttactttaaggtactaagcaatgatagtacttggaaccagtctgactcacagaccatacacccaggaacactttttcctctcccttcctgcctagacttgtagcgtgcatgtgctcactccctccctctctctccccatctccttctcattgaaggtaatgtaaaagagcaatcctaagcatgatttctgcctgagggtaggagctattttaaaatatgagcaaaatggtaagacttgatggggagttaaagatacctctgaatatcatcttccctgccagagcatttgaagatgagaagaaggctcggatgggtgtggtggagtgcgccaaacatgaactgctgcaaccatttaatgttctctatgagaaggagggtgagttccaaaaagagcttcactttggattccctgattataagatatccttcctgtaagttcagaagagctaagtatgacaaaggaactttttatcaaaacacatcttcatttttgccataggtgaatttgttgcccagtttaaatttacagttctgctcatgcccaatggccccatgcggataaccagtggtcccttcgagcctgacctctacaagtctgagatggaggtccaggatgcagagctaaaggttagtatggaatagaaggtggtgagtatgtacatggtatcctgcttgggagtgagggctaaatgccagcaaagtcctgaaaagagctgcagtactgaaagtaaccctttatttttaatttcctccacatttctcaaaatttttttcccttcttcctgttttccaggccctcctccagagttctgcaagtcgaaaaacccagaaaaagaaaaaaaagaaggtgtgttattaacgatcattcctctctggcagggtgaacctgatccctctttctcccactgtgttaagttgtagtgaaatacggatttttatacagatgctcctcaacttatatgatagaactttgtcccagtaaacccatcataaattgaaaatactgtaagtcaaaatggattttaaaatatatatatatatatatttaagagacagagtctcaaactcctggccttgaacagtccttccacctcagcctcccaaactgttgggattacaggcatgagctgccatgcccagccttgctttggccgggcacagtggctcatgcctgtaatcccagcactttgggaggctaaggcggatggatcacctgaggtcaggagtttgagatcagcctgaccaacacagagagaaaccccgtctctactaaaaatacaaaattagctgggtgtggtggcacacgcttataatcccagctactcgggaggctaaggcaggagaattgtttgaatctgggaggcagaggttgcagtgggccgagatcgcaccattgcgctccggcctgcgcaacaagagcgaaactctgtctccaaaaaagagatgatctcactgtgtcacccaggctgacgtgtagaggcatgatcatagctcactgtatcctcaaactcctcctgggttcaagtgattgtcctgccttgacctgctgagtagccaccaccatgcctggctcaaaatggatttgatgtaccttaacctaccatgaacctcatagcttagcctggcctaccttgaatgtgctcaaaacatttattgaacaaattatcatgtatcgaaatatccatattgctttcacgccattgtgaagttgaaaaatcacaagttgaccattgtaagtcagagacctgtatgtctttatttcagctgtgacccagaggattgagataactttatggctgggtgtggtggttcacacatataatcccaacagtttgggaggcctaggcaggagcatcacttgagcccaggagttcaagatcagcccgggcaacatggtgaaacctcatctctacaaaaaatacaaaaaagttgtacatggtggcatatgcctatagtcccagctacctgggaggctgaggtgagaggatcacctgagcccagggaagtggtaccactgcactccagcctggaaaacagagtgagactgtctcagaaaaaaaaatacttttatctctggtcccagacatccccaagtagttagaaactgacaggtcttctccctctccttttcttgcatataggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataatgatgtgctttgtatgctgctcttgtttgatggaggtggggagaatgtcagttgaagtggtattggaactgttcctccacagtgccatgctctaccttcccaaaacgaggaatgtcttgacttgcagaagacacaaatcttagaatctttgatgatatagtaatctgctggagttgggtggtgtaattttctaagtagaaacagtcctcactgctaagatttgtttggggctaggacacaatgtctactgcaaaaacagtactgcaagtgtttatcttgaattcaagaagccaggaagaatggtacactagttttcagggccagactaaggtcagatgggtaattagtttatcttactacatgtcaggaattgctaaactagagatactacaagtgaacagaactgaacacaggtcaaatgtgtaatgatgtatatctaccattaaaatagagtagttttagtgccctaaaaatcctctgtgttttgcctgttcatctctctctccttgcttacgcatttgtccaaaggcaaagaatgtacaatgccaatgccaagagtgaaccctagtgtaaactaaactatggatttggggtgataatggtatatcaacgtaggttctattgttaacaaatgtaccactctggcagggtggagtgatgtttataaagggggaggctatatgtgtgggaaatgtctatacctttctcaattttgctgtgaacctaaaactgttctaaaaaattaagtctattaaaaaaagaaaaaaacagccaagtgcggtggcttatacctgtaattccagcactttgggaggccgacgcaggcagatcacctgaggtcaggagatcaagaccagcctggccaacatggtgaaaccccatctctactaaaaatataaaaagccaggcttagtggcgggcgcctgtaatcccagctacttgggaggctgaggcaggagaatcgcttgaacccaggaggcggaggttgcag

SEQ ID NO: 14991 - DNA, 11730 bp, Human
ctcttttaggatttgtctagcaggctttcaggtttttgccagaaaccacccccacccccacccccaccaaaaaaaaaaaaaaaaaaaaaagatagttacaaatgtttcccagaatagttgtcccaatcgaatctattttctcatgtgtagtgtatggttgttttcctgtcaccacattgctgattattattatttttaattatagagacagtaaagtacagtagttaaaaatgtgagttggggctgggtgcagtggctcacacctgtaatcccagcactttgggaggccaaggtgggcggatcacctgaggtcaggagttcaagaccagcttggccaacatggcaaaaccccgtctctactaaaaatatatatatataagttagccgggcgtggtggcacatacctgtaatcccagctactcgggaggccaaggcaggagaatctcttgaatccaggaggtggaggttgcagtgagccaagatcacaccattgcactccagcctggatgacaagagagtgagactgtctaaaaaaaaaaaacaaagtgtgagttgtacaatgagactgcctgggatcacatacaagcttcatcccttactagttgtatgaccttaagcaagtcacttaacctttctgtgcctcagttttatcatctgtaatgtggggaaaataatagtacctgcctcagagggttgttttgaggattaaatgcattaatatgtggaaagggcttaatataagttgtacatagcatatgaaaactgttatgttaaatctattagcagttttatatgtgaaaatagctttgattttcatttcttggattatgaatcatgttgaataatcctttatatgcttcctggattctttttttttcttccccccagtcagtttctgactcttcacatatttacagagagatcttggaacctggatgggggaatccaggaaactcatggattccttcttcctgaattttatcacccaggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacaggtctagaggccaggcaggaaccctgggggaaagaaggaacaagggaagccattcttacagatactgagctatatattctctccacacctctctctcctcagagcctttgtggtagaaacccagccctgcatgccccaaactccccatcgacccctcatcctcaagactggcagcaagttcaccgtccgaacaaggttggcattccagaactcattcccacttcctttttccaaccctgccactgtgtattttctggctttacagctcttcccactcttggctttttcttctctttccctgcaatctccctacctcttataatccctcttctctttttcaaacatctagtctatccggaaggttgaggttgaccactttcccctatcccccttccttcccccaggctgctggtgagactccaggaaggcaatgagtcactgactgtggaagtctccattgacaggtaaattggagcaggtgaagggtggccaggacacgggctgctggggtggaggagatactcactcttcacaacagggccctagggctatctccttcctccttccaatcctacctcacagaaattataattcatttcttttgttgaacacttactttgtgacatgcagcatgtcagctactcatttaattgtcacaccaaccccatgaataaactattaccagtgcactgtacaaacaaagatacaggcttagagagactgattacatctcttctcaaggccacatagctagtgagctcaagtcgggtttgaaccgaggtctgtctgatcccaaagacgaaactcctaacttccatactcttttgcccaatgatttttttaaatttatttcttttcaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctggtaagaatagtttgtgacctatgcttttattactatttttatttttttgagacggagtctcactctgtcccccaggctggagtgcagtggtgccatcttggctcacagcaacctccgcctcccgggttcaagcaattcttctgtctcagcctcctgagtagctgagactataggcacacaccaccatgcccggctaatttttgtatttttagtagagatagggtttcaccatattggtcgggctggtctcgaactcctgacctcaggtgatccacccgcctcagcctcccaaagtgctgggatcacaggcatgagccaccatagctggcctgcttttagtccaaaggaacaggggttgggggaagttcccagggcttgagaggtcttgaagccaaacaggggttccagggacactagggtgcccactctggcattttctctccttcccttcaattcacagactctggtggagcaacgttcaggtggttcaggaaagggcagcaataaggtgagatctggacagaggactcgaggcagggggagcttgccaaagagccttctgatgactatgtctttggctgtcccaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaaggtaactccctgaatcctgtggagctgctggatctagcccacattccaaatactggccttcccacgtccctccttccctacaccagaggcaactcctcagcttttgctacctttccattcctcctccagcgagagagccctcctggcaagttaccattctggacatggctggacaaaattctggagttggtacatgaccacctgaaggatctctggaatgatgggtaaggccttggtcacccttccctcatgggcttgtgctttccgggcttgagagtggagtctctgcaccctcacgtggcaagcagggagagagagcaaagacaggtgcaggccacgtctcctcacatttgttaacaataataaggccgggtgtggtggctcacacctgtaatcccagcactttgggaggccgaggcgggcggatcatgaggtcaggagatcgagaccatcctggctaacacggtgaaaccccgtctctactaaaaatacaaaaaattagccgggcgtggtggcagacacctgtagtcccagctactcaggaggctgaggcaggaaaatggcgtgaacctgggagatggagcttgcagtgagccgagattgcgtcactgccctccagcctgggtgacgagcaagactccgtctcaaaaaaaaaaaaaaaaaaacaaccaataatagccataaacagtgtttgtgaagcatctcctacattccagagcttgatgggtgctcttcattaattctctcatctcatccttacaaccatgctgagtggtgggttttgccagcttcatttcatgtgaggaaactgagtttcagagaagttaaagaacttacccaagggacacagttgatattcaaatccaggcctatgtgactccaagcccatgctctttccaccacactgcctaccaacttgtgtagcatttggcttttaaaagtgctattcatgaccaggcacgatggctcacgcctgtaatcccagcattttgggaggccgaggtgggtggatcacctgaggtcaggagtttgagaccagcctggccaacatggcgaaaccccatctctattaaaaatacaaaaattagccgggtgtggtggtgggcgcctgtaatcccagctactcaggaggctgaggcaggagaatcgcttgaacccaggagagaaggttacagtgagccaagatcgtgccattgcactccagcctgggtgacagagcaagactctgtctcaaaacaaaaccaaaaaaaagtgctatttgtggccaggcgtggttgctcatgcctgtaatcctagcattttgggaggctgaggagtacagatcacttgagcccaggagttcaaaactaccctgggccacgtggtgaaaccccgtctctacgaaaaatacaaaagttagccaggcatggtggtgtgcacctgtggtcccagctactctggaggctgagaggtgggaagattgcttgagcccgggaggtcgaggtggcagtgagctgtgatcatgccactattctccagcctgggtgacagaatgacaccctgtctcccagaaaaaaaaaaaagtgctgttcatctgtgtgatctcactgaatcttcgtacttcaaaccctcggaaggtggctattgtcagcaaagtgaagtgacttgtaaaagataaaaaaaagctaagtggcagggcttggtccaaagcctggattccaaacctgggctgtttctccatacaaggggagcagggaggcaggggcctggtggggcagggtgttgggcggtgtctcacagctgctctctgtgctccagacgcatcatgggctttgtgagtcggagccaggagcgccggctgctgaagaagaccatgtctggcacctttctactgcgcttcagtgaatcgtcagaagggggcattacctgctcctgggtggagcaccaggatgatggtcagctgctctgccctgccattcccacagcctctcctttctgcctggctcccctcttgcccctctgcctgcccttggcttccctggctctgaactgaatccctcagctggtttgggactgggcagccagagcagagagctccaaggcccggcctcttccctcaagcccgcctgttcctgcattcactctccagacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaaggtgggaatcgttgacatacttcattgctagattgcagagatctaccagacatccatagatcccactccttcctttaaagcatgggaaaactgatatctagaggaattaagggattcgtccatgggatactgctggttactatggggatgagactgccaggaccatctgcactaggggaacctcaggctatatgtctggcccactgatcttctctgcttcttgtatatgttcctcacagttaatctccaggaacggaggaaatacctgaaacacaggctcattgtggtctctaataggtgagatatgaactcttcattcatcctccctaatcctttttggctctgcttcagtgaatcgtcaaaagggggcattaccttctcctgggtggagcaccaggatgatggtcagctgctctgccctgccattcccacagcctctcctttctgccttctcctaagctgccctattccagtctccccagccttccctccctcctagcccactctagttttttctggttctagtctctcctatctcatatttttctgctgccatccttaggttgtctccacaggggtttctggataataatgatcataatcactggtgttaatgggtacctacttgatgcaagcatggagctttttttttttccagacagggttttgttctgtcgcccaggctggagtgcagtggtgtgatcctggctcactgcagcctcgacctcctgagctcaagcaatacaggcatgcatcaccaaactcagctaattttttttgtattttttgtagagatggggtcttaccatgttgcccaggctgttcttgaactcctggactcaagcaatccacccaccttggcctcccaaaatgcagggattacaggcgtgagccaccacaccccgcatatatatatattttttttttttttttttttttttttttttgagacagggtctctgttatccaggctggagtgcagtggtataatcatgactcactgcagccttgacctaggggttgaagcaatgctcctgcctcagcctcccaagtagctgagactacaggcacacgccatcacactcaatcacactcagctaattttttaaattttttgtagggatggggtatcactgtgttgcccaggctggtcttgaactcctggcctcaagcagtctcctgccttggcctcccaaattgccgggattgtaggaatgagccatggcacttggctggggatagaattttttttttttttttttttttttttttgagacagtctcactctcattgcccgggctggagtgcagtggtgcaatttcagctcactgcaacctctgcctcccaggctcaagcaattctcctgcctcagcctactgagtagctgggattacaggcgagcgccacccatgcctggttaatttttgttttttttttgagacagagtctcgccctgttgcccaggctggagtgcagtggcacgatctcagctcactgcaacctctgcctcccaggctcaagcaattctcctgcctcagcctcctgagtagctgggactacaagcgcgcacaaccaccacacctggctaatttttgtatttttagtagagacagggttttaccatattggccaggctggtctcaaactcctgacctcatgatccgcccaccttggcctcccaaagtgctgggattacaggcgtgagcctctgcacccggcctaacttttgtatttttagtagaaacagggtttcaccatgttggccaggctggtcatgagctcctggcctcaagtgatctgcccgcctcagcctcccaaagtgcttggattacaggtgtgagccaccatgcctggcctgagagtttattatgcgccaggcactaggctaaatggtttgcatttattttctcattttattgaatctacaaaatagtcctgtgaagtaaacactgttactgttttcagctaaggaactggatttagagtagtcaagttttgtacctaaggtacgtggctaatgatacaggtctgttagattccgtagccctgattttaaccaccctactgcctctcaagaattactaggtattgttctcatttatagatgataaatctgaggctcagaaaagttaggccacttgcctaaggtcccccagccaggattcaaactccaggaggcctgattccaaacccatgctctttagccctccgccctactgccttcttagactagcttctgcttattctaccattcctgatttcatttgaaccactgagccctgcccctttgtctgtctttgggtatccagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaagtaagtgatgagatggagctatggaagatggcacacattccctttcctacctcttctccctctcccattacagaaaaagctgaactccaagctcctcattggagagaggtccattctgtgattcctttttttaggaattacacatgccttcccccacctccctgctctttcatcccacaagttcccactcaggctcttcccaggcctttcctgccatcctccctccctttccctgctgggttgggaactcctaactaagatcggggcctcacttttctctctggattacctagtcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaactgggctcaagtgatcctcacgccttggcctcccaaagtgctgggattataggcatgagccactgtgcttggccaggatttttttttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaatgtctcatctctgatcctctttatttccctgctcacaaaggctaatgttcttagggacaccaacaagctgcacaggaatgaagtcagaaaattgtggcctctcttccatccacccctctacattcctcttgtcatatttcttcttcccttcctgtttggagtagcccctcctgtccgttagactcttctaggggtgctgggagctatatatgcattgtggggggagggatgagtagttatataactgtctcattgtcactcagctgattgttggcaaagccaaaacacaaacctgtctggatttttctgacttcaaacccacactttttgatgctgtgactatggaaaaaaaaggaaaggaaataatcactagccacttcccctcatcttttctttttttcaaagaatttcagctacccttgagttaccaaacttccaaagggactccaaggccgggcatggtggctcatgcctgtaatcccagcactttgggaggccgaggcaggtggatcacctgaggtcaggagttcaagaccagcctgaccaacatggtgaaaccccatctctactaaaaatacaaaaattagccaggcgtggtggtgcgtgcctgtagtcccagctgcttgggaggctgaggcaggagaatcgcttcaacgtgggaggcggaggttgcagtgagcagagatcacgccactgcactccagcctgggcaacagaatgagactccatctcaaaaaaaaaaaaaaaaaaaaaaaaaaaaagggattccaattgtcctttgagaggaaagtcccattattctaggatatttatcttcatttccctggaatgcccttcctgctcaaagctgaactctgacttttgatcctgcaatgatcaggactc

SEQ ID NO: 14992 - DNA, 13782 bp, Human
ggacaaacagctcatcaaggaccccctgtgggcagtcagggacccccttggcaggcagagaccctccacagcaggcaggcagcaggcccttttgctgttgaacttgctgggtctggccctggagaggactcccaggcctcgttccccaccctgtggtggaggctggagcaccagcccaggaacgttatctgagtgggatcctgaggccctgctgaccaggtgccactgcaatccctggtgtcagccgtggggtcagctgaggctgcccatccacagtcaggtgtttccctggcctctggcaacaggagggatggtgggaatgcacagaagcctgggcccagtcgaggcgggaggggccaggcaggggccaagcttgaagtgtctggagaaggagagtgagtgcgaggctggggctcctgggcagggaggagctgggacctgcccctcagtgtggagttggggctgggccagggacgaggtccacaccagccttgcacctgctgctctgtgaactctctcactggcccccgccggcctgggagctgacctggagagtccagaaacggtggtggcctctgtccccagcctgctgtttgcagtgcatgggtgtcctcagggcgcctccccccagtgcctcctgtggctgtgggttgggggtctggcttgctgagggcccgctacccaccgtagcccgctttgcacagggcgcagggcccagggtacatctatctcccagccttccctcagtcctgagctgggtggagtaaacttcctgactgcctggcagctgtgggggcacagggaagatggcattgcagggacacccagtgcccatctgtgtgtgacccaggtgtgacccaggtcccaaccctgccccaagcctcggtttccccatagttaaagcaaactcatcatccttaacactatgcgcctcctaggggctgtgagtgtaaagtggacccagaggaaggccagtcctggcaggtgacagggagatggggcccggcagtggggcagtgacaggcttgtcatcaagcctgcaggaggggcttccggagactccatcctcagacatccctactccacctgcccacccggcagtctgaggcctttgcaggccatgccgagggcctggcacctgcggggtccccgacactgaccctcctcccagggctgccccgcccctcccatcctgggccctatcagcccatgaaggagcctcctagaccccaggctccgctaggggagaggcactgtgtgggtgcaacacgcccctgcaggagctgggcactcacccccagcaggcacgtggcgcacactaaacctcagcctgcaggtcaggagggcagcagtggcaaaggagccgtgcctctgtgcctgagcccctcccgcacccgcctgctatccggctgcccccgggagcccactctccagtggaggcagccccaaggccaccatccaccaggggctggattatcggcttacggagctgccctggagtcaagtctccagggattggactccctggggctgtgctagggagagaggggcaggtgtgaggacagcaagcccggaggagggcagagagcttgaccatgtgggagggtgaggtgcagtccagaccccgacttgctgggggtcctgtggtggaaaagatgcagaagtcacagcagggagatgcctgtgtcccagggatgagatggaatgttctggaatgcctaagggtccgtgaaccccagggcccacaggaaggacccctggcctcttccagccctcagacccttctctgtggggcccatttgcccccctctgccttgttgcatcctgctgagagctggccttgtgacctggacggggtctctccagagggagaagggttcccacgggcacatgttggtgtgtcctggtgggcgcagctcccagctctgatctgtcctggggagcttctgggtgccacccaggggcccgcagcactgctgaccatccccctgtccctgcaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtacccagcccactgcccaccaggcatgcatcacgtccagggtccacagctaaggggccctcagctcgggcagcacccccctcctctgccttccagtccaaactcgactccttggggtcacagccaggggcgtgtggagcagtcctccctggcacttgcctctcaccgctgcctgttgcccctgctcagggcatcccccgcacccccgcccgcagcacccttccctaccctccctccagggcctccttgctcagcttctgcacagaggtgccgggccctccccacgcagataggactgtgtggccagggccaacccaggctcacagaggggagcagtgagtggaatagcaaggtgtgaccacatggcagtgggagcagcccagctggcctacacgggacagggacagctgtgtggtccacttccactgctgtgaggacaggaggggtggtcaaaaggcacacgtgagcagtccatgtccccgtcccacagcttcccccagcccgcagagtattcagggacccagaattctctctgtggccccccaggaatgtccttctggggaaggacagctcattctgcccaggaccatcaggtgcagctggggagggaccagcggggctgttgacctgtgaaggtggcggcacctcctccttctactgcctcgcaggggacaagggtgacaagctcttggccctggaggctttgagaggggtctgggtcactgataggccctgttcagagctgggacatgggaggactcaagtgggatggccactggccaggagtccgcccgccccaaggccagaatcggctccctttggtttccaacaaggggaatccggtgattaatgacccccagcaaggactcccggcagagtgcgatcccattggctgccggtgacgtcacccagcccagggttggcggctcagctggcttaagggctgagtgtgtgcttgcagggcgggggcaccggtgctgtctgagcaaaagccgctcaacatctgggctggcccttggggtgggggaggagggcaggaggaacccagcttccagctgctgcctccggaattggtgcaggggcctggggtcctgctgcagccctctgtttctccgctgggggttggggaggggatagggtggggagcagaattgctggctacacagttagccccactgagagcccacacccgaaggcatgcgtttcagggccgagcttctctgtccctccgccaccctgggagccagccaggtcctatcctgggctcccatcgcactcacctgtgtctcctccacacaggcctggcccagagcgtccgtccccttcacccatgtgcatggcatgggggcacagctgcgcagggcaggagtccacccctccctgcccccatggcttgctgtgtggtgtgggtgtgtgcatctgggcctctggcagatggaggagagtgtgtgactgcacctgccctcccctccaggcagcaaggtgacagctgcctgcctcccatcatctgatgcccttactattcccttgagccagcatatctgggacggggccagggcatcgataggtggaggcggcatgctgatctctgccccatggcccccaggtggaggctacggagccacaggacgtggtggtctatgaccagagcacgcgggacgccagcgtgctggccgcagacagcttcctctccatcctgctgagcaagctggacggctgcttcgacagcgtggccatcctcactggtgagtccatgacccacgcctccccgaggcacttgctccgccagcagtggggctggggctggggctggggcatcagggaggtgtccgctgggcacggggggatctccatacatctgtggttcttgaggccccaccatcctctccccaggacgcccacacttcaggacccaccaatatgactatcctcaacacagaaggaaacctcacagtacagctgggctccagaggtgtagggcaaggcatgcaggctgggagcccctcccactcccggagctcctgtcagaagccggaggcagaggccccatcctctggaaactcagttggagccgtggggtcccgaggaagtccccccacctccgaaagcccagctgagtgcaggttgcctggcaacagcctggcaccaaggctgctgcctgggtcccagcagacagcccccagggatccctgtggcccaaaagcagcctgggcaactggccccaagccctggaggcagggaagccgcccccctacacacgctgatacacactcatatacactcacacactcgtggtcccagagggttctttctttccttgggctgtggctgagggcgtgtctgtagaatccacctcctggggtcggcccaggtcccagagccggacggagctggcctgtcccagggatgtgcaccctcccccatccaggtctggggtctttgtccaggctccttctgcctggcctctgctaccaggggctgttccaggcaagcagaggatatgggggactgtggggtgcaggcacggtggggtgaggagtaggcagccaagccaggcccttggccctgcatccagtggaagcagggaccttcacccagcctgagggcggctgtgggggatgaaggggtggcagccgctttggccaggccgacctcccgacatggcatgtcctgggacctaaagggcacctgggaggcttgagggtggtccagtgtcctgggcaagagcattgaggccaggctccctccccacctctctgtgggtgagaccagcaccctgcactgctgggtggccatggtcagagggtgtctgtgcgtctgtgcatggctctgggcgtctggtgaccagcatctgcctctgcgagtgtgtacgtgagcatgtgtgtgcatgtatgtgtgtgtgtgcatgtgcatgcatgtatgtgtgtgcatgtacatgtgtgcatgtatgggcatatgcatgcctgtgtgtgcgcatatgtgcatgtacgtgtgtgcacgtgtatatgcatgtatatacatggaggtatatttgtgtatgtacccgcctgtgcttgtctgggtgagatttgggatttgtgtgcatatgtgtgaactctcagaaccagaagccacagaatgacgcactctgatccaaccctgttcccctaggtccagtttgaggactgaactggtggggggcggggagagagtagtttggggctttttacagctcaccaggtgtaacaggacccctcccaaaggccagtttgctgccctagccaggaatgggagtcaggagactcttcttggaggctgagaaaggtcccagagtggcacctccctacctgcaggcagatcccaggaaagtcccaagcctggaagggcctgtctccctcgaggccagagtgggacggtttggggggctggggccctcacccagcactggtgggtgggacagcatgggtgtgcaggtgggcgtggatgagtatgggcatgggaggggccgggcctgtgctaggatttgccaggagggcactcccagggcctggtcatgccaccctcagaactgcctttctgtgctgacatctgccctgcaaggttgaggctgtgtccccttttctccagaagtgcagctgccaaggagtcccaggccccgtggtatacagtgggctcatggcgacacccaggcaggcccacgggctctgccctcaggctccctcccaccctgtggtgggcacagcccctgctctgggctggctctgcgaagaaccagggagagtgggaaagaatatattggggggggcaggggtgctgcccctcacccaggagaagggatgttccaggatcccgcggcacaggcaacacagctccttggtccatttgcagggacagtagaggccggaatgtgaggaccaagcctctgtcctccccacagcagggcaggtttgcgggaagcgggagagaaacagtggcaggacaggctgtgctggggtcccaggactgctgtgaagcccacctccccctgccgctcctcttcccccactccagctgcgctgctcacgatgttggggggcaagcggcaagggatgagagaggggcctggccctttaagcagcggcccgcagtcggccttggacccttggccgggcgactgcactgcaagtgggtggggtggcggcccccgccctggcggggagtccaggggtcatggaggtggcgggcagaagtgcgtctgtgactgtggccataagcgcttgcagggtctcccaggtggcatggggcaggcacatgtcctggtacacacgccttttttcaagtctgggatttcactgtgagtaacaggtgaactgcaggcgctgccccagaaacccccgagtcagggagcagggatactgggaaggcgcctttggagatgcctgggggtaggggtgcctccccagggcccaaagagtgctgggacctacaaagggtccactgaaccccaacacccctcacttatcactcacccccagagcctgggtggttctgaaatccctggagcctcggtccctgctaggcctggcatccacagtggggtgtgtagggacatccacactacctgctccgcctggggaggtcctgggaagcttcctggggaattgctgacatagctgtcggttctctgcacctgtccagagactttcctgcctttacctcctctgggagaggtgggagggtactgatggaatccccagcacctcctcctttggccaggccctggagaaagcagagagtaaggcacaaaatccctgggagagccacagggaggaggagaggcagcaggtggcagaagagtctgcagagaagtggtgcagcccttccgcctccccggggctgtcctgcagcgggaacatccagggctaccccagctcagaacagtgagtggaagccagctacagtgcccatcccagcctctgctcaggggaacctgcaagctggggcgtcgttggtgacaagtcacctacctgctttcccctgtccagtcagcaggttcccacagaagagactgttcctccaaggctgctgcctcaacccacccagcctggagcttcccctatctccacagtcccccagcgtcacgccctttttagggacacggggagctggcacagcaggtgttctggttgggggtttgcacacactcccctgtcctcaggagttatccagggtggctctactccacccagcaggggagaatggagagaggaggagccctaggcactgggggcacgcggggcaggcagtgggcacctgctacacatgtggcaccagcctcttctgcaaaccaggacaaaaaagagccctggggttcccaggccctgagctcccgccgtcactcccctgccccgtccaatgggatagggcaggcctcagcccagctgcctcaggctctgcacaagcaggagccggcttgccatgggggcttatgttctggaaggtgtcctcggggtggtgctgggccatgctggcttcaccctcccaagagctggcagccaccaggtgggtgctgcccagtttctggtccacatcggtggtcgccccagccaggtcagggacggccaggtccattctcaccatgtgtcttcgtgctcattatcttcttggaaccacatgatgctgtgtggcaggcaggaggaggaagctgagaccagagccatggtgtgcactacccatggtcactgagtcagacatccagggattcacgttcgggtccttccagctggtgcagggcaggggacttcctcccaccagcctgtggcctcggacttggacgtgtgtggaaggcagcagcacacgctggtcacgtgtgcagcgggtgcccactgcctgctctgcgtgcccccagtgccccgggcttctccactctccgtcctcccctgctgggtggagtacagccataaccagacagcaaatgccccgagggctgtgccagggtgatgtcatgcctggggacggggagggcctctcggaagccctggcctcctggtcctggcacccaagcccaggcctggggctcccagccagctggaggcagggaggcattgcatcagtgcaggggaggaggaaggcccagcctggccccaggccatgggtatgggagatggccgggctcgtgagggcctctcctctgggctgtgtgacacacaccctcagcaggagacccctgtggcctctgagcccacccctgcctgggcccagcgcgtgccgtgatggccagccacctcaacgccacctttacgggcatcctagcggcgtcctcagctgggtcagcccctaattagcatgaggaggaatgtgggcgtaggtgcaggctgtaaatgtgtggcagtaccccctccccccaccgcgggcagagcaggtgctccgccagaggcttgccggctgggctcaggctcgggtctgggctgggtgtgactgatcctcagcagtagatggggtgccctaggcggacagggcaccctaggcggacagggagccctaggtgttctctcaacccacttgacggccctcctcctacagggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggtgtgtgtgcagtggagttcggggggtggtcaatgggaaaggggcaggagctccagaagcagcttggcagcggagcgggggatgagggaggaaaggagctgaaggcagtggatgagctgggtgtgggagaagcatgggtgggggcccaggaggaccccaggctccccacccatgcccctggaaggaccacagcagggcttgcgggagggcccggcagggctcgggggaggagcggggagctggcatgccaagctgcggatgtcactgggcctctggccagctctgaaagaatcccatgttttaaaaatggtgacgagggaaaagggtaaaagccaccacccaggcaatcataaaattcctaggagcccaccaccagccgtgggtggggcctgcagtcggaggccagccgtgccccaccccccgcacgggcccagggtgccagggtggaccagagaggcctcctgggccctcccctggatacactgggatctgggacaaattccaaggctcccaggattctaaaggccctcctgacggcagggcaggaaaagcctccaccttcactcccgccccgagcttctcccacccctttccaacccgccctcccgcccctccaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcggtgagtctgcggtgggcggagggcagggacctggctagaggaaggctagagctgtgtgtggccacagacacaggaggggtccccaggaagtagccggaactgttggcagttgggcgggtggggtcccctacctgggccagggagaagctgtgcagtcttagccctcacctggcccccatggcccacctgcccagataaagccaagctctccagctgccaagtcatcgtccactgtctggctggcatctcccgctctgccaccatcgccatcgcctacatcatgaagaccatgggcatgtcctccgacgacgcctacaggtaccaccttccccagtcgcgcacttgtggctcacagcgtcgcttcccttcccccggctgcccacttgcaccagaatgaccccaccgtccaggacccgtggcaagggaggagggcctgagaccagcctggcgcacatgagctcgtgggtgcccagcgggtgcgtcaggtgggcagcctggccccggcgggcgcctgggactgagcctcctcccccgcaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcatgcggcccgacggccccgggccccccgaccccggcgaggccccgaagctctgcaagctggacagcccgtcgggggccgcgctgggcctgtcctcgcccatcccggacagcccggacgccgcgcctgatgcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccactgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccggccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagcc

SEQ ID NO: 14993 - DNA, 114842 bp, Human
  misc_feature (1)...(114842): n = A,T,C or G
gacagctggtaatatatttgggtctttgaagaaagcaacaggacctgtttctttctacgcactaactgtggctaagcaacaagacctactctctactggcaacagaattggaacccttaacttcctgtcagccacagcccacactggatttccctagaattttctagaagcaaatggctaccacaggaagaaaaccatagaattcagctggaaaccatccaaatttcctcatcctaagcttcatctccagcaagcctcagtcaaggagacccacaccacaaggctatgacataattcttggttgcctgccaaaatagagaaaaaaggatgaaaaggaagagtttttattgcaaaaagacagcttagggaattttttcttaacttagtgagatggaatcctgagacaaagatttgttagagataacttgtgtaggggtattaaactcaacagagataaagggagatgggtgagtaataagaaaaataaattaacccttggtgttttcttcaggcaatgctgaaaacacacacacacacacacacacacacacacacacacacacacacacacaaaaaaaaaaaaaaaaaaaaaaaaaaaaaccttatgcccaccacatcatcatttgtatcttaagtaaatgcttggggaaaggggttgagccaggaaggaagaacaggtgttgtacatcgaaccaagcctaaatatttggtatggaacagttgaagatttaagattgtaactccagaacttctgatcactttttttgtattgttaagggtagcaactgagattagataactcacttgctgaaggaagcacattcttggctctgtgcgacattcactgtgccatgagctgctagtgcttactgatacccatgtgctctttggcatttcccagtctcccttgcacttgagctgaccatgtgactatttctgaccaatggactgagagtagaagtaatgtggtcacttctgagggaggtagttaagtatcaagtgtgactcccctcaactcttcgactccttcctgcacccctgcagctggaagaggaggcttggagatggtagaaacataagatggaaggggtctagatggctggatgactgcttgaggagagttattcaagactgctacttagctgatgtcagactctgagtaagtaagaaacttttgtaagatacataaaagtttaactgtaggaagaaaagtcatttttatccatgaaaataaaagatgcctaagatgtatgttttcaaattatattgggatttatatatttcactttatataaactcaaaatcatcaacatatgcctttgttcacttgcttctctgaacttagaaagtctgtaaataaatgtaatgtcaaaagctgaaaacacccaaagctactgtgatttgtggattgttacaacagttaacgagaaatatacatacactaaatgtgttctcctcattttcttgtgtgtactgctccaatctttttcagatgtaactgcttccccaggttaaggggagagtaactctgctccctgttctgggataaaatcctctttggtctcttggccattccctttgccagtgactggtttaggagtagagatgggactcaatagttacactttctgggggcctctgaaaaagattttcttgttcttacagaaaagtcacagattgaaattgctcatttctgaatagaaatggagatttggagggagaggtaatgcggcaaaaaactctaaagtggttgcttaataaagtgaggtaattttcattgtctagtcaaaatgccaacataccaaatatggttgattggggccctgaaactgaggacgagaagcaaggggaaagagaaggtcccaagaacactgtggtaagcagggattgacagagaaatatctccctaaggagggcaatggcccctgacctattagaataataatacctgccccctaattttaaattgtttcatgtgtcataatgtccttttgttattgcagatccttgtgcatacaactgacttgtgtgggtgaggcttgcagaaaaaatcagctagaacagccttgggggtagtggcaaggtggccagagcaattgactgggagctgggaacaggaatgaagaggaagagctgataagaaacatgcccagagcaggtaagcacctctatccctccaatcttcaaaagcatgccgggcgggcggatcacacattaagttggaatgtaaacagaagtaaaggagtatgaagaacactatagcaaggaggaaaaaaagccacacattttgtgccagacagacttagtttgaaatcctatttatagattttgtttcattaggcaatttatttcattctctgagcttcaggggaatcttagtcattgcagttctattacttaacaaagtctttaacagttttccacttactatgtaacatatatatttataacatcttgtctaggatgcagaagagctgtatcttgtatttcctttgctacattcagatgttctcataggttgcttcatgtgtaaaatgaggacaatgccattgttatactctgaaccaagttattggaggaagcagtgtgacaagcacctcgtaaaccctgttaaatgtgcagataagctattaatagaaattattgcaccaatttgatctgaagactcttccagctttgcatgatagatgcattgtcatgtcttatgttttgtaaacagccacacttcaccactatttagataaaatgtgactaagtcaaccttagtttccagacaaccctggatagtttttactttatcttgtatttggactggcgttgggacctctttagctgagaattcccctcccctctgtgagccattagctgagaagcaccattgtcagaaattctgaggatgacctgtcacccccacagccttgccctttctgacttttcagccacccgcccaccatccccatctggttgaggccttggtcagtgtgggagaacaggaggaatctacttagctgagtcatgacccaggtctagcttatggtataaaaccaattaaagcccctttatctgtggcctgatccatcacatgggggtattgagggaggtgaaattccagcctcatttctcttggcagcttctgtgaaggggtagggttcccggtggtcatggaaaaataaagcacacagaaaagggggctgattgctttcacttcattcctgctgcctcccccagaaatgttctctggccaaaccaaatcccagggctcccagaagacccaatgtacccaaagccaagagcaactcctacctcgctgccgctacttactgtccccaaagggcctatctagaggatctggtcaggaagcttaaaaatagttgagtgtgtggtgacaagccttgtggatttcctttgtaaaaatattccaagcagggaaataaacctttcagcaacttatttttccattgctctgtggagcagctcccactctctgctgctataagtacttcaggtagcttgtgggtggtagtggtggtagggatgccagaggggaagtggaggggagatgtgtcttgctcagagaaccaggtttagggggccagcaactattaggatctagaggcaacataacatttctgcacattctgtatacagaaggaaatgtaattccaagctgctgagtttggcacatgaggcctttccagatctagctgtgtccactgccccagcatcataaagtgtcagtatcagcagttgccccatcacattatgatgcttgattcctatatggcttcccatcctctgttccttccactgggaacctggaccctcaccatcatccccagtcatcatccaacctgccagtcattaaaatccagcccagaagtctgccttctcagtgaagtcttctctggcctaagagttaatcactgttttctgaacaacaattctgtcatcattgcatttatcatatggtggggtgttccctcatggggtttgttttctatgcatcttcatgtttttgcagctgcgtacaggatctggcaatgatcactactgccgaacaggttaatcgagcaatttgaagatggcagtatttctgccaaagaagacaaaaagacagaacgaccagtttacaggcagcttagataaatgcaggtttccatgaggttaaaattttgtggaatgctcatgtccacttcacatttctgtcagtaaattactgtgttagaagttgtcccaaataacactgcgaagaactttgagaacttttgagttaacaaagaaccttatcatctttttcgttttcagcactcccttgagttaagatgttatgaccccatttttacaaatgtgaaaacaatttccacagaggaggtagaagaggagagatagagctgagactcaactctgattgcctgtatccagttttttctttccacaaatgaccaaaaagtaccaaaaaacaaagaaactatgagaaaaatgctttctaatagttgtttactattatgattataactactagaaaatataaagcccacataagattttatgtctccaaattcaagaaaatcaccaaagggcaaggcatagagtagcagacaataggctgcatcctcacctggatcccggaagggcttggccatcctcattgatgctatggcagcactgatacctgccaactactctcaagggacaggacagcatggtggttcagagatcaggctctggagccagattgtccaggcttcaatctcagcaccccacctatttctatggggtctggtacatgttaatctctctataccacagtttctccatctttaaactggtggtagtaattagacctgactcacagaattttgtaagttaatagtatgtaaaagattaaatggcccagatacagtggctcatgcctgtaacctcaacactttgggaggctaaggcaggaggactgcttgagtccaggagttcgagacctgcttgggcaacatggcgaaactctgtttctacaaaaaaagaaaaaaaattaaaaattatccaagtgtggtggcatgtgcctgtagttccagctccttgggaggctgaggtaggaggatcactttagcccaggaggttgaggctgcagtgagccatgatggagatattgcattgtagcttgagtgacagagaacctgtctcaaaaaaaaaaaaaaaaaattaaaagatcaatcagtgttatctactatgtgccagttatttaccatgacaccatcagattctttatctttcattctcataagaactaatttaggtattattatctctattttatctatgaaatacctggggctacaaggttagatatttttcccagtgggagttctgggttttggatcacaattattgtgaatttaaaattctatatacgtcatctcttacaataacaaaatactcaattaattttcttttcatggatcctggaaacagccctcctttgggaccttactgaaggcttagatacatggcttagacaatctgtggaggtccaagcggcaagcttgataaactgggatttcctgagctcttgtcagcttctcaagtcagagttaatgctgaaagttctacatggggcatgggtgtagcttagataaatacccagaggcttgggaggtagagtgaaaatattttgagctggcaagtctgttcaattaatatgtacttgggagacattttcaaagctgacagatcttttgtaagtgccaagtgatattaattattagtataaaagcagatcccaccagtggagtcagagacacccaaatttatgtgtgttcgggtgtatcatcgggttgtgaggttgaggatgccaacgcttctagctgtgagggcaaaatttagcaaatgagtgtaccctaggaatgaggcaagaagagtctgaacctcttctttgtgtagtgcagaaatctggtcttgtaggaaagagttgctctcagtcttgccagagtcctgctcagaaggtaaaagtctagtgggctgcccaaagggaaggtgtgcaatatatagccttatagcctgggttgaatcaggcaaaacaagagaaatatggctaatgttttaccagaggataaagcagggccataaatgagagaaaaatgaaccctgagctcagaggtggaaacaatatacaacctgtcaggaagtcaagtccagtgtaggtctggaaagtgcttcagaagggagtaatgaatagtgtgaggtcctggcagctctgagagtgcaggctgcctgccgcttggtggaggatgacctggtctcttacagccttttcagagagtcaggtagttcccctccgtgaacctaacagcttctgtgtcttctccaggtgaatttcactttacatcttcaggcatgtttctgattttttgcgggggacagaggggaggagggaaagaagaatttattcttggaggtagatgatccattcttggatccatactctttgtggtagatgatccattcatgagctctctatgactgtgggtgaggtatttcttttcttttgtaatcagttcctgatccgaaaaattaggaatgggctcagaatgttccctgttttcttccattgccaactttccataatgtacagaactggcaattcctttcttttgctaattctgcaaaacctaagggtctttctgagatgtcccgtgggctagttgagtaaatctgggaatacctagtaactagggctgtgttaaaaaggacatttttggttttatctgttttagggttcattaaagtttaataagctatccttgggggaaaataatgcatacatatacaattatttatatatgtggtttatcccttttgtggaatacggttttgtgtgggcttaattatttaaaagaaatttatggcaggttataaagccaatttttgcaatgtaaacaactcccactcattgttttgaaattattgaattttattaacaataattataccttgtatctatgaagcacattcgattttattaaatctagttgtttgtgtaataacgggttcagaaaacacctgtgaactaggcttttttcttttgaaattgctttattgttttctttcagtcataaaatgaatacataacagcagggtgctatattaaatatttacttattttcttctagtgaagagagagccagacactacactaccatggtcattcttgggagaatgattcacttttgaggcaagaatgtggctctctttcccaaaacggatgtagaggtctatcaccagaggcaattggttctccttgttagggaaataagcttcacaattcttatgcctctgttgtagtgaaccacattctctcaaagagttcagggaagaagagaaaagtattcagggtggaggagaagattcattactggcaggaggtgattgagccactgcctctggcacagcactccttggtgggcttgccttttggctctggatggagctgagcaagctaagcttgtaggtctctggcctgaaaacctaggaacattgcagccacaagcttggcattgagggagtggaagccctatcctctgagaaagcacatggatggcccatgcaaggaacctgaatcagcagtagccaagtgacatttgcataactctttgtcatggataagcaaactttgtggaaagatgcagattaaataaacattttgggctttgtgggccacataatctctattgtaactacacagctttgccactgccatgtacattgagcaacagcatggatgttactatgtttcaaacaaaaactctgtttacaaaaagttagcgggctgcattcagtctgtgggccatggtttgctgacacctggcttgggatattcccagaagtagagttgccatgtcaaagtgtacactcttttctagatttttctagatgttttcaagtcaccctccagaagggtaactgaattgaatccttaccatctgcatgaacgtacttgtttctctctatcatcctcaatactaggtattttcatttttttaaaaaaggcttggccaggaggctcatgcctataattctagcactttgggaggccaaggcaggcaggtcacttgaggtcaggagtttgagaccagcctggccaacatggtgaaaccctgtctctactaaaaatacaaaaattagctggaaattgcttgaacctgggaagtggaggttgcagtgagtggagatcgtgccattgcactccagcctgggcgacagagtgagactccgtctcaaaaaaaaaaaaaaacaaaaaaaaaacaaaaaaaaaaacaggaaagcatctgtactttaattttgcatatggaaaatggaaaacattaaccaaagtgttaattttctttttctcactgaagtccacaaagcaagaaattgacaaatttggggttactacatggaacttgtaaaatcaaatcatattaatatatttggtgtggagagtctctgcaacaggaggatggtgtgtgtgggggagagtacctacagtggagggagaggttggagagtgtgtcacaaggattgtggtggaaaagatcgtttggctgcttcatgattgaatgggcatgcggctgatcaaggtaatcccagcagatgagctgcttgggatccttcattaccaatggcccacctaaggtgaatcttctaggatgttatatgacctatgtaggataacccttgcaagagaaatatgttggcttaaatttatgtgtcccttccctctactgtatatcttcccaataggacccaggcatcagaaaaaagaaaactcattggagattttaggctgaactctttggactcttcaaggatgggagaactgttgactcacttgtcaagattctcttttgttttctgattttttctatgaccagccatacactagccaaagaggtgaactaatagagtactctctttggagacacacatctgatttgaatcctagctcaaccctatagtggctgtgtagactcagacctagtctctctaagcccatttgttttaatgtaaaataggcacaataacgtctccctcttaaggtgtttgtaagaattcaatcatcacatgtctggagagtgtctaggcaaatgggaggtattatgtgtccaactccaggacattgctcataaacctgtgatttagctcatagagcactgggcacctaaggagatcaaaagatctggattgcactgactacatcaggtggccaaggattggttggattagtggggcctctcaaatcacatttcacagggaacaatcctatggagagtgattaggaattaggttcaccaatctattttgagaggatttggtttggtccagccaatattttgaagtactcacaatgccaggttctttgcttcgttcttgaaatatagatatgaaccaggaattaattctggtgccaaggaacttcacactgtagagatggatatgagcaattaccaaaaaatattctaaatattatctgataaagtttttaatggaggaaatcataggatgttaccaaggcaaagaggaaaaaatccctaacttagatcattgggattagggatggtttctcctaggggacaaaagagcttaagtcttcttgatgaaggtgtggtatatatttgaatgtgaaggcattaaattgaatgatgcatataagagaatagaataagtattgtgttgtaggagacataagatgaaacttgggggatagcaagagatgtcagttatgaaaggctgatcaaagtcttcattctttgaaagccattgaaacgttttatacaacagagtgacaagatcagattcatgtttcacaaatatctttttggtttcagggtggaggatgaatagaatggtgaaaccagaggcagagatactagttaggaagctagttcagtaattcacatgagagatggtggtggctgaattagggaagtggcagtgcagaaggggaaagggatctatgcaatcaatattaattggtaaatttggcaagattgggcatgggttgcatatggaaaatgaaagagagtgagaataattcccaagagtctgatttgagcattgggtggttggggcgggaagtgagggtgggggcattccttgatacctgaacaatggagggggtagagatgatgagtttagaaagcagaagagagacttcaaccaggaacttctgggcttggaatcaggttccatggcttctgacaaactgtgctgactatgggcaaatcactctccctctttagctttagtttctcattttatcatgcaagtaaatattagactgaagagagactcccaaacatgtatctgtggtcacacaactgtagactctgatttactaagtctggtgtgcagtccaagaatcagtattttcaaaagtttcccaggtgatgctgttgtccaacaggtttcaagccctttggagcaggagatccttgaggattcttacagctcaagcatctcttaatgcagtttcctcctagctcttgctccttcctgctgactctgcagatatgagctggcatctaatatccagtgtggccttcacagacactaccatgcatgccagtatccacagtgtgtctcactttctctgtccctgcaccccttcctccactcatcacacggattgggcaggcagaaaaagccaagagtattacccttcacataattggcaccaaggcaactccctgccatgtttttccttcccaaagacatatggttgatttcccaccaggatattgtataataaaccacttctgtagctcattgggatggagggttagtgattttgttccaagtgtggtggtaaatgcattttttaaaaggccttccctaaacttaaagttttagtagacagaacacatccaagaattgagcatttatcttccacatgtgccgggaggacatgttacttatcttctctcttggtacttccactgatcccacttcctgctatggatgagctcagcagacatggcatgtagacacatggggaaaagtcatcaacacatctgaaaaattagtaatggcttggccatcaacagagaggcttaggtgttacttcttacaacctacaaacagcattaattacactgaaatctccaggctggaccaagaagaggatccccttacaccacacataagtgcatttgcctggagtgaaacagcacaggtcttcctctcactgcaaggctgtgatcaattcttggctcccaaacccaaaagggatgtggaaatctggtgggaactgtaaaggcctggaatataagacttatgtgcacagatgaaaggcagcaggcttgttcagctgggaggaactgtaggatggcttaattataacctcctggtctatagcgagttcttagatcactgatgaggtaaacccgctgctggatcccaagctgggagctacagcaaggactcaaacctatttatcttttatttttctatggtgtttgggatgcagctctgaataaagtggtggctgaggaaactgattcagcaactgcatttccagatccttttacagcagaaagagcttaactttggggtaattcaaacctgagtttgaattccaattacacaaattacaaactgtaactttggatatttcaactgcgtacattgtaattttcttaactataaaataaggttaaaatattgaccacatagggctattttggggaatgagagagagagagagagtaggagtagtctcttatctagtacagagcctggtaagttctttaagtattttcagagtgaaggattagataaagctatggagaacgtttagacagactatggtagacaagctagtagggtgatttgacgtctcaatttgccttggatggtgctagcttaaaaattcagcaggcatgcaaaagggtctcagattgaagggacaaagtgatttccctgtagcctctgaataacttaagctctgtggtttgcaggaacttagtgatgtggtcatgcatagtgtgcgtgtgtgtgtgtgcgtgcgcatgtgtgcatgtatgtaatatcttatgtctactactctgatgtcttttgagcttcttggaaacttggataatatctaatttatctcttcatttctctttatccctaaatcagcaaatgtgtgaggagaaccaatggtaattatatgccttgtataatatgagaacagatggaaaaataaacaaacaccaaatctcacttcctcctgttgcttaccttttagtggcagtgtcagatttttctcctggactccttctcctaactataatttaaaaaatgtatttcatcatgcaacttatttattttaaaaatctaaagtattacagataacatggaagctcttatccctaatatcattcccccttctctaaaggcaatcaccaatatgaattttattgtgtatcattgcagcccccattttctatgtttattatgagatatatccactaataatacatatggttgctatttcttacctatttacagaactatttcatactacagtttttaacaacttgtttcccctttgttactcaagattgcatttttgatatccattcatgtctttacacatagatctaattaattcattttgatttttgttattgtaaattccatgaatatattacaatttatttactcattctttctccactgaaggacataaagattgtttccaatttttcttcattgtaaacagacactgctataatgaacattctggtttatgtgcaggcatttctctgaagtagaatgagaagtcattgggcatgcacattttaacaatttcacgatctacagtcaaattgctctccaaagtgattgtactaatttagactcccaccagcagggtaggaaagttcagttttctcatgtctttaccaacagttgctattgacagactctttaatgcttgtcaaactatttggtgtaaaatgcttcactgttgttttaatttgcatttcctttatttctagtgaggataataatctattcatatgttcactggctcttctgaattgcctgttcccatcaattgccaacttctgtgttatattgttggttcgtttaaactgatacataatttctctacctattcaagataatctgtgtttgttttacacgtgtgtttgttttacacgttacagacatattttctaagcctgccatttttttaagtatgtttcatggtgtgcttcgtaatggggaaaatcttaattttgatgcacttggttttatcaatgctttcctataaattgctagtgtttgagagttttctaagaaatttgatttttatctcttagtcaaaaattgttatcctacattctcttctaattaaaaaatcccatttgcagttttatttagttatttttgtctataaagtgagttccgaatgggaaaccaggtcatttactgcacttttttccttcccactgatttataatgccacctctgtcatacaccaggctcatatgtgtttcagcttatttaagggcttcaaattttatttcattaacttgactttttctctgctccaatatcattcttttaattttatgactttaaactgttttcatggataggtagtcaagttctagctcattttttcccctcccctcagaattatctttgctgatctttgttgtttgcatattcaaatggagtttagaataagtgcgtagagttctgagagagaaatcttgttgagattttatctgaaacctcattaattaaatatattgatgatttggatcaagttaatagctttgtgattttaaatatctccactcatggaaatggcacaactctccatatattttgtttcccttatgctgcttatttcataattttgtatacaaatttttgcatatatgtatttttaaatttattcataaacacctttttttgcttttatgcctgtacttatattgcattattactgatatgtatatattcttccacccttgtgagatcttagagtgactttgctagtttagtcagtttttcttagatttattatattgaggaccttatatatgatctctaaatatatactgataagcttaaattcttaagtatcatttatttttcttgccttattacgtaattagggcatccagttgactagtaaaagtaattataaagactctactattttcttttcttgactttaatagaaatgcttttaaagcttcatcattcattattatatctatagtagtttttcgctagatgtttatttttaaagaaagtttcttgttactgatagattgctaagaattttgtcatggattcattttgaattttattccttaattttatgtatctattgataaatctattttttcttttagtttgctcatatattgaattagcctactttgatagattttttttcctagttaaccatacctgcctcttttttgatgaattttaataggccattatatttgtttgttagttttagtgaagggttaggtttattatgcttggattttacttaagatgtttaatgaattttaataggccattatatttgtttgtttgttttagtgaagggttaagtttattatgcttggattttacttaagatgtttaaaattaagatttttttgccatctgtaactttattttattgtacattttttggagtggggatcttatgttaatatctcttctgaccattctattaggttggtgcaaaagtaattgcagtttttaccaatttcaatctaataatctattagtctataataatttcaatctatagtctattagatgactactattatctactagattattccacctactatttttattgtacatgctagagcttaagaaaatttttcatcttagactatgctctaattatatcacctgtgtgcatttttcccattgtaaaacaaattgtttttctttttgatatatattggctggtgccaattgttctctcagagaagtaaatgggatctttaaggaaaaaaatatctaggtttcccacatttaacttactaatcttagcaatggctaatagggaaattcccagatgaatcaaggaaatatctcaccttccacaacaataatttattaattataattaatcagattggtagctaactgtgtgttgggcactgggctaagtactttatttatatacatgatgttatgtatttgcaaaaatcatatggtataagcagtgctagtctcagtttagagataataaaatttggattaatggggtttaagttacttgctcaagtgtgcataggtggtaaagtggtgatttttatccattcctttctgactccaaatcacatacccttgaccactttgctacattgtgtctacaccaatgtttggagaacctaaagccacctgtgttaactccattccagcacttaagggagtttaactcaacaatgtctcctggttagtatatcccttatatctcagttctctctgcttaacatatacagatttcttttcaagaaatgcaaattatatttctcttgttctgtcttatttatgttttattttttcttcttacactgcgtccaagaaacacctcctcatgctttggtgtcttctttcttctttttcctcttgtctgtgtttagtttcctcgttttctagttagtcctataattcttactgatccttctttacttttacattagaaaaaaggagggtttaaaaagcgttttttaaatgaaagaaaataaattgtccttcattggactattgttcctccaagctaggaagttgatgcttgattctctgataccccgggggcctgggtggtgttttaagctgggagaagatgggcactctcctgaactgccttagatgcttccttatcctgggcctctctgacaggcaacatgcctcaactttgtcaacaagttgtggtttgtttcactggccaagcataagacagagcatgaaggccgagctgcgtgcctggtgctgcatgtttcctgtttctgtaagctatttgttgtcaactctcttttttcctttatgatatttaattgaaatcacagcttaatgaggcctgaccagtatttttcctttggtcacagatttgatgctactgccaatgtacctgaataagaagacaactctttctggaaaaagggaaaacttgaagggctattgaaggccgctagaaaggtattgtttacatgatgcattttccccttatcttcaacaggtaaaattgttactaaactgatgtttcctttaacaatgataatttttatttggtagtcttgggatgtccctgggagctcaagttcagacaatgaatctagatttttgccagttgaagttcaggttttgtgacctcacctaaaatttgctcctggggcttggaaagtttaaaattgtgcttttttattttccccttcttttttttagcacagttcagatgccatgtccctaggaatttttccttaattcccaaattgcaataatatatccatcatctgcacatctacattacttgtatttaaactgtttcatggcattaaccatgttttaccctgatgcaatgagatacaatgcagttagatgagagaatatgagtactggagctggacaggaatggatgtgaagcccgtggcagttatttactgggtgatcttaacatctcaatattttcttcttcataaaatgataatattaaaaataatagactgttaatatgacctaccttatcttgttgttgggataatttaaggaaattacacattgtattagtctgttctcatactgctgatgaagacataccaaagactgggtaatttataaaggaaagaggtttaattgactcacagttccacatggctagggaggcctcacaatcacggtggaaggcaaaggagaagcaaggacatttcttacatggtgacaggcaagacagcttgtgcaggggaacaaactctgatttataaaactatcagatcttgtgagacttattcactaccacgagaacagtatgggggaaaccacccccatgattccattatcttcacctggacccacccttgacatgtggggattattgcaattcaaggtgagatttgggtggggacacagccaaaccgtatcacacatgtaataaccttggtgcacaggagaagcaatagatgactatgattttaccatcctttgagttaatacccactatcactggtgcctgtaaagggctgcacttgtagaaagtatgactctgtctttccataacactaaacatgaaacctaagagcttttcatcacggggatttgtctcatcatctggcatgctttctttgacacctagccaacccagtaggctttatctgagttaacctcataaagtatcatattgtttcacacaggggtttattcctgaaagttacttaatggtagtttttaagaaaattaaatcttattttataggcacctgggaaaatcattattaaagtgagtcatatggctaatcgttttgcgtaaaggatccctttggaaagtgaataatctcttgttagttaccatgcgtatgttcagataccagcgcttcttagagaggtgcttaatccatgtatataaagtactctatacaatcttatacttctgctaagaacatttgccatggaatccagggatagatatacacgaatgatgttgtgttactttgtaaaatttgtctctgcatttttaataaattggtacgtaaatggattggtatgtatttggattctctacaacacaaacttctaagatttttagttttaggaatcctccaaaagccaaggaaaaactagaaggaaaatgatatttattgagcatctttttgctaagcattatgtgaatcatcttcactaacatattatagttattcctcatcataatgctatgaaaagtattgcttaccttttattggagagaaaaaaaatgaggctcagataagtaaattacactatgccaggtaattcagctagaaaatagcaaagtacaggatttgaaatcagatcttctggatgccaaatcccttacttattccagtaaagtactctttcttgagaacaatatactgaatttcaacgggaaataaaatttaagatgtgggtggtatttatcttactattcgggtacttaaaaaatatcgtacattatcttcgggccttattttttaacctgcctatggaacgtggctctaaacctttgcactgaggctagcttcagtgaaattttgaaggagttaatgccttcctctttttgatacaagattaaacatggattgcaactagaaaccacaaagctgagtgtttattaaatatactaattttcctttcatccagttggccaatgttttcaaccataatctacttttctctaaatttttccatggagcaggatgatgattccaaatcctaaaattctgaaaaaaaaaaaatcacttaatgaccactggtgaactcctgtaaactcatcccagaatcagtaatgagtatttggaaaagattcatgggtaagctccaattctcaccaaaatggccctttgagtagcaatcaaggattctctgagggaactgggaagttccagatggcttttaagggaggctatttggtttagtttaatagaacttggtgctattaaggccaatggttggagtcctttgtcctattctagtatatatatacatatacatacgtacatacatatatactccttactctattaatgtatttagaaagtaaatagtataggttataaataggcagaaaaaaaaacagtgggaatggcttagtgtgaaccattaactctatatattcattcaacatgaatttgctaaaagcccattaggtactagtctctggagacacatggtcaacttgaacaagaattggctttgaggaaataatggactaagggggatatataaacagataattgtgatgtgtgttttttgtttttttttttttaattatactttaagttttagggtacatgtgcacatcgtgcaggttagttacatatgtatacatgtgccatgctggtgcactgcacccactaactcatcatctagcattaggtatatctcccgatgctatccctcccccttccccccaccccacaacagtccccagagtgtgatattccccttcctgtgtccatgtgacctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccattctatcattgttggacatttgggttggttccaagtctttgctattgtgaataatgccgcaataaacacacttgtgcatgtgtctttatagcagcatgatttataggcctttgggtatatacccagtaatgggatggctgggtcaaatggtatttctagttctagatccctgaggaatcgccacactgacttccacaatggttgaattagtttacagtcccaccaacagtgtaaaagtgttcctatttctctctccacatcctctccagcacctgttgtttcctgactttttaatgattgccattctaactggtgtgagatggtatctcattgtggttttgatttgcatttctctgatggccagtgatgatgagcattttttcatgtgtgtgttttttggctgcataaatgtcttcttttgagaagtgtgtgttcatgtccttcgcccactttttgatggggttgtttttttcttgtaaatttgtttgaattcattgtagattctggatattagccctttgtcagatgagtaggttgcgaaaattttctcccattttgtaggttgcctgttcactctgatggtagtttcttttgctgtggagaagctctttagtttaattagatcccatttgtcaattttgtcttttgtttccattgcttttggtgttttaaacatgaagtccttgcccatgcctatgtcctgaatggtaatgcctaggttttcttctacagtttttatggttttaggtctaacatttaagtctttaatccatcttgaattgattttttgtataaggtgtaaggaagggatccagtttcagctttctccatatggctagccagttttcccagcaccatttattaaatagggaatcctttccccattgcttgtttttctcaggtttgtcaaagatcagatagttgtagatatgtggcgttatttctgagggctctgttctgttccattgatttatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattcagtgaagaaagtcattggtagcttgatggggatggcattgaatctgtaaattatcttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattccctttgaggcaattgtgaatgggagttcactcatgatttggctgtttgtctgttgttggtgtataagaatgcttgtgatttttgtacattgattttgtatgctgagactttgctgaagttacttatcagcttaaggagattttgggctgagacaatggggttttctagatatacaatcatgtcgtctgcaaacagggcttatgatgcgtatcatagtcttacagatttatatctacctttactaaaagaagaagaatgttgattaggaagtggcgtttattaagtttattaagtttagtagtaatgagaattattataatggtggttgcaattaccataattcattgatcttttaatgctaatcccagcactatggcctgtacgtgaattattctattcaatctaacaaacttgtgatattggtgatgatgattatgattatagtaacagaaataatggggaatataaggcacatgtattaaacgttattttcaagttactgtattgggtctttcaaggtattattttattaaatcatgccagcaactctctgcagttggtattattatcaccatgttgaagaacagtctgatgccaagagagtgtccacaaattttccaagaatgtacaatgattaggtttatgatttaaaatctgggctagatgaccccacagttcatacccctaagtacaggtctaccttgtttcattgtgcttcacttcacatatactgtattttttaaaaatattgaaggtttatggcaaccatgcattgagcaagtctataggtaccatttctccaacagcatgtgctcactctgtgtttctgtttcacattttggtaattctcacaatattccaaacattttttgttatcattatatccattttgatggttcatgatagtgagtttttgtttgtttgttttttgtttttttagagagagttggtgtctcagcctacggagtagctgggattacatgcatgcgccaccacacctgcctgatttttgtatttttagtagagatgaagttttgccatgttggccagactggtcttgaactcctggcctcaagtgatccgcccactttggcttcccaaagtgctgagattacaggcaagaaccaccacacccggcctgattagtaatttttgatgtcaatattgtaattgttttggggggccatgaatcaagctcatataagactgtaaacttaataaatattgcggtcagctccaatgactggccattttgcctctctcttttttggcctgcctattttctaggatacaacaataatgaaattaggccaattgataaccttacagtggcctgaaagtgcccaggtgaaaggaatagttgtacatctcacttcaaatcaaaagcaagaaatgattaaactcagtgaggaaggcatgttgaaagtcaagataggccaagagctaggcctcttgtgccaaagaatttggcaagttgtgaatgccaaggaaaagttcttgaagcaaattaaaagtactattccaatgaacacactaatgataagaaagcaaaacagccttattgctggtatgaagacagttttagtgctccacatagaaaatcaaatcagccacaatatttgcttaagctaaaacctaaccctgagcaacaccttacctctctttaattctaggaaggctgagagaggtggcaaagctgcagaagaaaagtttgaagctagcagagattggttcatgaggtttaaagaaagaagccatctttatatcacaaaagttcaaggtaaagcagaaaatattgatatagaagctgcaacaagttatccagaagatctagctaagataattgatgaaggtggctataataaacaatagatttagagtgtagacaaaacagctttatattggaagaagatgccatctaggactttcatagctacagagaagttaatgcctggcttcaaagcctcaaagaatatgctgactcttgttatgggctaatgcagctgttgactttaagttaaagccaatgttcatataccattcctaaaaatcctaagatttatgctaaatgactctgcctgtgctctataaatggaagaacaaagcctggatgactgcacgtctgtttacataatgcttcactgaagattttaagcccactgttgagacccactgctcagaaacaaagatttctttcacagtattactgcttatagaccattcacctggtcacccaagagttctgataatatacaagaagattaaccttacttttatgccctacgaacacaatattcattctgcagctcatggttcaagaagtaattttgactttcacatttcattactgaaaaaaatacattttgtaaggctgtaactgccatagaaagtgattcttctgatgaatctgagcaaagtaaataaaaaacctggaaagaattcaccattctagatgtcactaggagcatttgtgattcatgggaggatatcaaaatgacaacattagcagaactttggaagaagttgattccaactctcacatataaataactttgttcaagacgtcagtggtggaagtaactgcagaggtggcttaaataggaagaacactagaattagaagtggattctgaaggcatggctgaattgctgctgtctcatgataaaacttgaatgaaaaggagttgcttttatggatgagcaaagagtggttgcttgagagggaatctactctttgtgaggatgctgtgaacattgctgaaatggcaacaaatgatttaaaatattgcataaatttagttcatcaaacagcatcaggtttgaaagaattgtctccaattttgaaggaagttatactgtgagcaatatgctatcaaacagcatcacatgccaaagagaaatattttgtgaaaggaagagtcaatcaacatagcaaacttcattgttatcttaagtaatttccatagccaccaaaccttcagcaaccaccaccctcaccagtcagcagccatcaatactggggcagaatctccactggcaaaaagattaggacttgctgaaggcttagatgaccattagcatttttaaacaagaaagcatttttttagttaagctatgtgcatttttagatttgaaagacatttctcaaaagaagacatacaagtggcaagcaggcatatgaaaagatgctacacatcatccatcatcagataaatgcaaatcaaaactacaaggagatatcatctcacaccagttagaatggcttatatccaaaacacaggcaataacaaatgctgatgaggaagtggagaaaagaggacagtcaatgggaatgtaaattagcacaactatggagtacagtttagaggtttcacaaaaaactaaaaatgagctaccatatgatccagcaatcccactgatgagtatatattgaaaagaaggtatatcagtatattgaagagatatctgcactcttatgtttgttgcagcactgtttacagcaactaagatttggaagcaacctaagtgttcaacagatgaatggttaaagaaaatgcggtacatacagacaatggagtactactcagccataaaaaaaatgatatccagtcatttgcagcaacgtggatggaactggagaccattatgttaagtgaaataaaccaggcacagaaagacaaacatcgcatgttctcccttatttgtgggatccaaacaacaaaacaattgaactcatgctcatagagaggagaaggatggttaccagaggctgggaaaggtagtgggaaggtggaaagggaggtggggatcggtaatgtataaaaaaatactggaaagagtgaataagacctactatttgatagtacaatggatgattatagtcaataataacctaattgtatattttcaaataacataaagagtgtaattggattgtttgtaactcaaaggataaatgcttgaggggacagatacaccattctccatgatgtgtttatttcacatttcatgactgtattaaaacattttatgtaccccataaatatatatacctactacatacccacaaaaattaaacattaaaaaaagatatgtacatttttaagacacaatgctatgcacttaatagtccacagtatagtgtaaaagtaacttttatatttactgggagagcaaaaaaaattgtgtgacttgctttattggtatacttgctgtatttcagtggtgtgtaatcaaacccataatatctcagaggtttgcctgtacactaagccaagctgtcttctgagcagggtaaacactgaagggtgtcaggtagaaaaataaaaggaacacattctaagaaaaggaagttttttaaaaaatagttttgtaaaacagtatgttagagaggtcacttaatgagaatgtatagtgcatgaaggaaaacagtggtaaataaagcccaaaatataaattagtttcaaattataaaggaatgtgtatttgcattttatcctataagttgagaatcaaaggatagtcttccaagcaaggaagataaagattcacatctacattttttttttttgagacagagtctcgctctgtcgcccaggctggagtgcagtggcacgatctcggctcactgcaagctccgcctcccaggttcacgccattctcctgcctcagcctcccgagtagctgggaccacaggcgcacgccaccatgcctggctaatttttttgtatttttagtagagacggagtttcaccgtgttagccaggatggtctcaatctcctgacctcgtgatccacccacctcggcctcacatctacatttttaaagaaaacaccagatcaaacaaaaaataaaaatagttgacgtgagtgggtaacccaaagtatgctaaggttactcagaatttttgaaaatctggtttaagaattctcctgtatctgaatatcccaaatggttcataaatataagtaaatagcttctgtcacacagtattcttgaggttctttatctctctggtttggattggttcccatgttggttatgtattgagagataacatccagaggtgaaaacatactctactgagtagtgttgacataaaattaacgaaaattgttggagaaaatcagcttttggtgaatgtctgagcagaaaatctgggctttgagccctaggtaaacttactttcccacaccccacttccatagagtagacatattggaatagcctaaaatatctatctctaaaatggtacctttgaaacattctaaatttattatttcattctttcatcctcacccttaaaattttcattccaactctgcatcactggcttttaaaagttctccaatgccggccaggtgcggtggctcatgcctgtaatcccagcactctgggaggctaaagcgggttgatcacaaggtcaagagatcaagaccgtcctggccaacgtggtgaaaccctatctctactaaaaatacaaaaattagctgggcgtggtggtgcatgcctgtagtcccagctactcaggaggctgaggcaggagaatcgcttgaacctgggaggcagaggttgcagtgagatgagattccgccactgcactccagcctgggtgacagagtgagactctgtctcaaaaaaaaaaaaaaaaaaaaaaagttttccaatgcctcaagaaactcctaatggtattctcaacttataaagaaggaccaatctctagaactatagacttctgaaaaggaaaatgaaagaacaatctttcttccttctttcttctctcttttcctttttcttactcttctttctgtcctttcctttcttctctccctccttcccttcctttctggtatacttcctttctcccttccttcctcctttcttcttttattcatttttctttatttcctctctctttttgaacttttctactcatttcttttctacctttatgtagtgaaaatgcaaatttgctcacatcacaattcagacatgcaataaaaatgtagcctgcttatttcatcatcataatctcccctcctgttacttttcaaaaaagatttaaactaaacttaatctacaagtttgaaacttactttgatctaataatttaaaaaccttttgatttttttttaccctatgatatttacttttagattcctccattttctccagtctcttttctgatttaggtgcatgaggaaaaagctaatggctttggaaggaaattttctcctggcctcatagtgctttttggtagtgttctggctagtagccactgaagtacagttggtccgtcatgttttaggcactctactgggttttctgcttgctcctgaattactcctatgtccaattatcctctcctgactcagagtcacataaattcttcctgctgacccagccacccttagctctcactgggatgaatatctctctgaaattctctcatagtctccatttggactgaagcttctgctttgggagcatcttacctataccactggcataataacaggtctgttgactttcaattcagtgttcatgccacaaagaaaggaggggaattgggtactacataatctttcattctacagagcaaagacttggggatatatataagctacttcctctttcttactccttctctccttcttttactaacctttggcccaaaagaagcagattttgttttcctctctggtctagatgaaacatctccctaaatcattcatacttcatgaagtagcatctacgtaaatcatactgatacatcatgaagtagcaactaccttcccatttcctcctattgtctttatttagaatgtagtgctaggagaaataaaaatgtcttactatcaaggaacttaaatttagaagtagttagaaatatattatcacttctgtttctggctattagaaagtagtggtggctagaattattcccttatcataaatgctagaagactggacaaaagatagaaaacaaacatttttaatcattggctaatatgcagtaggactgtggttcctgtaaaaagggaaacaaatgaagtaagccctggaatcacgcaggctttctactgggaggcaatttctagaatgcttcatagggaagggcagctcaaggattaagagtaatcttgctgagtagctaagacagagattgcagtttatgaggccaaagtggttaaaatgtatatagttaagagagtacctgagaggagtgaacttaacaaagaacaagtaccagaaatctgcaaagggtttccttaaaattcttgactgatctaggcttagagtgaaaacttcaggcttatataaagaacttctggacaaagaagttactggggaatttcatgccagatgattcctgaacacatcattttagttcccaccagccatagtggaggggctttattgaatactggaggcattcactagagatcccagaattttcatatcttagaagttaggctaaattagctctgaagaaaatactactccagagtcaccctgaaaagcataaaaacaacttcaaagggaccaaacaaatctgcaaatagtctaacttcctgccacaagaaaaggtagcactcttcaaagaagtataaaaaatacactacttacaaatgtaacattctcaaaaaatactatatgtacaaagaagtagaaaatggggactcataactgggtgaatatcagccaatataaacagatccagagattaaaaagatgataaaattagcagacaaagacattaagtatacttttgtaaataagcttcataagttcaagtattgaaaataaagcataaatataatgaggagagaaatgaaatataagataaaaaagaaaagcaaatggaacttctagttgtaaaaacatatctgaaattaaatcccataggatgagaacaataatacttcagaaaaaatagtagtgaaaatgaagatataacaatagaaactatctaaaatgaagcagagaaagaaaaggagactgaaaaatatgaacagaactttattgaccttttggaaagcatcaaggagtttaaaattcatgtgactgaaatctaagaaagggatctgaagaggcaatggctgaaaaaattttaagtttgatgaaaaccatcaacccatcaatctaaaaagttcagtgagctcaaaagaagataaatataaagccacataaggaaatatcatgatcaaatttttaaaagcaaatattatagaaacagtgaaataaactaaacaacaacaacaacaaaaacttattattctatacccagataaactatctttcaaaattgagggtaaaataaaaccatctttagacaaaacaaaaagctgagaatatttgttactagcaaacctatgctataagtaatgtgacaggctggatacagtggttcgtgcctataatcccagtactttgggaggttgaggtgagaagatcacttgagcccaggagtttgagatcagactgggcaacatagtgagaccctgtttctaaaataaggaaagtaagaaagaatgaaaggaagaaaagaaagaaatgttataggaagttctttaggcctaaggaaaatgagccccaactactggtattcacatctttgtgtagtttcttcccacattgcatcatgtttggtctgtctaaccaaggaaatatggctgatgtgatggtatgtcacttccgagattaggttataaaagacaagtctttctatgcctctgtttctgcctgtctcttctcattaatcactctgcgagaagccaattgtgatgttataagaagactcaggcaacctacgaaaaggcccacattgtaagaaactgtggtttcagccaacaggcatgtgaatgagcttggaaatgaattctccagccacagatgacttcatccctaatgggctgatatggtttggctctgtgttctcacccaaatttcatcttgtagcttccataattcccacatgttgtagaagggacctgatgggagatgactgaatcatgagggtgggtcttttccatgctgttcttgtgatagtgaatgggtctcatgacatatgatggttttaaaaacaggagtttctctacacaagaactctttttgcctgctgccatccacataagatgtgactttctcctccttgcttcccaccataattgtgaggccttcccacccatgtggaactacaagtccaataaacctctttcttcagtaaattgtccagtctcgggtatgtctttatcagcagtgtgaaaacggactaataaatgggcagtatgactacaacctcttgagacaccctgaccagtacatccatctaagctctcttggatctctgactgaaaaaaaaaaacaaaactgtaagatagtaagtatttgttgctataagatgctatgttttgggggcatttgttatgcagctatagataactaacatactttcaaattaattctacaaggcaacattatccagaaataaaatacacccaatattcttataaaaaagattcaaaatatttaataaatactagcaaatcaaatagagcaatatataaaatgtattacagtatgactaagtgagttctaccccagaaatgtaatgtttatctattaatcaaaatgacacaacaaaatttactgtatttacagggtaaaaaacaaacaccaaaactaaaggattacctcaatagaggcagagtaagcatttgaataaactcaatatgtattaagatacaaacctctcagagccctagaagtagagggagcttttaacctgataaaaagcaagcaagcaagtgacaataacaacaaaaacttttgttaactcatatttaattgtgaaggactgactgcattttccatgaaatcagagagaaggcaaggttctttacttcttcactttttttttttgaaatggagtttcactgttgttgcccaagctacagtgcaatggcatgatcttggctcactgcaacccctgcctcccaggttcaagcgattctcctgcctcagcctcctgagtagctgggattataggtgtgcaccagcatgcccggtcaattttttgtatttttagtagaaacagggtttcaccatgttagccaggctggtctagaactcctgacctcaggtgatccgcccgccttggcctcccaaagtgctgggattacaggcatgagccaccgcatccagccctggttctttgctttcataatttctattcagcattatactggaagtcctatgcaatgaaataacacaagaattcaaacttataaaaaaataaaaattgcctttattttcaggcaagatttagaagaaaccataggagtaaatatttgctattgggaatagtgaaaaaaagttcttaaataagacacaaaaaagtataaaccatgaaagtaaatattagtaaatatacttcatggaatttaaacatttctgctcttcacaatatattcttacaaatttgaagggcaagctatggactatgagaaaatattttcaataggtacgtctaacaaaggacttgtatctagaatatatatataagaacatttacagcttaaaaataagaagataaactgctcaataaatattggcaaaaaattttagcagacactttacaaaagaagacacaaatgaccaataagcttatggaaacatgttaagcatcattagacatcatgaaaatacaaattaaaaccatagtgagatgccactgcacaaccattacaacggctatgattttaaaaaatgattttaagttttggtgagaagtgcaacaactggaaactcaaatgttgctaatgggaatgcacaatattttggaaaagtttggcaatttcttataatgttcaacaaatgcttacaatatgatccagaaattccactcctacgtggttaccctagagaaatgtaaacgtctgtccacacaaagatttttacttgaatggtcccagcagctttattcataataactgataacataatataagtgaaatgacctaaatattcattaattggtgaatggataagaaaagtgtggcatatttttttttttttgtaatttcatttttatttatttttattttttttttttaatttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtggtattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactgaaacaaatttacaagaagtgtggcatattaatacaatagaatattattctgcaaataaaaatgaaccaactactgatatgcacaacataatgaatgcattattctaagtgaaagaagccagagtcagaagactacacactatgattaaaattttgtgaaattttagaaaaggcaaaactatagtgacagaaacagataaatcactgccaagagcctgagggagtggagaaggaatttattgcagagacaagggtattttttgcagtgatagaaatgctctatattattactattgtagttgtggttacatacatttgtctaaactcattgaaatatgcactcaatcttggtaagttttattgcatgtaaacatacctcagtgaagctgacttttaaacgttatacacttgttgagtgatacaattttgaacgtcactgtacaactaatagaaaacaaagttatggcctaaaatgggccattttttcaaccaatatagatttatcacttattatgtgccaaaggctagtctagttattcaagacaaagtgatgaactagacagtgagtgaaataggtgagtaaacaggaaatttaaaaaataaagaaacagtgtaactgatatgataatggtaatcacaatgctatggattcagagagaagaggtacccaactcagccttggggccaggaaaggtagtattagagtggaaaacagatggaagaatatgtaaaagggatgggggtgtgggaaatgatacaaggagtgggtaatgtataccttgaacttggagtgagagagcagagggtggcctgtgagtaaacctgaagttagacatgagtaggcttattcaacgtacagttgagaaacggaatttggagaatttaataattgttacatgtgaaaactgaggcaaagaaggaggacaaggatgttattacttttctaaattgattaactgggaaaattatggcactattcattgaaattgaaatacatgagcaaagaaatgggcttagtgaaaggctgggggagaagaagggagacgttataaatattgaatataaagtacctttgagatatcccagcgcagtctgtaaaagaccattgaaataaagcctggagcacagaaaactgacttgagatagagatacaggtttgggtaaatgaactcattgaaatcatcacaaaagagcatgagatcaaccggagagatggggaaacacgaaacaggaaggcccaagatggtcgaagtttgtgaccgtcaaacatcatggtgtagccataaaataagtacttagtaaaaagtattgttattaccattacaattctggctgtaggtgacgttaaagccccaaaacaaagcatcatgctacctctacatgctaatgggatgtagccactagagaagggatataagtggagtgacattcttctgaacatcaaaaaggatgagatccagagtatgggatccagtttttggtaagataaaggacattcctttcggtctatcaggagcgtggaaggaagtaatgagtgaagatgcaaatacgtgtgtaacttttatgacacaaagttgagggagctttgactgatggcttttgtttttttctgtggagtcaaggtcatacggagactaagggagagaggtgggagtcataggtttgagagcaaagaagacagtttgaaatatgctgcctcagaaaaggggaaagtacttcccatagaaacataatagatccctgggcattattaaggacctagttaaggttgaggaccatgaattaagagcatttccaattgagagcgatttttttttttctttccacaattactcagcaacccaactgcaaggttgagaaaatagcaagttgagtttattcaggtttgaagttttacagatgactcataataagataattacaacttaagaaattaaagattttgaagacagtaattaatgtgattatcaataaaatcttagctagataatgagagaagtggaaacaggggagtcctgagaagtaaggagaaagtaaaggagtcggtaaactggaagttcctagaaggcctataaaatagtatattggggatcagtgaattgggataatgtggccaaagtgaagaaattgagaccataggggatgaagagggcaaggaatctgcaaagctaggttgttgaaaggatcacccaatgccgaaatcaccaataatagcaatgcctgtggtgggagaagatggaaaggcagaggccaatcttcagagaatttagaggattggccaggacataaagtcttttgatcaagtgctaaggagtaccccaaggtggaatcacaggcaaacactttcagtaagtgggaactgtatggaaggagtgaggaaatctaatccagaagtggtgatacaagccgggagaacacggactcccaaccttcagtgacatgggaggtgggaggaggaacatcctccccatgagtggtctattgtgtggcttgaataagtggggtttatggagagtttcctggctcaatgttgctgatatgcataggaggaatagagtctttttggtgattggagacccttcaggatggatgagggagcagacagcctggtggtgaaggtgatgagctctgctgcattctccaccaatgtcagtggccattctctcagtctgagcagtagtgaagtaattaaagctctagcatcagtcaggcctgggtggagcccaggttctgctcatcactcactgcatgtgggaccttctttgaattccaggttcttcaactgcaaaatgaggataatattatttacctcaggattgttttaaaactccaataaagtgttcaaaaaaaaagtttatggctgggcgcagtggctcacgcctgtaatcccagcactttgggaagccaagacgggtggatcacgaggtcaggagatcgagaccatcctggctaacacggtgcaaacccatctctactaacaatacaaaaaattagctgggcatagtggtgggctcctgtaatcccagctactcaggaggctgaggcaggagaatggcgtgaacccgggaggcggaggctgcagtgaaccaagatcgcaccactgtactccagcctgggcgactgaccaagactccatctcaaaaaaaaaaaaaaaaaaaaaaaaagtttatgataggtcagacagcattgtgtagttataaaatgtttattaaggggtattgttgttactactatttcaactctgagtacagatgattttggagcccaaaaataaagtattatgcttaatgagataaactttcacttaatctggatgatgaaggtaaaagtatactagtttgccaaatgaaaaagatgaaattctttagataatgagacctttatttctcaagatagatctttaaacaatgtaaaatgtcaaagaacctaatcatcagagttatttttctaccttcttcaataatgggtctggaaatacagaatgatttaacttttcctgtgttgacaagagcaaagtgtttggaaaggggagctgggggagagaactgtaaggccctgaactctttacaatgccccagccctggttatgcagtctgccgaattttgatgagagagctgtattcctgtaagagacatcatcgtccagatgtagatgcactgccgtgatgtccaaataggaaacaaagaccacttggaagtggatactttcctgaacttactgctctgatgaggggcccttcttttgaagcaaaatgagtcttcatgtagctgagaactctcttctcctatcactttacaaactctatcttcccccaaaggcctttccaaaggaagcagccaggctcagtggccatgatgttttcctgaaggtatgggagatagattatcaagttaaaaacacagttatttccctaaacctgacttaacctctgcatataactgcctggagcctattcaacgcagttgacaattgcctgccccggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactgttcatttttctgccaaatgattatatagaacttaatagtatgcattatgaatcagactgcttgggattgaatcacaggtctgccactatctatgtgaccttgagtaagttgtttaacctctctgcacctcagttcccatctgtgaaatggggatataataataacttcatggagttgttgtgaggattaaattaattcataaatacaaagtacttaaaacggtgcctggtgcagcttaagagctatagacaactttgctattatttatctagtgatcttagcatgccccattagaatggaaaggggtggagcttcataaatctttttgaagtgagatcttcaagacatggatgctgatagatgccagactatcatggatgcgagtctcagcatctgatgggataagaacatggtttatcatttttgatcctgaatttgaataggtaagagatgagtaatgagaaaaaagaagggaggaaaagaagtctgcaaaatagagactgagaccgggcaatataaagggtttgtaaagcatcttgatagtgagatgtctggaggagatttctaaacgggttctgttctgctctttgatagttgttttgttggtggctatagagatttttttttccccctgaagctcctctccccattattgtgtgaagttcactcttcttgcaaatgtgagtggagtttttagaaattcaaagcaatagttgaattttttctccagctaagtcttctagactaaaacagagatacccatctagaaacaaatattgagagacaagaggtgctgggttttctgaaaatttgccaaagtactggagaagatgtctacaggctgcacagttggggaggataagaagctaattttgctgagatctcaaaggtcagcgagaccctagataaaatctaaaccaacatttactagaagcagctgtgtagtagtcatttcccagaggtctgagaattaagacctatcactagcccttctgtgttatgttagcgagtaaccatgttacgtgcctagtttagggtaggatgatattgatgggtggagaagtcagagaagggtctgctcctctccttgattcatccactcaccctcttgctttgaacttctccaaatggctgaggttttagactttacactggtggaatttcatatacaatcacataataggcacataaaatatatttcatctaatctttctaacagccccaagaggcagatcatactgtcttttcaaaaaaaaaaaataacagtaaggtgaggagattcatagttataggtgtgaacgggctttaggatctgataagccgaaactggattgattgatagctttgcctggtcctatctgtaggtccttgagcaaagtatctaacttctaggagcttatattttctctgaacaaggagatcttgaaggattgtgtaacagttacaacagagtgccagttgttggaaaatacctacaaaatggtggtgttactattttcttattcttttgcacttttttttatatccatagatagtaaatgctcaacaattcagtgatgaaattaagtgaaattatcttcctaaactaggctactatagtcctgttaactcctgcgtgtagtttacaatgaatccttgtgtcccttgtatggaaaaatctgcttaatttatcagctctgccaagttcttacaaaaacaaaagaaaaggtgaagaagcagaaaaacaaatggaagatatcctttctgtagtcttttactgttgacatagatttcctctgcagaagagaaaactatggctttaaaactgggatgattcatactcaaaaagaatcagagctggtctggtatgagttggttatggactgaaagggttaggttatgtcaaaacttttcatgagctagtacaagcaggattctcttgtttattgttatattttaaaagacattccaggtaataaagaaagaaactccctcagcatgttctggctttgggcccctgtctcggtcatgttggtgcggcaatggagtgggtgtctatctcccagatgtgtaagtgcagaatgggttgcaacctggattcttgattgagaaaccttctgttcctctatagatgaaggtctatttccttcctcctgaggcttaaatggggaggcatggaaagcctcacacaggactgacctggataaaagggtctttgtgaagagaaggcaatttatcaactgcagggccatttcagggaatgatttaactgtggtcactgtgctgttcacagcaactttacatccacacctatagccccaactttgccatcaatttgcaaacacatacctgatggacacctatgctgatctgatgttttggggggctttctcttgggttccaagtatttaattttattgcatttgaggaactaggaaggagggaggaaaacgtttaaaaagagagacatttttagggaatttagccaatgttccaaagagccatgttgatgaaatggagcagtttaagtgaaaacaaattgagtttggaaaaaaaaaaaaaatttcctccacccagtggcatttggagcttccattctgagttacttctaacttcctggagccacgtttactttgctgagcagactaaatcatttaagttgtcagcttctccctgtccttgccagacctcactcaaggaatgcttccagggccatgggagctcacaaaggcctcagtctgcctgagtcactctctggggaccacatatccacagggcaagtttctctgtcctaatttaaggcttctcaaagtcaggggagagcctttctgtttccatccacaaaataggtcagaaggatatgataatagcgataggtagaattttatttagcgttccttgtgtgtagcaagtaccatgttgagagctttatattcattaattaataaactcttcacaaccatctgatatgggaagctaataatcttctggttttatagacattcttttttctgagaatcagaacaaacaacttgatcaagattatgcagcagcattgggcttcaaaaccaggtggtttgtcttaaacttagctcctaatactcagctctatttctctggggacattggatgttattgcagttccccaccatgcagctcactcagcaccagggtatgtgctgtatggggtgaggagagggggaggagaagggacagctgtgattcaattagcacaggtctctgctaattgcagagaaggagcctaaattctagaggggagacaagtgtatgaacaaaatcatcagagcagagtgacagagtgtctagaagtactaaagagggcttagtacaaagtctagatgtactaaggaggaatgagcaattaggtctttctctgagtaaggaaggggctttgtaaaggaagacttgaagagaagatcatccttggacaagaacttcagcatagaagaagtttatctaaaacatgattgacaacgagaccagcaggggcaaaaacacagagagatgtggacgagaatggtgtggcagataaatagaaggagcctagaattgctctagtgtcaactgaaaggtaatagaatgctaatcagtatctattttttttgcctcctttgtaattaggtgaagcagtattctgatttcatttctggatgatagaataggacaggaaattatatgcccatctaccaagtctggctcatcaacccttcaataactgatccttttcctttctccccatattctggcagacaaagagaactcagaacccaaaggacccacaggaccaaagaaaacaaggtctctgaattattgccccaggcaatcacccctctctcagtggacacacttttattgtgttatgctgataaaatttggggattattcattctagtgcttagtctacctttactaatcatggtggttgggaaaggaaaatgatcactcagagccttatacatggaatgaagaggttaggatttatctttaaggagattgagagctattgcacagttttaagcaacagagtggttcagatctgtggctcaggatgtttgttctgaatgctgtgttgtctgaatgggttggcgctagatggtgggaatgggagacatgagtggctaatggtctatctgcgctgctctcaagggtatgcctaactcctactccatctgcgctgctctcaagggtatgcctaactccatcattttattcaatttttgtacactgtggacattgcatacagtggcataaatggataaatgacttcatcactaccaatgattttatgccagtcatggagcttggcattgacgtgcatcatctcctttaaaacttgccagaactcaggagataaatatcatgattctcctctaacaggtgaggaaacagaagcttggtcagtttgggcaacttcctcaaagacctgcagtctttaaattcttgagctgaggcttgtactcaggcttctgattccagagtttatactcttttcattaacctgcttgctgagtaacttttttgtttgtttgtttgtttgttttcagatggagtttcactcttgtcgcccaggatggagtacaatggcatgatcttggctcactgcaacctctgcttccagggttcaagtgattctcctgcctcagcctcctgagtaggtgggcttataggtgcccgccatgatgcccagctaatttttgtttcattagtacaaatagggtttcactatgtcggccaggcttgtctcgaattcctgacctcaggtgatctgcccgcctcggcctcccaaagtgctgggattacaggtgtgaaccaccgtgcccggtttgagtaacctttaagtaagaaagtgccttttgggttgagtttaacaatttccatggtagagagtctcttctgctatatgctgtttacttagcttctgcctagtatatgcagcagcagaaaatggtttcccttgttgtaggtctaatgagatttagaacactttgggtcctcagatatagtgagcaagattttcacttcatagatgaaggaactgcagcctaaagaattgggaagaaaaggtttatccaggcttgctgtgcattccttcctttctctgggaattcccttggagaagaaatctggctgatcaaatctccttgtaaacatgctgtgaagactctggggaaaaccactaatgatatttgttagtggcagtctttatctttgagagacttttagcagcatgaaccttacccccgtagttagaattgtatatggtaaacaaacctggaaatctaaggattcatgggtaatggcttcttgaaaagtgtcaagtaagctatgtaactatggcaggagatggaactacttcagggttaaaaaagctggctttcatttcgtgcaagtaatgtacttgtgtacatcttttggagaaccatatgttaaatccgaatcagaccaagtcctaatgtggtaagaaaagggctgtggagtagtattggcagtcctgggcttttccctatgttccctgtaccttgtgattacttatagctttgacattattagtaaagcttgatacttggtaaaatattttattcttgtgggtctaatttgaaaatctagcccttgtgttatctccaacagatactgcctgatccaagatcacaaagttgggcagcaatgaaagatctaatctcagacctcttctctcctgtatcccaaaccagtgcaacaatgaggtttcctctgttcctacatatttatttctacatcttcttacgtggtttagaatgatgatgatgatgatgatgatgataatgataaaatcagcaactacctttaatttaccttactatgtgtcagacatagtgcttctcattatataaaaacagtataagcaacacatctatatgtaaaaactctcacgtcgtgaaacatatgtatagagaccctatcgggttaaaccttatgaaacttctaatatgtatttaacctacaaaacaggaatgtcatttggctcaatccaatataatatgccaggtagtttaaattaggtggacaagaaaggcctctgaagatctgagatcgaacaacgggaacttggcatataaaagttcagaaaagagaagaacctatgcaaagggaatcttctgcttcaaggactctgaggatgggaccaggtgcagtttgagcactgagagtcctgttatggctgaagtagagtgagtaagacagagtggtacaggttgagttgggatgggtagacagaaataagaccattgagctttggaagtaggagtaaagagtttgagttttatactaaatgggttttgactggggacagagaggaaaaaatgagatgtgattgattgattgataatttattatttttatagatttagggggtgcaagtgcaaatttgctacatggatgtactgcattgtggtgaagtctgggcttttcgtgtactcatcacccaaattgtgaacactgtaccatataggtaatttttcaaccctcatcctcctcttgccctcccacattctggagtctccaatgtctagtcttccacactgtacgtccatatttacccattgtttagctcccatgtactcatcacccaattagtgaacactgtaccatataggtaatttttcaacccttatccccttcttgccctcccaccttccggagtctccagtgtctagtcttccacactgtatgtccatgtgtacccattgtttagctcccacatactcatcgcccaattaatgaacactgtaccatataggtagtttttcaaccttcatccccctcttgccctcccaccttctggagtctccaatgtcttgtcttccacactgtatgtccatgggtacccattgtttagctcccacgtataagtgagaacatatagtacctgactttttgtttctgagtcatttcacttaggataatgacctctagctccataattttatttttaaagagtttctctagctgccaagtggagaatgggctatagggctataaaagcggcagcaaggagactatgtgggctgttactgtagtgggcaaggcaacagccaatgaaggcccagactagagtgatagcaattggatggagataactctgcagatgaggggtttatttttgttgcttgtgacaggcaagttcccatgctccctggtagccaccttatgaaaggtcttgttgatgtttcagagaacatttacaaacaacatctcagacaaggctgtggaaacaaacaaggggtttcactcacttactttgatgtctgacttgtggatacaatactgtaagttaatcctctcctttgtctcagagaagggtttgctttgggtagcttagagcacttgacaggaggcattttgtagcagccctattacccaaggggtataggaaaagctacagaccagaactgatatgctcttctctagaaaatgaaactgcttccagatccagagataattagacaaatgtctcactgctgcagggagcaagaaagaagggctacgatgggcagattcttggcatagctcttcaggatgtacaaggacttgcccagtgaccaggagagtaggggccactgaggaaaacaggctaaattaattgaatgatggggagaaggatgaggaggagaggaaagggagattggaatctgggactgcgcccaggctgcctttgtatgcgagttccctaacaacgctttctgagggaagtcagggactgactgaagcttaattcagattctctgaatgtgccttaaggagacagactgaggaatggtctgatgaaatgcaggggaagcaaaacttggcaagggcacagtggcaaatgagctgagaatatggggggagatcctgccaagacccccttccccccaggaccacccttggtgtatccggagaaatcaatcaattggacgggaatggatggctcccacaggacagcagtgggggacccctgtgagagctgggggtcttccatttacagacaggatttgggcctcaacagagcattaagatgggtcagtgcaggcataggggacgccctgaaagtcttgtcatatcctgtggatgactcaatggtgccaaaagctatgcccattcctggactgtgcccagggaaattatagtcttgcctcccacttcgtgtgaaggccctggggcaggaagcgtgacatggttccaatatccctacactgggggcatttgtaagagccttgtagagagttcacaaaaatcattaagtctacaaaacatcccttcctgatgccacctctttcctctcttgggtatttgtagtattctcctctaaatatctagctggatacattcgtgcccccacttaggcagccaaatcttcattcactcccttctggggtcgtctgccagatttgttgaaattaaaagttggaaataacttgatatatgtaaacttcctcctgcacctcctatcaattttataaccaaatgtaagaaaagcttttataatatccaaagagctttacccaatatatctctgcatctcactcaaagtttgtgaagtagctattattatccccaactgacttgtgaaaaacaggctcagagaagcagaggcctgcccaaagtcacactgtaaatgtcctgaaacagaggggcctggaacccaggtctcctagtttctatccagcctactcacccctgtacaatgctaccttcattatcttactttttattccactatgtcaatgggtaaaacagaataaaataatattcccttgttcccatgtctacctaaatgtggatgcagtctctagtatgctttccttgaactcagtggagacaatctttcatctggaaaaaattcattttttaaggtttccagtctcattgactgccctctccaacctcatactttctgatccaacactactactcataatgatttaaataaaccccaaactgttatttcacactactgcatgtttctttgttaaagctcttttccctattccaattgtccttctctttgaatagaaaacttctatccttcctcaagccctagaaatctacccttgacctccaagtaagtcaaatgggttgtctgatcccatatcccctctctatatgtacctcatcatagcactcactgggctctcttagaattgtctctttaaatgcctggcctcttcctctggcccagaagccacttggggacagggactttctatctccagcatctaatgcagaatttgaccaataattgcaggtgcttgggaaacatttattgccttgatcagaaatcacaaactgacaaatagtttctagttattaaataatcatttatcactcccagaaataatgccattggaactttcttataatcttgcatacaataaaatatacagattctaagtattcagttagatgagttttcacatttatatgcatctggggaaccaccacctcaaagaagttatagacatgttttttttgttgttgtttgttttccttgcttccagcccacaagagcagtctgttaaacaccttggccaaggctaagaatgtcagttttaaattaatatctgaatatgagctgcctcctacaagtataaaccttggcccaagggcccacaagggccacagccaattggcagggtcatggtaaatgatgcaaaggatggcatcactcttttcaggagaaatagcatggttggcgatgtatcattaactgaatgacattttgtatctctttcattcgtggtcactgatctgtgcaaaaccctccttcccttgctctaagcagagaagccccaaagaatctaaatcagccagggacaggtaagtaagcccagggtcttaaatcacccataagtttgtggccaggtttgcatttggtcctgaaggatgtattttcctttcatgggttgtgggccaatgtttcttttcctgctgatttatagcctcctataaattaacaggagcctttcaactgggaacgccacatcccaaaggcatgaatcttccgtaggtaattcctccctgaggaagaaagagttagctctcaattacatacagcgatgggggtgcatggtggctgaaatgatacaaatgccacttatattcaagttggagccttttcacaaagtcacagaaagacacagtgagatttgagtcccagaagcataaaagtcccagagaaaggggccttgacatagctttacttgcattgaatacagatttgttcaacccccatgagaggagaaatactgaaacaccggaaaacattgtctcctctcataacattttcagctcatggtgaagacggacacatccataactatactaccagctaacatttcccactcatttggaaattatttttaccaatattttagtgactcaagcattcagggtcataataaaaggggaaaatgtactaaatcacaatttttactgagtctgatattcaatttctttgattcatttcttctttatttaatcaaatattcaccaagtattactaggtaccagacatcatgccagggactagaaataatgtgaaaaaaaaggatgttttctgctctcacggggttcacagctgtggtggctgaggaactgtggtctctgctccccaccaattatacatcagctggacataagtaagtgtgcagtaaaacagaaatttaaattttgaggtagaaaatttacttatgaattctatcactcttaaatatatatattttgtattgagggaggagaaagtggattacagtttcaaagaggcataactaggagtcaggaagcctggcgtctattcccaaatccttttctcattagctggtgatttataaaagtcatttaaactcagtcccagttctgtcatatgtacaattgtgtaaggcttaccctggaagttataaattctatgtgtttttgatcggaatccttcactgtacaatttatttgttctcttatacattcaccacttattcattcattctgctaaataaacattcatttgtcccatgtgttaattttaatggctactataacaaattacacaaatttggtggcctaaaacatgagaaatgtatcctttcccaattattggagaccaagagtccaaaatcagtattactgggctgaaatcaagttgtcagtaggatgtgttactttagggtgctctaggggatagtgtgttccttgcccctttgattttttagtggctgtctttattttttggctggtggctgcattactccaatctctgcccctgtaatcacattgcttcctcttctgagtgtgaaatctccctttgcctccttcttataaggatatatgtgattacatttagggtctacctagataatccaggataaacttttcatctgaaaaattttaattaatcattcctgcaaaatctcatttttgcaacatgagataatgaatagccacagaatccaagcatgaggatgtcttgtgcagggacatttattcagccctaccacttcctttatttatgtgtatgccactttctcctccctcaacatgaaatatatatatatatatatatatatatatatatatataatttaagaatgatataatttataagtaaattttctacctcaaaatttaattttctattttactccacattttgagaatgagtaaagtataccggttaataatacagactttggaatcaaaagagttttgtcctgagtactgtctctgccacttcttatctgtgatcttgggaaaagtacttgcattataataatatgtgtcacattaaattacatatgtaaattatttagtacagttagttcataatattaactaatcagtggatatcagaaaatatcaatattaggtatatatgtggtctagatttggaggaacttgtccacgcccctggcaaattcaagatatggttaagaaattgtgaaataaacagttccaatgaaattcagtaacttttttttttaagagatggaacctcgctctgtcactcaggctgaagtgtggtggattatcatatgtggcttactgcagcttcgaacttgcagactcaagcaatccttctgcctcagtctctggagtacctgggactacaggcatacacaaccacacctggctaatttttttttaatttttatttttgtagagacaggatcttgttattttgcctaggcaagtttcaaacacctggcctcaagcaaacctcccccacttggcatctcaaactgtgggaattatagatgtgagccaccatgcctagcctaagttcagtaacttctattagcaaggaaatgtcagggattttctttgttttctttctttttttaatttttattttattttttggagtggaggtttaaaaagcagaagaaagagaaagaaaaacagttctctattgagagagatgggatttctgagaggaaagacggctggtggcagatgcgccagatttacagtcaggtttgaggaggtggtgtctgatttacatagggctcacaggcttccctgaactataaaatttcctgcacattttatagaatgtgagggtagagagggtaggagatatgacggtcacggacaggaaaggaggaaattaggatagaaaagttgaagaccctgttgctgacacccatcgggtggtcaaaggctggggtcagtccagaagcctttggatagcaccagggggtagcctcagccagaaatcctcgtttgctacaggacctcttccagccccagatgatggctaagtactctgtgaaaggaagctggttcaaacatggccaatatgcccaggaacccatgggcaccgggggattctccatgttgtcctcagcaagcctgtcccccagatttgaagattctgtgggtagaaacagtggtaattggatgctgaatgtgaagaaaagagagaagttctagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttcccttctcctttccttctcctcctctctctcctccttctctttcttcttttcttctgtgtagctggcagcattggtataagccaacaggaaaaagtgagacaaatctcagactcgacagaatgtgtcttttcctgtctcttccccaaacagctttctagatgccaagctctttcctacctggtggtcatcttgctgccaattgatctctttctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacacacacacagtttatgctctgttatatactgctctgattttctgtatctttcactttttgcactatcacaactataataaaatatttgaattactatctatataatgcccttctctcccattagtccataagcaccaagagacaaaatccatgtctgctttcctcactgtggtatcttttgaacttatcacagaacctggaaaataccaagttataaacatattctgaatgaaataatacaaacgaatcaatgaatgaatgatggataaatgcagtgtactataataatgatgtaaggaaccacttctaagcacacagaaagcataagacaaatgttcaagacacacatgcacctgtaaaatgagtctctgatcaggatagctgctccaatcatgggacattagacacttggtcttcctgagaattactcattggtaagcactttacagtttatgagcttctctcacttgcattatctcacatgatccacccagcagtattgaattggaagaattatcagttccaattgcaaatgaaaaaaaaaagaaaaaggcccatggagacattgtaatgacccaaggtgtcacagagactgagtgggaagggttagcattttttttttttctttttgagatggagtctcgctctgttcacccaggctggagtgcagtggcaagatctcggctcaatgcaaggtgcgccttctgggttcacgccattctcctgcctcagcctcccgagtagttgggactccaggcgcccgccaccacgcctggctaatttttttgtatttttagtagggacagagtttcaccatgttagccaggagggtctcgatctcctgacctcatgatctgcccacctcagcctcccaaagtgctgggattacaggtgtgagccaccgcgcctggccagggttagcatttaaatccatgtttttaattctgaagacatttttctccataccttgatgtccttcagacagataggcatttactaagcaccgactctgctatgtgccagggatatgcagataaaattgattctctgtatggacgcaaatagataaatagacagaatgggtccatacctagtgtggaaggagttgcaaggagtgggcaacttagtcggttctaggactggctcgaagtctggaaccagaggacacagagccaggcaggggcagcacctcccttacagacagggctaatccctggcaagtcagggctgtggagtgcttggggaatgacctcagagacagacagggagggccctggtcttgcctgcttagctgccgacagtcccagatcctaaggtggcccagtaacagcagggggacagggggacctgccctcggtcctcaattttttcatggtccttgcctcccttccaagcccctctactatcctggcaccatttcttcctgggcacctaacgcagacctcatcctctgtcctctttagtttttattaaagagacagctgatgaggacttagagtgctacccctgcagaggaacagagaagggaggtgtgtggtgagaagaggtttggtcaatgtgtgatttttcttgcaatgcccctttatcaacctgaggtaagggcactttgggtactttggtttgggttgagaagataatttgggatatgttgggtgaatgatttgaaatgaagcagtcagaccatttaagaacacgggctttggaatcagagatctgagttcaaatatgagtttcactgcttcacttcctgattatgccacctcaggcaggttacttgacattgctgtgtctcacttttatcatttgcatctgcaaaataattgtcctaaaaaccaattcatagagttggctcaaggacacagctggtaccaagtgaatgatggtcatacatgtatgtgtgtgtgcatgtgtgtgtgtgtgtgtgtgagagagagagagacagagaaagggagggaggaagagagtgtgtgtttttgcatatgacttagcatttattgagtacttctttggtagaaactatgctaattgtcatgtgtatatgattatctgatacagattttattaaacccattttacagatgagaaaaatggaagctcagacaacttaagtaatttgactcaggtcaaatggctagaaagtgcagacccaggatttgagatttaaatcaggtttcttgatgccaaagcacctgcgtatgggtagtctttctaatacacagcaaagtggaagctgtctctcttgaccttgagccactccttgcggcaaagtttccagttaacatgaaacccaatcagattccccaaaatagcagcctgttcctctagggagaagaggagccccacccaaagcttgctccagagtcttggaggaaagaaaaaggagggagcagagagtcttgcttaaaaatgtgacacatattttccaggagctgcctccaggcctgggatggagattctgagcatcatgattttaaactttttacttaatttttcattcttgcttcaggactgggcaagctggactctcgagtcttgaacaaaaatggaaaaataagggctgcagttgaaatcatttcactgtgcctatttcacatgatgctgcctgcaaaaaatatagcaaacaagattcctctgttcagtttatctccagaaagagggaacctgcatggagaaactgtaaggagtgagagagaggtttcggagaaagatgagctttagctttgcaaaggtgggatttgttttgcacagtaaatttctggaattatttcatttgatttcccattgtttgagtgtactgggtggtacaccttgtgctaggcactggaggagctcttagaggatttaaagagtcataatctctaagtgatatgagtagtggggtttgttcaaagaagagaactagcaaagagcagggcataatgaactaactataggtcaattttctcctctttcaagtcctagtttaaacacagaatacaaaatatgtctttcaaaatgatcatctttcactaaaggaagctgattaaatgtacaggtgcagcctctagaccttcctcacatgcttttctctagctggaagcagagcaatgcaatttacatgggcactgtgatcaattcttaacatggggattgtgaagcactcaaagagacttgattggattaaagactgataaatctttcctttaagttttctgaaaatgataaaaagaaaacaaacaaacaaaaaaaagaaataaaatctactccatcttccgtgaacgtggaaatagctataaccctgaaccacagactttgatatattcctacttagcaccacgaaatcttgttatggacctgaaactgggtgcagattttcctagaagtgccacaatcctcaaaagaccattcagtggtcctttgattaaagtagaagaatttaaaattgtggcaagccatggaagaagagagataatgctataaaaaaccactggtctggagatggacgctatatcatgatatttgtaactgattgtgatttagcccacctagatggtcactgcatctctggggaaaagaaaggtggaggatgacatgaaaatagcgttcaccgaatgacaagccagaaggcttgtgtatacagagatagcatggaagccaaactgatcttccaaatacctaaaccagaaagaattgacagctgcatgcaggaatggaagggttaaatttgataaaagtgttctggaaaacaaacttgcaataaaaatgaatactgcctttaaagaacttccctccatctttgacttctgcactcctcactctgcacaatattgtttagtaaatactttgtcatgttaaaaagaattatgagcaagaaataagaacagaagtttatgcatagacactgaataagcaaagcaatgaaaagcaaacaaaagaacacacatcactggaggaagagttctagcaaatagttttccagttcctgacagcttcaagaacattaggtcaccctgatatctcttttgcataaaaaagggagctctgagctaaaaagcaagagttctagtttaaaaaaaaggaaaaaaaaaaaaaaaaaaaagaaggtgagaagagctcaagaaataatcaaagaagaaattttaagtaatattgaagtggaagacacatgaaaattccagaagtagaatgaactcaactgaaaacatagtcaaggacaaagctgtgcttgagaacaatcacattagaaaatgttttatgagatgaaaataatttaacagaaagaaacatcatcatattacatgccaagaaatttttatatagaatcaacagcacagatcccagtaaatttaatacatttcagatgtgataataataatgtaataataataataaagtaatttagaaggaaaaaattcagagttgccttatactcctccacagcaacatgtaatagcagaagacagtggcataatatccataatgtttaaagggaagaaaactagacccattatacccagcatagcttgtctttagaagatgaagacaaaggatctacaacctcagacatacagatattcatcctatggcatgcataaatcttccttagaattaaaaaaacagacacaagacaaagaaatgcacccaatgaagaaatgaaaaaggaaaaataaaaacttagagaagtctaggaaaaagattgattggtagtgaacattaaatccatttaagtatataactaagattactagctctgagtattactattacctagtagaataaaatattataaaacttgacaataaaaataatactgtaaataagaaaacagggaaatcaagaattcaagagatactatgtgcatggtgcgatcttggctcactgcaacctctgcctcctgggttcaagcgattctcctgcctcagcctcctgggtagctgggattacaggtgtgtgccaccatgcctggctaattttttttttttttttttttgtatttttagtagagatggggtttcaccatgttggtcaggctggtctcgaactcctgacctcgtgatctgcccacctcagcctccaaaatgctgggattacaggcgtgagccaccatgcctggcctataatttttaaaaatatcttcaatctaattttttaaaataacattttctgccttgaactttagaggagattttcataagtgaaatctatttgtgtaaggaaacttaaataaatttttcagttactcctttagtttcatgttaggctctactttataatacattcaagacaagtgaaaataatcctttacattttaagtgggctgcattggacgactctgctttcattgaggggatatgtataggtaatgattagtttaaagaagacatatctgtgattttttttcttaatcaaatttgtatctgttttaagaagtgcacatgatggaatcaagtgggcaatctctcagaagccataggagatgtgttaataaaatagtagaatagggatcaaatagaattagattgaaattaaaatctatgaaggtgaagaagaaaaaagaataatgaataaaagatgaggaaatgaggaaagatgtactgtgccttaggactactgaataccataataagccatgctcagtagtaaaagagaatgtcataggaagtgtgtattacaactgtgagccctacacagctcaacacttatacttggtaggcttcttataacatctgatactaatacgccctttgcattaaaaataaaagttttttgtacaattaaccttctcaaatgtcatcaacaagtcatcaggactgatgtttaaccaaatctgcttctaccttttgaaattaagatcagctatattattctctcaagagttttatcattagactctggacttggatgtctatcccactcatggttatagactctgtgaagaatatatattgtgtaatttttgcatgtttatttactatccttcagaatctggcatagtacttggcatgtagtagtgcttaataagtgtttgtgaattgagttaacaagtatttgtgaatgatatgtgtatgaagattaagccctcttcccaaggtgcacctaggaaggggaacatcacacaccagggcctgtcatggggtgggggagcaggggagggataacattaggagatatacctaatgtaaatgatgagttaatgggtgcagcacaccaacatggcacatgtatacatatataacaaacctgcgcattgtgcacatgtaccctagaacttaaagtataataaaaaaaggaaaaaaaaataaaaaaatatatagtgccaactactgttatattctagagtgacccatgcagaatatgcagaggatgagcttaaagattatgtgaccaatagcccaatattcacctggaggatataaaatgaatgaaaagaagatttcactcacttcagtgagtgagtgaagctttaaggagactggaaactgtaggcagtggctgacgctggcttcctctctgttaaagcctaataagaaaaactgtgcctggtatttgctctggtaatagatgatgagggagagttctactgaaaaatacctgctcttccagagtgcattggagcataggatatatacttctaatgggtcagatggtggtcacttggaaagagctgcccaggagtcatccaaaagaggttgtaatttttcccaagagagatttctggatgggtgatgagaccccagtagaaagtatcaatgaggtcaccagaggccaaagggaaattgtagggagtccaccacaggatactggaagtgggacaccctgaggtgatggaggaatgtccatgaaggacttataaacacatcttcaaaaagcttcagatttgaacatccatggaacccagactcagattttagatcccattatgcccaatggaaaccaatactagatgattatattagcattgaaaaaggaacactgtgatggttaataatgagtgtcaacttgattgaattgaaggatgcaaagtattgttcctaagtgtgtctgtgagggtgttgccaaaggagattaatatttgagtcagtggactgggagaggcagacccaccctcaatctgagtggccatcatctaatcagctgcctgcgaggatagaataaagcaggcagaagaacgtggaaggatttgacttgctaagtcttccagctttcatctttctcctgtgctggatgcttcctgcccttgaacgttggcctcgatgttcttcagcttttggactcttagagttacaccagtggtttgccaggggctcttgggcctttggccacacattgaagggtgctctgttggctttcatactttgaggttttgggacttggactggcttcctttcccctcagcttgcagatggccctattgtgggacctcaccttgtgattgtgtgagtaaatactccttaataaactccccttcatatatactatctatcctattacttctgtacttctagagaaccctgactaatacagagacctttcctgccctttatttcccctcagtgttccagtgaaatcctgaggagccagaggcagcttcctgaatgggtgaagggataacagccctcacaaggaaaaagagagaaaggcagccatgtccctgtgtttctcccatttttaaaaccatcagatctcatgagactcactcactatcatgagaacagcacagaaaagacccgcccccatggtttaatcatctttcactgggtccctcccacaacacctgagaattatgtgagctacaagatgagatttgggtggggacatacagccaaaccatatcattctcccctgacacctcccaaatatcatgtcttcagatttcaaaaccaattatgccttcccaacagtccctcaaagtcttaactcatttcagcattaactcaaaagtccacagtccaaagtcttatctacgacaaggcaagtctctttggcctatgagcccataaaatcaaaagcaagttagttacttcctagatgcaatgggggtacaggcattgggtaaatacagccattccaaatggggaaaattggccaaaacaaagaggctactggccccatgcaagtttgaaaaccagcagggcaatcaaatcttaaagctcccaaatgatctcttttagctccatgtctcacatccaggtcacactgatgcaacaggtaggctcccatggtcttgggcagctctgcccctgtggcttttcagggtacagcctccctcccagctgctttcatgggctggtgttgagtgtctgtggcttttccaggcaaacggtgcaagctgtcagtggatctgccattctggggtctggaggatggtgaccttctcctcaaggctccactaggtggtgccccagtagggactctgtgtgggggctccaaccccacacttcccttccgcactgccctagcagaggttctccatgagctccctgcttctgcagcaaacttctgcctggacatccaggcatttccatacatcctgaaatttagatggaggttcccaaacctcagttcttcacttctgtgcactgacaggctcagcaccacttggaagctgccaaggcttgaggcttacacactctgaagccatagcccaagctctacattggcccctttcagctgtggctggggtggctgggatgcagggcaccaagtcccaaggttgcacacagcactgggaccctgggtccagcccatgagaccatgtttttctcctaggcttccgggtctgtgatgggatgggctgccatgaagacctctgacatgccctggatgcattttacccatggtcttggggattaacattcagctcctcattacttatgcaaatttctgcagctggcttgaatttctccttagaaaaatgggattttcttttctatcgcattgtctggctgcaaaatttccaaacttttatgctctgtttcccttataaaactgaatgcctttaacagcacccaagtgacctcttgcatgcttttctgcttagagatttcttctgccagatactctaaatcatctctctcaagttcaaagttctacaaatctctagggtaggggcaaaatgccaccagtctctttgctaaaacatagcaagattcacctttgctccggttcccaacaagttccttatttccatctgagaccacctcagtgtggcccttattgttcacatcactatcagcatttttgtcaaagccattgaacaagtttctaggaggttccaacctttcccatatttccctgtcttcttctgagccttccaaactgttccaacctctgcctgttacctatttccaaagtcgcttccgcatttcaggtctcttttcagcagtgctccactctactggtaccaatttagtgtattagtccatttttgtgctgctgataaagacatacccaagactgggcaatttacataagaaagaggtttaaccggacttacagtttcatgtggctggggaagtctctgaatcatggcagaaggcaagaaggagcaagtcccatcttatgtggatggcagcaagcaaaagataacttgcgcagggaaactcccatttttaaaaccatcagatctcctgagacccactcactatcatgagaacagcatgggaaagatccaacctcatgatttactcatcttccattgggtccctcccacaacacgtgggaattatgggagctacaagatgagatttgggtggggacacagagccaaaccatatcatcatctttaaggagacattattaagtttatgataaaggctctgataaaatgcccatgcttggagatgaagtagccttaaaaaattgattgcaacttaattcgctcactagcacaagagtgtcctttgtaaaactgagcagaaatcagctcctagaaataatgaatgtttatcaattaattggattgatgatttcttatcagacctttctctggttggattatttactctagacactccactgtttgttaatgtattgctaagattgctatgatcatattaaatcccaagtttattcctcaagggattttatatctgttttgtttgtctaagaactgtgacctcacttgagtcatttaaacaattcatatttctgcctttcctttaataatctttctcttagtcatccctgataaatttgggcttgtttgcttttcaacattctgcttttgatgcatcccatgacactcaagcagagcagttttctagaaatttagaacagagggctagacttcatgggcaatgttagtaatacagcaattttctgtatgttattaatttagagatagatatattttaagatagtaagtgaatagagaaggaaaaaggagcacggaaggaagactaaacttgaaaaagaggaatgaagcagctaaacagatgatcaataataatgattccagttaatggcaagtttcattaattaagtaattactaggttccaggccctgcaaattgttttatccacattatattatgtaattctcaatacaacagtaaggtatattcttttcctcatgttaccaaggaaactgaggcttggagatgttaaatcacttgctacaggtcatacagcttttaaatcacaaagaaaattaatcgcaaagaaacttagtttcttttcaacttcgcagtctattacatctttaaccactgtgctctgttgcctcttaagtatgagaataaaccagtagttcttcacttggagtgattttacccccagaagatatttggcaatgtctggagacattttggttgtcacagcttctgggtgggaggaaaaaggggtgctactggcgtctactgggtaaaggccaaggatgctgtgaaacatcctacaatgcacaagacagcccctacaacaaagacatacttggctcaaaatatcaataatgctgagatcaagaatggaatgaagttactgatctttttaaaaattatatttttatctcattaatattaacactagtatgtctagagggactgaaattatacaaggaaatgagtttgctgtgcagaaagaagaggaaaaggaatatactttggagtgggacttagagccttgggaggaatttgctgaccacaaacacgtcattgttaatagtaagttctgagttaccactgcatgccagccatcctttgcatgggtggtttggggcctacatagaaagaattggcctttgaatcaatactcaatgattgtaacagatttgcctgtctcctgtgtttttgctattctttctttatgaaaaaaattagtgtccattttaaaaggaggatctgttacctgctatatttagcgtcatgaaggaggagaactgcaatatttgctttccataaatttgcaaaaagaaagatattttccacccacccccacccatgcaatggttttccactgacagctgtatatatgggtatcctgccatatatctctggagtgaagaagacctgggaggcgtgggcaggccaatgaatggagccattgactcagatgttcctcgatgggcaggcgtgattatttcagggggccagttcttccactgtgaccgcatagctgagggcacagccaatgaatgagcttcacccaataatttctggttgattcacatttgggtcagtgatgtggtgggcaatgccagctgcagccccaggctccaagggcaactttccaagctgggactccttacaattctgccctgttaatggaggttgggggaaaatctagggtgggtccctccaggcatgagtgagtgaggcgagggaaaagaaggaaatggttttcataaattattgctagagtttttagagaaataaaagcatgggtttgagaaggaggtggaggactctcagcatcatgccactcctattgctcttcggataaagttcaaattgcctcatgtggcctactaggcctgtcatgagcaggttgccatgttatctttctctctagcctccccttaggctgccgttatcttcaatatctaccctccagtcaggctgaccacgttttagtatctctaacacggcattgttctctcctcaaagtctttgcaaatgctattactttatcctggaagggcttactcttcaacccccaacctgattaaatccttctcatcattaggatatagttgggatgtaactttcttgacctcccagactagatcagattgtggttacatgtttccatagtaacttgatcttcattgcagttatttcaatagctgtgttttccatctgtcttcctcatgagtctgtgagctataggagggccagaaaatatctaccttagtttatcttccatacctagtacctagtccagcgcctggcccgtagcaggttttactgaatatagtacttaataaaaaataataagggggagaaagaaggagagaagaaaagaagggagggaaggaaggaggacaggagcaaggaaggatacatggaagaaaggaagaggggaaagaagtagaagaaagaaagaagaaaggggataatttaatttgtaaaacaaaaacaatttccaatcatcagtttcaacctctggacttatctgtaaggtgatggcagaattgaagtctaaaatctaagtctcctgaatctcagttcaatagaacaaacaaataagtacaatagatccagatataattcagagagaggtcaattatccttgcaacttggaggaagtatacgagtttgctgtttctcagtgaaagccaattccctgtcgtggcctattgagcagccacatgttctatctgttgctattatttggagtatgattagaggcaccaggaaaataattagaaacatcaagagaaagattaggtgcatcagaagaatgagtaggggcattagcattgatcaagcaggaactctatgccaaggactatgcagggcacatgaaacacattttctcatggcatcctcacaaaccacacactgaggtgaggattgttccccgcagtgaggctaatgagaaaatcaagactcagagagtttcagggtatatgaggagaaagaataataccctggagacctggatgctttggtcacttattccctttccccaccccaggcctacctgatgacttttacttacacttcacatttgattcaaatgtcactttttcaggaggcattttctttttttcttttttttaattttactttatgttctggggtacatgtgcagaacgtgcagttttgttacataggtgtacatgtgccatggtggtttgctgcacccatcaacccatcacctgcattaagtatttctcctaatgctatccctcccctagctccccaccccccaacaggccccggtgtgtgttgttcccctccctgtgtccatgtattctcattgttcaactcccacttatgagtgagaacatgcagtgtttggttttctgttcttgtgatagtttgctgagaatgatggtttccagcttggaggggatttcttaccaccctcactaggtcaactcctctcttacagacctccatttcctctttgtacttgtcacttctaatcatgcatttttgagtgattagtnnnnnnnnnnnnnnnnnnnngcacatgtctgcattggtttgccgttgttttcccagctcctgaatagccctggcacataacaggttgccaataaccacttatgagcaaatgagttagatcattttgttgagcacatattctgtcctgggccctgtgctgattgatcttgctgtgtacagtggaaagtcatacatggtcactgctttcaaggagctcatagtcccatggggagattgtcttatttttttatgatattactatgttattttttaaagatactactttaaaaaataagagagttaaaatgttattggtaatagggggcccagggaagtccctgggtggagagaaggcagagatagttcattttacctaggaatgggtttctagaggagagggagcttggtgggagcccaggaaagtgaaaaggtgtttttcaggtggacaagggtgatatgtagttaggcagaaggaaatacagatgaagggagaaatatgagcagagggaaaagaaaaggagatgtgaaacaacatccatagcaaatggtttggtttacctggagcacctgctttgttcagaggcatgtccaagattgcagttgaagaggtgtctgtgggttagatcaggaagtggttttcatgcttgccttgggaaattgaactcttaatagtaaccacatgttgatggctaaacacagttaaaaggatattgaaccattcatccattatttgagtaaacatttattgggtacttacgtgctagcacgctgaaaaatgtgggtagaaataatacaaattccctcctccaagaagcctgcagtctatcaaatatgtaacagcagtcaggccctgacttctacgttaacttgtaagacacaaaaacaaaaatgaagcaaactgaaagcaatcggtcatcttctactcagcatacccagagtgggctgatagtgacagagtaggcaatgatgagggatgtgaggaaaggaggaattactgtgaagggaggatacataactccaggagctcttcctggagaaagtggctcagaggataaattctgcaatgcaaagagaagaatatgttttcaatgcacacatttttatgttcttaaatatctgttgcatttcccccccacgactcaggtctaaaaaagcttcccatctctgacattaagtgaccactccaactttatagtcctcccacatcctccacctaactaacctttcttgaacacctacattttgccaggcacttttataagcatttagttatagtattccatttacccactaacttgtaagatctgtttcataaacaccatcttgcagatgagacaactgaaaccagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcagcacagacggttcacaacatcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcctgtaatcccagcacgttgggaggccgaggcgggcggatcacgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaattgctaagtgggtgcctcatgagctgagtgaaaattaaaaaatagtcatttttgaagtgccgtcttctcttattctacgcaacaaaccatttctcaattagattgtgacatgtgatgaaacgtggattttataccacaaccagtgaagactagctcagtggtttgactgagaagaagctccaaagcacttctcaaagccaaacttgcaccaaaaaaaaaatcatggtcaccagttggtggccggctgccagtctgatccactacagctttcttaatctgggtgaaagtattacatctgagaagtatgctcagcaaatcgatgagatgcaccaaaaactgcaacacctgcagccggcattggtcaacagaaagggtccaattctctacaacacctgactgcatgtcgaataaccagtacttcaaaatttgaacaaattggcccatgaagattcgcctcatccaccatattcacctgacctctcaccaaccgattaccacttcttcaagcagctcaacaacttttgcagggaaaacgcttccacaaccagcaagatgcagaaaaatgctttccaagagtttattgaatcccaaagcatagatttctactctacaggaataagcaaacttattcctcattggcaaaaatatgtctattgtaatggttcctattttgattaataaagatgtgtttgaccctagctataatgatttaaaattcgtggtccaaaaccacagttctttttgtaccaaccaatacagcaaaaatgtgttttcataaatgttctacaacaaaatctaagaactttccagtatattgtatggtataacacactttctagttcagatgtctgcaaactaaaaaaaaatgtgatgatcaaaaccattgaatgctagcaaagggattacccaatacttgtcatctcacagctattcattattgccaggaagttctcagacttcatgcaaaccttaccccctcatctttcacattaggaaactgaggcccagggaaattcagcactggctcagtgtgatggagagtgtttgtagccaggccagaagtgagatccaggtttatagttcctcttcttatgatcttctcactaacgtttatagttctaatgctagattctgattcttctcattttatgttctccttgcagtttgtaaggtgtgttgggaagggtataggttttgaagccatttggatctcggtccaggttagagatctaccactgatttactctgtggccaagaacgagcttcctcctgggtttcaatgtcctgtcaaatggggtaaaacaatctctctctagtaggtttgtgataagtgttaaaaaaagtcacgtatagagtaactaggacagagttcaacatataatccgacctaatacatgttcgtttttcaacttcccttgctaggagatggaaggaaggtgaaatctgccacgatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattacttacctgtgcacaaaatgatttccgtctttgtcagggctgaggtgctagttttatgacataagggaggactctgattcgagactgctctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagacacaagtaatatctattttttttcttttcatgtacttctaacagtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactacttgcccatacagtgctagcttcttagaaatttttggctgaatttatgaatgagagtattttttcatttataaaatgtaaataaaagcaaccatgtactagggcagttgtgagagttaaattacatgtatgcatgaatatgagtaaatatggcaaactggttaggaggtcaggctctgaagtcagaatgcctgagtttgaatcccagatctaagcactgaactctttttgcctcaagtttctcttcagtgaagtgagtgatatggtttggctttgtgtcctcacccaaatctcatctctaattgtaatctccatgtgttgagggagggacctgtaatcctcatgtgttgagggagggaggtgattggatcatgggggcagtttcccccatgctgttcttatgatagtgagtgagttctcgtgagatctggtggttttataagtgtttgacatttcctcctacacacattatctctttcacctgccaccatgtaagatgtgcctgcttctccgtctgtcatggttgtaagtttcctgagacctccccatgtggaactgtgactcaattaaacctctttcctttataaattacccagtctctagtagtacctttatagcggtgtgagaacgaactaatacagtgaggaaaatgctattagttgctgtaaggaaaaaatgagataatttatgaaaagcacttagtgctaagcacagagtaaatgctcaataatggtagttcttgggtacatagtagatgctcagttagattttgttactaattcactgaagccagaagaagacagaattttgcaatgtaagtagaactgaacgtgtttttatatgtgtagcttttctaagataattatgtttgagaggtgttgtttccagtagaactctttaaatattattacacagctcttgggaacttgggaaaattttactcattattccaatacatctccctgaagactgatttccaccccccacaagtttccatgttcttcatgggtctggaatttagtcagagagacaggctacttttctctaacccaagccttctccttgggtgattaagcacgtagtttcatgggaagtttaagaccaaagaattatggcattgtcatgtcaggcactcaagtgtcagggatttggcttaagtgaattgattactggaaacccttgaaacttgttatctttaagttgcttccagcccctgtgaccagaaatgcatggcgactcccaataacatctgcctttcttacaatcccgcccataccagttcaaagatcacatagctgattcttttattaataaaatatttattgagctcacacagcaccctaagcactctgctaagtgctcaagatttagacaggaataaagtattatctctgctatcatgactgttatcttgcagtgaagggttagataaggagacaggaaatgtcaatagattataacaaatgggacagtggcacagggacatgtctgggacacataagcaaggttcctgcctcctctttggggccagattacatttagtgatgactgtgagaaaaatgtgtcagctgaactgaggtctgaaggcagggtaaatgtaagccaggcaaagtggacatgggatattaggatatatttctgccgaagtaacaacatataaagacctaggaattagcaaaagcgtagcacatacaggaaactgtaaagaatgcacaaagtcttgtatacaaagttggacatagtgagagttgagggtggaaaagcaaaccaaaggcaaatcttgtccaaggaatttgaactagctgagtgcttggaacattggtacatctttgttgaaagactaaatggatcaataaactgtattctgagggaaatgaagagccattaattcatttaaattagcatctgacttgtgttatatgatcatagaatctaggttaaataattcacctggtgcctcatatgagagcttgacataggaggaacaatcttcctctgtgttgcaatcaccatagcatgaacaaaatgggaatatgggggaaacaggagaaggagacaaatagaagagcagtcatcccagggaacagactaaatacggaaggcctatgcccagcccaaagaaatgcagagatggacaagtcatctcgcatggataagcaagcattcatcccagggaacagactaaataaggaaggcctatgcccagcccaaagaaatgcagagatggacaagtcatctcgcatggataggcaatagaatggaatgtgtgtatttaagccccagagacaatggcgttccaaccttgcctttgtccctaccacctatggactttcatctttttgagactaagtttctttatagggaagatgtgatttttaacatccctgcgtggagttgttgtgaatatataatagctttatgtataatgcatttatatataaaattctcagcacagggctatatacttcttctgggatactcagaaaagatcatttaagataagaagccatcctaaatttggatgttttctaatataccactgagaataactatatttattgaatgcttatattgtgttatgtgctgttctaagatttatagtgaccgtggatttaatcctgccaaagaccctataagatagtgaattctgttattctcactttacaaagaagaaaacagaagcctggtggaaatatgtatgaatttgcatgaagatgtatggccagaggtggtggagttgggactcaaacccaggctgtctgggattgaaatgctttcctatattgctgaaaaaaaaaaaaatggctgtacagtaaataaaatatcacagtgtcatgtatgaagtcagtggttctggcaaccctgatctaatgctgcagtggtcataaactgaactcagggaagttggaagttgagttttgaaacaactttaaatcatcttatttagccccttaatactcacatcagaaataatcttattttgtgtacattgttagacaattaccaataacctaactacggttttgtctaagacactgatttgacttagttgtctggaagatttagttgtctggaaatacattgtgatattgcataaacttttaaaaaatctagttaagtatcgccttttacacacaaagaaaaacagttttgtttaaggtgaagagacttgctgaaatgtttgtaatcagtccatgaaactgatttcctaacaaagatatttggtgccatggagtttgaaaaacagggaagaattttcaggtatgatgcagtcttcatcactgaactcattgtactgtttagttatatgtaacagaaagaagtcaaacttgcttagaaaatgaaggggaatttatttatggttgtatccaaaatttcagaggtaggaggaactttatgtacagctcacatcagtgactcaagattattaccaaaagactattttgtctttttcttctttgttttctatccttttgttatcatattagaatataaggtggctatactagccagatactccaggtcaacatgcttattcacaggcagtgatcgaaagaacatcgctggggatcagtcaaaactgcctgaaatgggtatccaagaatggtagcaggtcatttctcctaaggaaatttgtggaactattatccttaagaaagggaaatggaggtaaacagtaaaccaaggtgtacactgaaatctctttctaggagaaaagagtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaatattaaagtgtgaatgttttatttctaagattgggaaactgatgctccaggagagaaagtaacttgtctaaattctccagacctgtaaacacaaagccggcatgagaacccactctttcttactgtctctctgaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattatttgtttacatggcttagtatctaagggacatgaagtattgtcatttatcagagactaggtctcaagtttgactctggtttaagttttccataatctgctcagtacatttcttcatttaggcagctctttcacaacggtaaaagcatcaggtgacaacttccatctggctggtcccaagttacttttcatgtaattcatccttttaataagctatctcctgacatattgggtccatcttgacaagccatgtttttttttgtgagacatcattctaattatcttaatatcttagaaggaagaactccataattatcttttatgggaaggctcgagacacacatttgaaattgtatgcccaggactttatgtgcagaagaatcaaggtatagtattatccagtgtctctggcaagtttttgggactaaatttcaggctacaagatgtttgttgttcattgcaaaggtcaggtttgactgcgtttattaaattacaaacttgcttgtcttgtatcatcggaagatggtatgaattaaggctttctcattccagtcacagtacagattgcagctgaaaaacatctaaagggattcaagtgaccaagaacattgaacagaaaaaccataacaaacagtccctgcctttggggagtccctatgctatttgatacaacagaaaatgtaccatatgttaaaatttaagacagaccaaatatcaatcccttcctccaaataaatcaagctgtcagtagataagacctcctgcctctaaacttgactcctccagttcccaccgcaatgatcccgatctcttactacttttgcaatcaaacaacttcaatagattttcattgctttaatgatcaagttcaaatgccttaaaacagtggtccccaacctttttggcaccagggaccatgtttgtggaaaacaatttttccatggactgaggggggcaggatggtttcagaatgattcaagtgcattacacttctcatgtactttatttctattattattacattgttcattaatatataattaatatataatgaaataattatacaactctccaccatgtagaatcagtgggagccttgagcttgttttcctgcaactaggtggtcccatgtggaggtgatgggagacagtgacagattctcatacagagcacgctacctagatccctcacatacacagtccacaatagcgttcgtacttctatgagaatctaatgctcaggctgtaatgcagcaagggggagtggctgtaaatacagatgaagcttcactctcttgcccactgctcacctcctgttttatggcccagttccacatggaccactatcagtctgtgggccaggggtgggggatccttcaaagatacacagtgcctcccctaccctcatctcttaatgttctttaaggcccctttttaccatcatacaaaaaatgacttaattttctgttacatgctaaacttattcacatagctaaacttttgaaaatactatttcttcagtctggaatgttctactctagtagtccaagtaataaaatcaccctttatgatgtagcttaattattgaaatctttgagaagggtgaattttatggcatatgaaatatatcttaataacgatgctattaaaaacaacaaaacattgatgactcttttataagaaacttccctctcttaattcattctaccatacagtcaggtacctgaaagcagatattaacacgtatacatgtacatgcacacgatactaggttagggaccaatttttttctcccttaaaaccctgcatacctacctattaactgtgtttataggtttacttgtttattttccatctagacttggagcctttaatgtggtagccattaatagcacgtggctgttgagctcttgaaagatggctagtccaaaatgagatatgctggaaatgtaaaattcacacacaacatttcaaagtcttgttatgaaacaatgtagactgtctcattagtagttttatagtgattacctattgaaattaatatatacattgggctaagtgaaaatgttattaaaattaatttcattttttctctttattttttaaaatgtgtctacatgaaaatttaaatttatgtatagggctcattttatttcatttggacaacactgatttagaccgtgagatacttaaaggtagggacagtgttttattcatctctgcatatagagtcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgctgtgccaggtgcggtggctcacctctgtaatcccagcactttgggaggcaaaggtggacagatcatgaggtcaggagttggagaccagcctgaccaacaaggtgaatccccgtctctactaaaaatacaaaaattagctgggtgtggtggcatgcgcctatagtcccagctaatctagaggctgaggcaggagaatcacttggacccgggaggcagaggttgcagtgagccgagatcgtgccactgcactctagcctggcaacagagcgagacttcgtctcaaaaaaaaataaaaaaaaaaaagaagagattgtatgatttctccaagtcactgtcggcattcacgtttctcctatgaaaataaaaggccagcataaaatgggctttgatatgacttcataaagctgatctcatcatgaccactccaatgggaatatttattttacccttgatttggggttgctgattagcttccaaagtatgtagagggtcctgccatgcctggggtttctcttaagatattttatatacatgtggttggttcagtcgaggagaggcacaaagttaatctaaggccttctctgttcaaaactgtcaggtccacagtttttattcatggaagcttctgtaggctattctatagggttggtgcaaaagtaactgcagcttttgtcagtaaaagtaatgccaaaaaactgcaatttctttcgcaccaacctaatatgtacatctgaatgggctgtaagcagacatctgcccctggcaacaaccaactgatgatttttttttttttttttttttttttgagacggagtctcgctctgtcacccaggctggagtgcagtggtgctatctccgctcactgcaagctccgcctcccaggttcacgccattctcctgcctcagcctcccgagtagctggaactgcaggcacctgccactgtacccggctaatttttttttttttttgtatttttagtagagacgaggtttcacggtgttagccaggatggtctcgatctcttgacctcgtgatcttcccgcctcgacctcccaaagtgctgggattacaggcgtgagccaccgtgcctggctgatgatattttataattaaattaatccattcagacagactttctgatattcagattttaaaatgcaaaagaggatagggcagttatttgcaagataaatctctctcaatagtaagtatagttttgtataatattgtataaaaacaatgctaataacaaaatgtattgaaaattcactatattggacattgaatgttatttacattacctcattcaaactccacaagaataaagtttggattgccattctacatttacagttgagttaagtggctcagaaagtggaaacaactgggccaaagtggaggaggaattagaactcaagtctgttttgctcatttttgctaccatgtgaagctatctttagggtgtcagccataagttttgatcaggttgtcctgccactgacttgataaatcagcccctcaggaaataatctacatgcagaacttccaactgattggagaaaacagaagctcagaaccctgcatttctgtcgcataccattcttagtgtagaattggaactttcaatactggaaccctgctctgagactctgcaggcctaatcatcaacgcctcctctaggtgccagccatagaaggaccacgttgggtctggcccttatttcagggaaaaggagactttctgcccagtctccaggctgctgaatcagcctctttcttcctttggctttcagaatttactttcaaccctttatttttcagtttgatggcctcacacagactgacttttgtgaattgacagagataaaagaaaataaaaacctggttatgaaccactgagtctataaactggatactttcctagatgtgtggaaaatataacagtgctagttttttttttttgttgttcctcttggactgtgagtacaaggctccttctttgagaatgagcaggaatgcctataaggagttttctttttattttccctgactccactttttgtttctggattatgatttatatcagaaaacatttcctatggtttggagatatttttagaagtctgagggtggtctcaggaaaaatggaaaatactctgttatttgtttctttatcttccaacttctctctttaggttccaatccggaccttgccctcagtcttactcctttcactgtccgagccaatcttttgtcccttgtttatttctgtagggaaacacccaatgcaggaggtgatagctctggaatttgtcattgataagccacctccttccagaaatcacaaattcattctgactgaacccttttttgctttaaatcagaggagcggtaatttctagtttgaaagtaacagacacatgtggatggtatccttgggaagaggaggaagagcagcactacagtgttattttacagacagcgtcctacctcatctatgggcacagaaaggcaagggagatccttattttatacctctatgagaaggtagtcttttagcattgcagagatcctgaaccgatagtttaggtgatatgaaacgtcaatcatacagcacccctgatgaaaaaccactgggcctagaaactttgaatacttatggtgctgaataactcattactttggaaagtttgctgttattatcttgtgcttcttatcatcaaatacgttctcagggcccattgagtgctaggaagatcttgaatcatttggagaaaatgcagcactgtgtattggtctccagacaggttatattcctggctgaggtcacaacgtctggtgcaaaactgaataatgcgagggtgatatgggattcgtaagcatttttacactcctgctaggacaagagagggttttggagatacagattcaaagacaattatacgtgaaacagcaaagtctgatagttgaggacatggcctcaggattcagagttcactacttattatctacataaagttgaccagcttacttaatctccatgagccttggtttctccatttgtaacatggggctcacagaagtatttgcttcataggggtgttgagaaaatgaaatcacttaatacatgcaaaatattgagaatactgcctggcatatagtaaaaaagagctcagtaaacttaagccattattgttatgaccctgactcaagcatgtgttgagaaatcctgaatcaagtgtagtatcatcatagaggaatggaacacttgtttgttaaatctttgcacttgcaagatttttagtggacactaagttctttacttttacagtctcatttgctcttttctaaaatcctgttgtctgggcacatcttaatgtttcccatattacagatgggagacttgcagctcaaagaggtcagacattttttcccaaggcctcagcttaaatgtcacaccttcagagatagatgccttctcaaagcactcaatataaaacagtcacccactcccgttttacatttactctaagattatcatctgcatgttattcactattagctggcatttttgtcatattcctgtgtgcgactgtgcttattttatgccttttcccagctagaacacaagctttctgaggataggaacctttcttgtcttggcacagaaccaatctccagcatttaatatgttgcaaatctttggtaaacatttgctgaaggagtaaatgaaggacactagaaggagaacagaatagaacaattattctgtaagaaaaacagaaggagctgtctttgctttccaatgctatccccaacttcatgaccttgggcaactgatttcctgtctctaaattagggaaatgagaatagtaacctctacttccttacagctatgatgaggaaaaataaaataaaatttaaaaatcacttagcatagtgcctgcgcataccaagggcaaaataaatgctggcttttgtcattggaggaggcaggatttgtgaggtttgtttgagagtctttcctgctatgttctatgcttatataggaaattatgaataataactttgatgagaacagaaaagttcaataaaaccatcatctctttgttccatttggttacttcaaatttgacaattatcttttaatggagaactgaactaaatgttctcattattttctttccagactaaatgctccttcttaaactaagtctcccaatcccacctcatatgtaactattttatttcttcccacaagctcaaggaatgtaaaaaaaaaaaaacgaatcttaagatgttaagcttagtggaaatgcaggaagggcttacaggttggttgcctggtgcaattttctgtcatgcagggaaaccaagactgagagagggaaatggattcacctcctgacacagtggacaagccaggacttgaacccaggtctctttaatacagtttctgccatgtttccctgacactcacacagagaaaacaaatctacaacagttatgtctccacttcgtaaaccttccattctccatcaccacttccaaataaagaataacggttgttacaggaatatgtcattacttgcccatttcgaattgccaaccagggactcccatttccaacatgtttatgtaaaagattaggagactctttgctctaattggtcatttttccactgagtaatagagttgcatcattgttgaattggctcagcctgacacaggcagacacactgatatatgtatgctttaatctgttaggaccaatgaggaaagaaaaccgttatttactttttgtcctgacctcaccatttagccatggctctttgagagcatacttcatttactgaacaaactgctcagtagcatcaataacttgttttagattcttttaaagaggacttcatatggcattcaatccttgattccccaataaaacaacacagctgttcccttgcagctcgtctctcagcaggagctgcaaaatcatatttaatcaactttgctttaaaagccatccagtttcctttagggctttggcgaacttccctggccaggatggcccctgctgacatgtcagcagctacagcttttccaagccctggcggagggagttgccatttgctgagcactttctcatgtgccagtccctctattgggcactttaaattcaaggttttatttaatccacatggcagtctcatgagatggggattgatctctgattttaagataaggaaactgaggcttagaagtgtaaaaacatttttcccaaatcaaagagcaacaagtgaaagaattgggattcagccaagttctctctaattccaaaatctgtgcattttctacttttcagtttggctttctacataaagaggtaccaaggaattatacaggggtgagtgagacacaatttagtcagtatgtcaaatttggcaacagagtcccattgctatagctcctaagtctttttaagacttacagctttttcttaccatgatgaaatttgctgttagaatataaataatcttgatggcatcttgtattcaataaagattaacaattattatgtacaatttactcttcaaagtgaggtgaagggatgcagagatcaaataggtatacatcttgctctcaagaagctctaagtctagaaatagagatacaacagcaacatcaaacatgctaatgaaaaatagaaagtgataagtgttatgagtgggttaaattatgatggaaatttgaaaaaggagaagtctattctagctaaggcataagtcttatccaaaactttgaatgtaaagactataagtattttccataaggctttatggaagattgcaatagtcaggatgattaacactagctcctgtgacacccccaaagtatcagtggctttaacacaacaagaatttcttcttcactctttgttggggtgaggcagtgctctcatctatgatgtcactcaggatataggcttcttgtatcatgtggctctaccctttgagagtcctatgtttctagccacctggttagagaagagagagagagagagagagacagagagggagggaatggaggatcaagtggaaagtagaggagccaggcctggaagtggtttacttcatttcatttacatctcagtggacagacaagtcacatggccccaacacaactgaaagaaggatgggaaatgtcttcttcctgtaggcccagggagaaaacagagcttaattgagcacatagcattgtttctgccacaaggaatatgaacataggtgttgcagaatcatttaatttaagaagttgagggacatgcaggatgaaggtagtgtagagggtattcatggaacactttgattcaaaagagattggtttggggtcgggcatggtggctcacgcctgtaatcccagcactttgggaggctgaggctggtggatcaccttaggtcaggagttagaggccagcctggccaacatggcaaaaccccatctctactaaaaatacaaaaattagctgggcatggtgatgtgtgcctgtaatcccagctacttgggaggctgaggcaggagaatcacttgaacccgggaggcagaggttgcagtgagccctgattgtgccactgcactccagcctcggcgacacaccgagactctgtctcaaacaaaacataaacaaacaagaaacaaaagagattggtttggaaagatagttgataccagatctggaaaggcctttagtgacaagcattttccaaaatgtatttttcagaatgttagtgagtaaaatatgaagaatgatttgagtagtcaagtagattttggaaaaactgcgttatcaaattttaattgcctcggttccacaggatttcgatttttagagggaggcacgatgtatcaattataataaaccttttcgatcacagaatctctttttggtagactatcttgtaagactaatattttgtgacatggaatcttaggcaatgaggaaccattaagcaagaaagacaaatgattagacttacttttagaagtacaagccagagatgagttccaacccacatcccagatttgaccaattaataatggctggcattagtgctatcatgaaagaaattatgaaacttcatctgaacttatctaggaaaaggtagtgattgattaataatgtctgctgtagagtaaaggatatagaggtgtgtcttagttagtttggacttctataacaaagtaccatagatgggtggcttaaagaacccacacttatttatcatatatcttccagcctcctatctggaggctggaagtctaagatgaagatccttgcaggtttgcatctggcaaaaacctgcttcctggttcatagatggccatcttctctctctgtatgctcacatagtggagaacagagagaggaaaagcaagctctctcatctctttttttttttttaaaggcactaaccttgttcaaggggattccacccttatgacctaattacctcccataggtctcacctcttaatgccatcatattggggatgagaatttcaacatatgaatttggggggaaggcaaaccttccacagcagggtgtgatggttaattttgtgtatcaatttagctaaactatggtgcccagttgtttggtgaaacagtagtttagatgttgctgtgaaagtattttgtagacacgatgaacatttacaatcagttgacttaaaataaacgatattattcttgacaatgtgtctcatccaatcagttgaaggcctgaaaaataaaactgaagtttttcagagaggaaattctgcctcaagagtaacgaggaaatcctacttgagttttcagtctgctgacctgctctgctctgtagattttgaatttctagcttactggcttgccatccaaattttagacttatcagtccctacaatcatgtaagaaaattccttaaagataagtgtgtgtgtgtgtgtgtgtgtgtgtgtatgtgtgtgtgtgtgagtgtgagtgtaggttcggtctctggagaaccctgactgatacaaggggtgacaacagcatgatggcatttgattttgttgctttaggtgaaggttgcaagttgggttacaaagagagcttgggtgcctgaaagtggtgtcaacaccaaaatggaaaagatttcaggagaagaaagttcagatttggaactttgtcctttagatgtcacctggacaaacaaatagacatccttcagaagaacgttcattcagagctaagcagaagtcagcattatttccagtgtgcaaagatattttgaagagaatgtatatctcctttaggatccttcaacagatacgccacctgtttgcctgcagcagtttcctgaggctgcaatttggaacaaatgcctctagtgacagggaacaaaaagagttgctttgtcctgaaaggaggttaagagtcatttgaggctgactattcaagacacacctgaatggggtgtgaattaagagaaaggagggccaggtgtggtggctcactcctgtaataccagcactttgggaggcctagatgggaggattgcttaagcctaggagtttgagacaagcctgggcaatatggtgagaccccatctctaaaaataaaagaaaaaggaaagaaaataaaacagaaaggaggaaaacggttatagaaaaaggagaggaacatcactaagcgaaaagctgaatggaggtgagtcactgggcatgactaagccatgactaagacctccagggtgatagatgaaggtctcaccaccaggagagtggagtaattattaatgcatgtttgcctggtgagttatttagttacaaaaaccacagcagaggctcttcattgtaacagctcaacaatcatatatagagttcccgcaatgcagacactcactaaacactggggtcacacgggggaaagacacaagtccagcctcattttgaatcagtctttttgtgtgttttagtagcttcccaaacataactttgtcttatcactcatagatgtaatgaggtagcttgattctatttattcaacaaagacttattgatttcctacaacaaaccatgcactgttcttgctatggggaatatagtagtgaagaaaattggctaaacttactccttgccttcatggagctgacattctcatgtgggtgacagaaaataccatgataaataagtaaactacacagtaggatctgtggtgatatgttagagaaaaaaaataaagcagctttatcaatcaagagaggttaggcagccaacatgcaataattaacaaactggaatctcagtgacttttccactcgcctaattttcatcgtgggccagaaggggcctctgctcccacaacgtcactgtcttccttgctctaggactctgactatagagcaacgaatatctgtgctattataggggaaaaaataaaaagagatttctgctgggtctcaccttggggaagcaatgctcagcctgaaattgatgcacattatttccacacatcattcattggaatgaactgattagttggattgacctaaaatatggaagcaggaagtacagttctatcatgtgttcagactgggggaaatcctgtaaatatggcaaacaaaaatagggtcatttaggtcacagtgaggactttggcttctcccatgagtaaaatgggaagccattggagactgtgaacagtcgagtgagtgcagaatgagacagacttttgttgagatcttggctctgtgacccagaacatgtgatctataaattggggcaacaaaacctaccttattagattggtagtaagattcactgagatatttgtgtaatgcctggcataaaataaattttggcaaaatgacaatgatatattgaatttcctataaacctatttgtttcatcaaatgaggatgaatttcccccaaagcaaaaaccatgtctaattcatcattgaattctcaattcctaatacaagattggacccacttcattcccctaatatgtgtacttcattctccacaggatggctgagaggagggaaaagatgcagagagcatctgtgtatccttgctgctaagaattcaccttttttaaaaaagggagctgtcaccttgaataaaaaaggctgaagcagcaattcataagccacagttaatgatcaaactcatggcaagtcagctttagaatccagtggaggcatgttctctgtggccttatggcttgggggactgtttggaatatggttagctgtcaccttatatttctgatataagctatgacatgcctgtagctgacacatttgtccgcagactctttgttcaaagagaaaggtataccacagttgtgctagtaatggttgcaatgcctagggatagaattacgaagaacttgaaaaatcttgctcttagcatgtgtcaccataatgaatagatcgacggtacaaggtcaaacttaatgcacaatgggaaaggtggaaattttttttattatctttctttatatgtgtctcctttcactgcatagctttttctccacactcctttcatattgatctggcaataatgctaactttggtgcattcaagaggcccctttccccaccttcattttgtcttttctctaacagcacttgtttttcatattcttgaacacattcagctagtggctgtgaatttggagagataagcatataataactatgatgatcatacttcttagtttgcccagaacagtcatggcttttgcccaatgtctaggtgtaaatattaatgataatcccttttattctcaaatttttctcagttagaaaaatatatggtcctatttattatagaaatttatccttttctgaagggccacacaatgccagaaactattatgcctttccaccagcgtgatcctagagttaactcaaagtttcacgtgttgttagaaatatgaggggtttcaaagtcaaccaaaatagctggaagggaaggacattgtcatagtccatccagggagttagcagcccactctgctgccaatctcaaccagaatttgacctccccatcaagttctgctgtcacattatcctcctctaggagaggaaagatggtggtgacaaagcactcaactttggtctcgatggacctgggtttaaactttgggtcaattaatctatgacagttactgtattagtctgttctcacactgctataaagaactgcttgagactgggtaatttagaaaggaaagaggtttaattgactggtagtacagcatggctgcagaggcctcaggaaacttagaaatcatggtagaaggcaaaggggaagcaaggcaccttcttcacaaggtggcagaagggagaatgaatgcaggaggaactaccaaacatttataaaaccatcagatcttggaagaactcactcattattacaagaacagcgtgggggaaactgcccccaagatccaattacttctacctgatttgtcccttgacatgtggggattatggggattataattcaagatgagatttgggtggggacacaaagtcaaccacatcagttacctcttaatttaaaatttttagcaggaatactaacatatgattcacccagattgttataaaatttaatcacataatgtcatataatgtgaaaaaaattatataatgtaaaaattgtttaacatagtttattgacactattgagtgacagcttttattagtattattaataaaataaaaattgaattttcatattactgcaattaccacagggtctgaaacctagtagttactatacactttttattttgaatcttgatatatacatacagcagacattgtttttcaaaacaatttctttctcattagtacagaaggaactttggatgtgggagagaaagacaaggagaaacctgaaagcagcccagttatgacaatgaatggtaagatattctcctgacctgagatctgcttttacggagtaaataaatgaatgttacatgagcccagtgcaaaacaagcagggtgtgattatgcaggcagtcttggagaagttagcaccattgtcagctctgagggatcataggagtagaacagctaccactgaaagtaaaaaggaatctgaatccagttgttgacaatgacaagtcaagttttaaaaaacctgagtagaatctgctgctattttaataatggttggatacactgagcagagcctctgacagaggtaggatgtgttaagccctggggttccctgcacagtgttgcagcagagtagtggtccctcagctgtgagctaggttaagacctgagactgaaatggatacatttaactcatgcccaccccaatcccaggcaaagcttttcaagtcttgattggtcctgcctctctgagggttttttttttttccactttaagtatatttttgaggttcagagccgtaagaacatatcatggaatttgcccacaagtgataaagtatcatctcaaatttgggcttaacttgtgttggggactcatatttgccttagggagttaaaatttttactatgtaagatagggagagagatatcaaattatggtgtatagaacatctgctttaaaatcatttggaaaactttaaaatgctgacttctgtaccttatctttgacctactgaatcagactatttgagaaatgaatatgaaggttgattagctcacagagttttactatcctcatgattattgagaaaccattaggctagtggctctatgaataggttagcataataaaagagaattatcttcatcaagatccaataatggtagttgctaccatctttatctgaccattgagaaaactgatgtaggaggagttgcaatctgccaaagacccaaaaggatatagttacaaaagaaggagattatttgtttttgtttttttgttttttttgagacagagtctcgcgctgtcgcccaggctggagtgcagtggcacgatctcggctcactgcaagctccgcctcccggggtcaggccattctcctgcctcagcctccctagtagctgggactacaggcgcctgccaccacgcccaactaatttttttgtatttttagtcgagacggggtttcactatgttagccaggatggtctcgatctcctgacctcgtgatccacccacctcggcctcccaaagtgctgggattacaggcgtgagccaccacgccctgccaaaagaaggagattatttgtctttgccatgttctaatggaagtagaggtaagatgcttactcagattcttttctccctgaatcagtgggggacatttccatggaccaaggaagagggatgatttaggccaaaaccctaattttgattatttgatgataatttatattaaaaatatgaaaaaatagtaaccaagcacaaaataattatagtaccttgaatgagtcctggtagcctctgctgtctctgatgatgtcaagaaagtcaggggcattttccaggggcaacagtaactattgccttaagtttgtattttttattcatgttaatggaattggaaaaagcttagattttcgggaaatagtaactcacaagttaccaagcagatggcaatttcctctctgcctcttgcctaaaaacacactttggatgcgtcataagcaaagcccaggcccagttaaagctctgttattcagtccggaagcagttgcttctgtatttatcatggtgctcagggtatagatatagatcttagacatttttagtgagatagtttgaggagcctgtagaggcagagaaatcagtatgaaatctgggagaaaaaaagggcattcatttttgaaacaggtataatttataggaatggacacttcaatccttttctttagaacacagttttcatctgaccagtttgcttcttgcattgcccagaaagcaatcgatcatctactcctttttttcaatgtgatcaatagagaagagtgtgctgacttagagaagagattctcaaacttcaatgcacccacaaatcacctatcttgttaaaatgcagatcgtgcttcatcaggcctgagaatctgcatttctaaccagctgtcatggctgctggtctgtggaccacactgcaagaccaggacttagagcatggtcagttgcccaagttcacttgagaccatgagaacattactgagcttctgagccttcatttcctcattttaaacatttgcatataatacagataatgaaagtgcctaacatataggactattttaagtacagaatatagtccacataaagtgctaaaataattaattgtcacatcatattctatcagtaaatgtttgctatcattattaggcatttgctgtgtgccttctatatgctagggttctaggaaaagaattagaagatgtgctttttgtttcttaaatctaacaacctagaagcggtcagtaaaataggttacatagaggcacataaatctaccatgagttagcagatagatgggtgcacgcttcaatggcaggaatactggtcatggagtaaggaagctggtttccctattcccttgtcgtaaggaattttgtgaaaacctctttcattttctggattgttgtctcatcctttataacagaggaattttacccagctgcatagttctgatggcagtgtctgctgccatcatgcctgctgcagcaggagcaagtgggagccctgccccttctgaattgggatgggagattcccgtgccactgtagctgcccaaactgcagctgcagactcaggcctccctgctctagggagcaggcaggagccccactctcctgggtggggctacagccacccaaactgcaaatgtggatctggccaccctcccaagcacaggatcggagtgtctctgcagcctgcaccctcaggtgcaccaggaaggattccccctccatccctacaggctcaggggtgtctgctcccactgcccagcctctctctgctcctgacacctccaatgtcagagcagggttggagccaagcccaggggccatgaatggcagcaggaggcagacagagtcctaggcggaagtgggtggagtccccagtaaggtcccattctcaggccagggagggcccaaaggctgggggctgggctgccagtttctccaaccagagtggcaactcatagtgcctcttctggcccacccatggccgcccatggacccattcacatgtacttcccctctctgaggtccataaaagccctggcctcagctgggtgcagtggctcgcacttgtaaccccagcactttgggaggccaagccaggtggatcagctgaggtcaggactttgagatcagcctggccaacatggtgaaactccgtctctactaaaaatacaaaaattagctgcacatggtggtgggcacctgtaatctcagctactctggaggcggaggcaggagaatctcttgattctctgtgtgggggttctgatcccacatttcccttctgcactgccctagcagaagttctccatgagagtcctgccactgcaacaaacttctgcctgggcatccaggcatttccatacatcttttgaaatctaagcagaggttcccaaaccttacttcttgacttctgtgcactggcaggctcaacaccacatggaagctaccaagacttgaggtttacaccctctgaagccacagcctgagctgtacattggcctctttcagccatggctagagtggctgggacacagggcaccaaatctctaggctgcacacagcacgcagaccctggtcccaacccaagaaaccactctttcctcctggacctctgggcctgtgatgggaggggctgccatgaaggtctctgacatggccaggagacattttcccccatggtcttggggattaacattaggctccttgctacttatgcaaatttctaaagcttgcttgaatttcttctcaaaaaatgggttttccttttctactgcatcatcaggctgcaattactccaaacatttatgctctgtttcccttttaagagaatgcttttaacagtacacaacttacttcttgaatgcttttctgcttagacatttcttttctgccagataccctaaatcatctctctcaatttcaaagttccacagatctctaggacaggggcaaaatgctgccagtctctttgctaacatataacaagagtcacctttgccccagtttccaacaagttcctcatctccatctgagaccacctcagcctagaccttattgttcatatcactatcagaatttctgtcaaagccattcagcaaatctctaggaggttcaaactttcatacatttttctgtcttctgtgagccctccaaattgttccaatctctggctgttacccagttccaaagttgctttcacatttttgggtatcttttcagcagtgctcctctctactgataccaacttactgtattagccagttttcatgctgctgataaagacacacctaagactgggaagaaaaagaggtttaattggacttatagttccacatgtctggggaggcctcaggatcatggagggaggcaaaaggcacttcttacatggtgacggcaagagaaaaatgagaaaaaagcaaaagtggaaacccctgataaacccattagattttgtgagatttattcactattatgagaacagcatagaaaagaccagcccccatgattcaattacctccccctgtgtccttcccacaacatgtgggaattctgggagatacaattcaagttgagatttgaatggggacacagccaaaccatatcagggatcttcgcaaattatcagatgaccctgataggtatatagaggccttccagaacttaacccaagtattaatatgtgaactctcctggaaggatgtagtgttactttggaatcaaaccctggccaacgctgaaaagcaggccattctcagcaagtggcaaataattttgaggaatgagctttatatcttgtatagcacgagggaaggggaggaactttatccagttggaagaatagcagtaccattggagtaccctaaatgggaccccaatgatgaaatgggagagttgaagaggaaacactttaaaatgtgtgtatattagagggctttgtaagggactgagactagacctctcaatctcactgggctacctgtggtagaccagggatttgacaggagtcccactgccttcctggaaaggctaagaggggtcttggcaaaacacacccttctctcccctcattcaatagagggatagctggtcctaggggatgagtttgttactcaggcagcctctggtatcaggaggaagctgcagaaacaggacataggaccagtagtactttagaggacctcctgaaagtggccaccttggtcttttataatagagatcaggaggccagagagagggaaaggagacagaaaaaaaagcagagagtctcatagccaccttacaggctcagaaaccccagagttcctaagatgtacttgttgacttctgcaaatgtaaaccactggaggtcagactgttcctgagacacaggtaaccaggtccagggctggtctttcaaatggtacagcaaggcttatgggtcccagggttcttttccctggctttggtgattcagactgccattatcatccaggagccttgggtgattatgggtatcaagggaaagaggatggatctcctggactcaagtgcgcctttcattctctccaacctaggtccccctctcttagcatgactgtgaggagctcaggagaagccaaaactcttagttgtcacctctttacgtcaggaccccaattcctgggactgctattcctgggacttcctttatctcccttgtttgaggaggacctggccccacagctttgcctgcttgtgatagggaggcaacagaggagtgggccctgccagttgctagatgcaatgtggcaagggtcatttgggactaatttaaagggttcatataccctcctgaggcaccttttatcccaaactttggtttgaagccctgtaatggaacactagacctaaggcagatgacagtgggagttgagggtcacagcacaggtgagcatgactaattcctgccaaataggccctcccacttcacggatggaggttatgctcatggtatagataaggtctaaggaactcacagattaccgagagtgggaggcttaggctccactcagatgagtgtgaatattcctgtcagctatgcttcccacttcatgggtgaaggttgcacttgcacccatagttggcacctgcacaagtcactgggactcagggatataaggtcaggagaagaaagagggatgccttttcttctcttcatcatgtaacctgggtggttgctgggatggtgaaaggaacaaagggatgcctttttcccctctttccagatgggtaaccaaccaatcattttcaacctgccctcctcaagtgcatcctaaatcactggacaggacttcagagctcatggctcagggaaaggaaacccagaagcctgaaatgctggcaaaagtggaaaggttcttgccattcagactgtggcttctctctttctgtgcaaactagttgcaggaatgatataaatcacttctttacttaatttatgagcaccgttttacttataagccattttggttgacacaatatacatcaataaacacaactagacatatatacccacacacaaactaagatccaatagcttggaaccctggccatgagatagcaacatgagctcactggttttactttgtttgtcccaataggtaatccaatgaaggctgtaaaccaaaatttcaggtaaaacagtttccatatcaatttgatttaaaggtcaaatctccccagaattcgaagaacactgaggccaaacagcaccaaaggagagtatcacacattaagtaaagaagtccttcagaattgttaggatacatttttgtctggattatgtttgtctactataacatctaatggagactcctgaaaatagatttacatacaagatgtaaggaaagtaaaatgtgtctttagtaaaagaatatgagaaagcatgggaatgtaaatttttgcctagttcagagggttcaaagattgttttaaatgagataagagaaaactaaaggttcaaacaagttatggaaggtttgtaaaaattttgtaaaataagtgtgtaaatatattgactaaattcaaaagggtatttggtttttccataaattgaacattggaataaatgcacaacaaggttttcttgaggatttgtctgtaaggttttattttttaaaaattggggtgaaatttggctttctcttgaacacgacttttgtacaatgaaatgtttttgtttgcaaactatcaacaaaagaagggaaggacaaaagacagattatttggaaaactaggtcttctgtcttaatgagtaaacatttttgctttttaaaataaatttgagtcatcattgtagctaaacggatgacttatggcaatctgaaattctattaagtgtttgagtctttacagcttcaaaattgcctttcctaactcccaacttttggaagctacagagggaccctggagtgtccaaagtagaggtaaacaggattatttgacatgtttagttatataggattattgaaataaggtggtgcttgatcttcaggttatattttagtgaaaaatgttaatatgtgttccaaaatagtatgagatttctggagtactgatgtctgagtctgtgttattaatcataattagggtcattgtgttaggttatcgtaaatcacagaggtgaccaaatttctttgtcaattatgtttttgactgtaactaacctaggacattttaacattcatagacaattgttgtcttgttttgatcctcttcaaagaatggattataaccctcaagtgcaggtttcttataactttgaagattgtgaacaggagttgagtaggtaaactgaactattggaagaccaatcttttttgactttttgcttttttcttggaacagtgctgatccttatgtcctgtttttcagaatcaagggtttttttgagctatttgtggctttaaacaattgtagggtgaaccaaccagtgatctctgaccacagctcagaagaaacaaaagggatgggccatcaaactccaaatggtcacaaagatggagccctggatgatggctcccttgtactggggacctttagataggacccaccgagagagagacttgactgtaggtttcccagaacaatgctccttgtcagcatgaagcagttaagagctgtcatcgtctccatcctaacagcagttaggtgtacctcttcagaggggggatggatggcattggctgccgccatcatgccagctgcagcagggaagtgcagctggggctgcacactccatggagcaattgggagacccttctgagttgggatgggagctccctgtgccactgcagctgcccaaaccacagctgcagacccaggcctcctgctctacggagctctgcccaggagggtggagcagagctccgctgcctaaactgcagctgtggatccaagcctccctgtgctcttgggggagctgggaataggcaagatctgccctctcaggtacagctgcagccgcggcataagcggctgcagacctgggcttttggctccgggaagcaggcaggaactagggacaagcgggagccttgctccttttgagttgggggcggaggtgtggtggggtggtgggagatcctgggcgcagctgcggccaccctcctaggcacaggacccaggtgtctctgcagcctgcaccctcgcacgcctcttgaaggagccctcccccacccccatccttgcaggctcaggggtgtctgctcccgctgcctaacctctttctgctcttggcacttgatacaatcttggagccgggttagagccaacctctggggccatgaatggcagtaggaggcagacagagtcgtgggtggaagggggtggggtccccagtaaggcgccaccctcaggccagagcgggcctgaaggtggggggctgggctgccagtttctcctgcctgagtggggactagtggtgcctcttccaggccctcccatgactgcccatggaccaatcagcaggcacttcctcccctctgaggtccataaaaggcctgggctcggtcagagcagggtaggggactgccagaggaggaagagagcggaggtttgagagatgaggagatgaccagctgcagagaggagcaccctctctgctgatagctggagaagatgggatgagagacctgcaaagatattccaatgacttgcctgtggagaggaaccaccctcttcagagcctcctctctgttcagagctgacgacctgcctacagagaggagctacccactcttctgagctgttctaacactaaataaaactttttttcttcacctttcagttgtctgtgtacctcattcttcctagatgcaggataaaaacttgggcaaaggtgccacagccacagagctttccagccagaaaaatggacaccccagagatcccgtaactgttccatcccccaagtcatgacttattagctttgatgaccttagtcaagtttcttgaactcccaggctttattgtcctgatttacaaagttgagataataagatgacagttgcgaggattaaacatcttagcagaaaacatttggattatcatcttgcttctttaagcactcaataaatgcaatcatcattgtcctcctcctcctcctcctttactagtcctttttccttactattttttacaaactctgtgaccttagtcacctcacattagccacgactcatcgctttctaaaatgttcaactattaatatatattggagctatttttacttttttttttgagtggtttctgaaacaatcaaaagattaaaccagaagtcaacaaactgttttctgtactagaccaaatagtaaacattttaggctttactatagacaatatagtacaatacacaaatgggcatggctgtattccaatcaaatcttatttacaaaataaaataaaataaaataaaataaaataaaataaaataaaggtaggtcgacaggacttagtttgctcacccctcctttaaagtaaagaagctgtaaatgttctgtgatttataaggaagtaagtttcacccaacacaaacctgtgatccatgaaatgcaacataatattgtaggaaagtcagtggctctgtgttctccagtagtcctgccttcaccttaagaaccccatagccttagaaccagtcttaccttggagaaggatcaaatctctcttttttaacagctatattaaactgtggcccagataggggaatttatttattcaaagtcagcagctccagggatagagccagcaccagaatcttgatctcctggctccaaatcagggactacatattttctctttagcttgaaaagagaaagaaatcattttcctcaggaaaaaaataacttatttccactagagttttaatatagaaatatgttttttaaaccttcttgttaatggttatgccacagtcagacatgaaaacactgctatatctgcttaatgggaataccagtcccctgtccttgtcacttggatctcatattaaagatctcctttcatttctattgagacagaaaaacaccctctccttctactcacatctagtcagattccagaatcatttctttggcagtaaatcagtagtgaatgaaaaggctactcacatctatccatatcctattcccaaagaagaaatgggaacagaaagccctggaatgaatacaagcttccttctgctaggatctgaatggaaatacttctctccttttaatatgccatctgtgtagattttcatggagttccttttcttattttcctatcctggccttgctgaactctgataggataataataataacaacaataataacagttatgatttaatgagaatgtactgtttaccagcattatgccaaatatcttagtcatgtgtgagaatattctgaatcccattttatggatgaagaaattaggcacaaggagggtaagtcagacatgcaaaaagaggattatgacttcagagcagatgatttaaccctgcttagattcttcctgcaaatagcaaagaggtaaaccattttgatataaacttaacgatgtgtacctatacaattccatttatatgaaatgtccagagaaggtaaatggtcagagataaaaagtagattagtttttgcctgaagctgggagtgggaatggggagtgactgcaagggccatgaaggatattcctggagtgatgggaaagttttaaaattgggttaatattattattattctgagacagaatctcactctgttgcccaggctagagtgcagtggcatgatcacaactcactgcagcctccatctgctgggctcaggtgattctcccacctcagcctcctcagagctgggactataggcatgcatcaccatgcccagctaagtttttgtagagatggggtttcaccatatttcccaggctggtctcgaactcctgggctcaagcaacctgcccaccttggcctcccaaaagaataattgtgtgattatagacatgagtcactacacctggctttaaaatggattataataaggctgggtgtggtggctcacgcctgtaatcccagcactttgggaggccgaggtgggtggatcatgaggtcaggagatcaagaccatcctggctaacatggtgaaaccctatctctactaaaaatacaaaaaaaaaaaaaaaaaaaaaattagctgggtgtggtggcaggcacctgtaatcccatctactcgggaggctgaggcaggagaatggcatgaacctgggaggcagagcgtgcagtgagccgagattgcaccactgcactccagcctgggcaacagagcaagactccatctcaaaaaaaaaaaaaaaaaattggattataataatggttgcacaactccacaaatttgctaaagatcattgatttttctttttgcacatgagatgaatgaaacttatggtatgtaaattaagcctcaacaaagctcttaaaagattaaacacatggaacagaaattgtgaaggcttttcttagtcttcatggctgctcctcttgtgtgggcatcttcatttctctttacagccacaatcagatttgaccatagaaaggtcccttctctcccaggattgttaactaccaattctttgatgatagaatatggacagatgaggattaactgcttcctcaatgctaatttattgccaaagcaagaatcctggaatttgagtgggtgcaaatagaggaagagggtgcttcttcactttaatagaaatgagacttttattacaaatggcatatgataagaacaagggactgtttttcccattaaacaaacacaagcatattttaatatatcttaaaaaggtctctatttcaataagcgcatttatgtatttgtttatttacttgacatgcattcaccaaatccttcttatgtgccaggcacctttcctgactctggggataaaacaatgagcaacctagtcattacccttgtcttcctaaagctttcagcccagcaggaaatcttaccttcttctttccatcttcatgaaaattctacctattctcccaggctctaactctattgggaggtaacccctccaatataatccaccacatcattttttctacctctctcttatgactccagtcatgtctacattgcagtggagttatatttgtttactactaattgccagaattatctcctctacaagtctataaaatccttcctagtagatgctgtgattaattcacctgtttgtctgctgagtactcatcataatattttacacctaggagataatccataagcctctgttatatgaatttgctaatttatccatgagccacatattttagataattttcaagcaacaggtactgttctgggcactaggagatttggtggtgaacaggactagcaagatccatgtcctccaggatcttactttagctttgaggagacagtcaatgaacaaatgattagaaagacacagtgaatttggataaataaaggatattatgaaggaactaaacagagagtaacttattaggggtggactgcagggaactacttcagcaaggatagtcacagatgctctctttggggacacagtatttgatcttagacatgaaaaatgaaaaagaaccagccttatgaatagttaggtacaataatagtctaggtagagagaaaagcaagtaaaaagacccagaggcaggaaagaatttggtgtttttttaaggaaaacaggaaatcaggccagtgttgctaaagcctagtgagagagaaaaagaaaaggaataggaagataggaagaatcaaatcatgaaaggccttgcaggccacaggaaggagtgcaaatttcattctatgagcaatggatgaaggacctttaagagcaaagtgacgtatatgttatttgtagtttagtgaaatgattttgtatgatttgtagcaaacgtataatattttggggctaaagcagtgaaatcatgaataaatactttttttttttttttgagacagggtctcgctctgtcacccaggctggagtgcaatggcgtgatctcggctcactgtgccctccacctcccatgttcaagcgattctcctcatgataaatactttgaatgtaaagttccttaggcaggagtctggagacctgggtctggattatagagtgatctcagtgttatcagacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttctgttccattgatctatatctcttttggtaccagtaccatgctgttttggttactgtagccttgtagtatagtttgaagtcaggtagtgtgatgcctccagctttgttcttttggcttaggattgacttggtgatgcatgctcttttttggttccatatgaactttaaagtagttttttccaattctgtgaagaaagtcattggtagcttgatagggatggcattgaatctgtaaattaccttgggcagtatggccattttcacaatattgattcttcctacccatgagcatggaatgttcttccatttgtttgtatcctcttttatttcccttgagcagtggtttgtagaggagaaatgaagggctgggcttagctctctgggtcaggaaggatttgtcagagaacaaaaatggtaacttgcgagacattagagaaaattatctctgagagaaagacaggctcggcctaacgtgtctttccttgtggttacattatttggtgcttgctgggtgacaaatcatccatttttatcttttatgtaactttagttttgatgttaggagctaagaataactaatacccaagagggtatgaccctggagcaaggcatgctgggaaagcacatttctgggtgcatgttgcctctgtgcctagagacatggattcaaataaaagtcacagctactgtcccaccgggggccattgctttggaaagtttaactgagcttttgaatacatctttgtttgccattcttattcaaggttatccaaagacaaatctgcttcaagagaggagaaagtagtaaatttaaatggacctttcaaacaacgttcagtctaaaaatggagaagctcaagatcaaatacgtatttgaaatcactggctaagaaacaaaattagtgttttcaatgggcatcgtttccttggtcttgctggctcagaagagcaagtgcaagggttgagaaattctgttcttgctcaattccattaatggtcaggcagttgggggaagaaagccaatcacctcccatccttttctgactatttttgttgtctagagttatgtccataagaggtcaactcgctgtggctgaaaagaagggagcgtattggatatttagttgtgaacttttgcatgcataggctgagatgggctagtcagagattaatcatacctgtggggccaatttgttcctttcaacaatcatgggagggaaccatgattattagcgtctctactttatagatgggaaaacagattcccaagaattttggtgactcacccaagaccatacaataacctagtgacagagtcagaatgtgaactggaatctccccaatgcttgactatactacaattattggaggacctaatgatcttttttatcttaccaaaaatcagaagaatgtttagtgaccaaactctgcatctggtcttatttctcttgacctctagactgaaatgttcccaatttctcctctttctgagccatatagcattgccagctggtaacttctcagtaggcttagtgagatcaaatatgtgagagttttcaaattggggtgtttcagcttcaacgaccatcatgtgcatccctggaatcccaggacactggggcatagacaaagcttaaccccatcatattatttgacataaggggaaacagattcagagagaaagaaggagttgctcatagtcacacaactgctgtgacattgcatgtccatcggtgttttccaagaactgatgaaatagatgttcaaggaagctcaaagagaagagataaggaggaaaaacattcattattaacaatctctgtcacttccttgctgtgcaatctctgataggtctcttaaactttttaattctcagctacctcctgtgttaaatagtaatcatattggaaaataccccaaaggtatatgaggattaattgattctgtgtatgtaagtctccaagcacagggcctgaccttagtagaaatcaatgcataggagctataataaggtcttatcaggtcagaagcacagagagaaggagtgggtttgtgagcttgagcgggacattgctagagggagctgagagagtgatctgaggggatgtctgtgagttcccacagagcagttcagtttgggaaaacagaggggtgaagataacaggaaaaaaaagggcatgtcctttggtaaattgcttattgttgcccagatatcactgtggtaacaaggaaagcccctgaaatcagtttgtccacagctcaagatataactccccagggttttcagtggcaagttaaggggttccaaggaggagccaggaatgaggcagtcacagatgggaacatttatttctttgagagtcttccgtttaagatgttctcagagttttggatgagctaaagggctcttcaggctagaacttggtcttggagggcagctttccttccacctggccatgtttatcttacttccattagaaggcaagatgccaactttcctattcaatgaagtgtttagattccatgaggtttgtaaatagcctctgggaactcctttctgaaacttcccataggacttctaaactctccttaatcagagcagattgcaagagcaaatgcttcttattatgggttttaaaaaggtgagtagaccatagataaaaatcatagtaaaagtgggaatttgaggaaggtctgtttgctcaggaaaattttctaaatttcaaggttataaatgaaactgtagatgatcactcaggcaggatgtggtttagtttcttcatgaccatgataatgtttttcacataaaaagataagtagtactcatagaatgatgtagagaaaatcattttgtttgaaagaataaattgttcaagcatttgtaggcagtcattcagttttaagtagctacagacaacccttatctgttcagttacagacaatccttatctgttcatggcaagtagccacatacttttcaccaatatccttttctgtagctccccagtgaagagttgacattaaagttccagggtggagttggagtaattttgttttcctccaggggacacaagtgcagagaatggataaaacacaaacactaacagagaatagataaagcttcactctttaatgccacctcctggagcccatatgaaacccaagagtgaagaaagcaaagggttcttaggcataatagggcattaaggataaccatctcttatttcttttcattccagacagggtttggcctggcagttcaacctgattgcatgaagggttgtggtaggcagagatgtctgattgcctttgaattctttgttttctaaccagaggggagatagttctttcaacagaaagtcccagcaagtgcaacaacaaccgcggcctggtgtgcctctacttgccttggctgcctcagaaagagccctgaacactcctcctagggcctgtctatgaaaccaactggatgtagtcttattatttatcagaagttgccaagcaagcagtggtagacagcaggctttcagggaattatcccagggattccttaccagtcttcaaccagatatcacaccagagcaatacatattccccatgcaagaagcagagtaagcaatccatacccttagatacataacactgattagtgcctctgttgttaaagttatttccctttgtataagatgtattcaatgtttcaatgtttacagtgaatttaagaggtagatataatagttatggtgaaaaccctcattttgcagaagagaaaacagaacattgcctatgcaaaatgaatctaccaaggtccgcagctattaagtgcaaagtacaggatttaaacctgttttgaaaaaattgacaaagtctcagggccttgtcctgggtccattcattccattcagtcacatatattctaactcattcattcattcctttagcaaggatgaatagagcacctgctacgttacaagccctactctaggtactcaggttacgtcacagaacaagaaagacacaaacatttgcctctgcagtaagatatagaataaaatatgtataatgtctccctttccattgtcagccatcaccttgcgcagcacggctttctacttaaagagtgtttattgtgtaggcgaagtgggcacagacaacggacgataatcacaataccagtttaaatactagataaaaggtgctaagtgatctggaagaaagagaggagggcaaaggagatcagaagtgttaggtagaaggacaattacagttttaagtaggatgactatggtagtcctcattgaaaaggtaaatttgagtttgaataagctccagagaggaatctgggaaagagctttccaggcagaggacaaagcaagagaagagattctaaggtgccaggcatggctagagccttgcctgtgagtgacgggagagtagtggaagctgaggtttgcaagataatggggccaaatcatgggggcccatacaggtcattgtgatgacttaggcttttactctgtaaaaactgtaaagtcactgctgagttttgagcactgaagtggcataatcaaattatattttttcaatgattccattggctgctgggttaatattagtttgaagggggccagggtagaagcaaaaaattcaaagaaggcatacaacagagacagtaaaatatgtgcatgaaagccttccagtttgtcctgggtatttatgaagacacctcacattctctttttgcagtgaagtgagcatgatatgactcggttttgcctagaagcgacatcaccatttccaggcctggccctaaaacctgacatgtgttctaaactctgctccttctgcagcaaccattgagaccctgtgttgtggatgaaagcattgtagggtggaaggagctgaggtcctcaatgacagcgtggagcacaaccaccccttcccatgccaaccacactgggctgtgacttgagtagttttggaaactataaaaaagaacattttgtaaaaattccttgtccctctctatttctttcaaccttgttgccagagattgttgagattcacttcctgtttttatttttcaaagcaagaagagcagggcacgggtcaaatgcacctcttctccacatctccccaacagctgcttaaaatcatgcctctgtcctatcacacttttcaacatcacagcctgcctcggggacctaagacacttattatggagaatctctaagtcactctgtgccgaatgtggaaaaagaaaacactataaccacaacaatcattaaaattaaaataaatttgttttccctttcttcctaaaaatatatcaaattattggcaaggtttccttgaacatttcagcatgtttactatttgtttgaattcttttctaagcagattgtcattcactataccagttgttgaaaattatttaaactccccacaccaccaaatatatatatagagaaagacaaatagagagatagatattcttttaccttccttcaatttgatgttttatcagatacctatgtttagaaaatttcaaaggtagaaacccaattagccttaatgatagacaggaagtaaacttttcccaaagaaattaccataattctccctaaacagcctcttggacatagaaaaggggaaatgaggattaatatgcttactacgtgctgggactacactgggaacattatttagaatatttcataaatatcttcagcattactcttagccagcttgtggttaagatggaaggagccagtgctagtattatcttctctgacaaatgataagcaggcacaaagaggtgacatgactgtcaccatcccacactgccaggaagagcatatctggatgtgtggggcacatcactgcagatgctattactttcttttcctggaacagtcagaggtagagaaacactgcaaaactgatccagaacaactgggggatgcatagcagcacagcagtttaggaaaccaccattggatttggccaggactgggtgtggatcttggttttgtccctttctggatgtggtctttgacaatgttgctcagtctttccgtgtgtccttaaacatcagtaatggctatagtatatttaacatggtctctggcgtattatgagtactcaaattgtagccactgtgtttattctagtaccactaaaatgtctcctgattttgaaaggagcatccccagagcattgtgtggctcatttacagatttgtaaaatgtaacatttacctacaccctcaatatctgctgaacactttcaataggcagtgaccatgggtcctccttgaaggtcataactagttaagtcaggaggattcttcaggggtttaggagagaatgagagagctgactcccggaagtgggaagggaatcaccctgactatttcctgtctttgctgctttcctttctcataagggagggctctgggaatgggaggcagcagcatccttgtccatactacacatcctttgttccctcccaccatgggcaaggagggatggattgtagcatagccatgtgagaaccatggagcaaaggtggaaggctagagggcagcagggaatctaattagcactagtcaattatctgttctatgcaacctgatgagtttgctgtcagagggaatgcaaaaacaacaacaaagaatttgtttttcatcttcatctctatgagctcctgtggtgcaactgtcagaaagcacttgccccaaatattttatttattgtcaacttttgcagagaatggagtaattcccatgggatctgctaggtaggttaatggactgagaagattaataaattatagacatggtactttgtgcaatgtactaatgtgtattgaacattatttcattagatcattacaaaagattgccatctgatgatgttttctgttgctataacagaatacctaagactgggtaagttataaagaaaataagtttatttcttccagttctggaggctgggaagtggaagagcattgtgccagcacctggtgagggccttcttgccgtgttacacatgatggtaggtgaaagctcagtaagagaggaagtatgaggggcagaactagctttataaaacccactctgaggataactagcccactcctggcataaaggctttaatccattcatgaaggtggagtccccatgacctaatcacttcttaaagaccacacctcttaatactgatacaatggcacttacatttcaacatgagtttcggaggggacaaacactcaaactacagcagtagctatcccctttttagagataagaaaaatgcatttagcaaagttacatagccagaaagtgtcagagtcagaaatctacccaggattgtctactctagcctcttaagcacccatatctctctattacatctccacatttaaaacaaaagccatggcatatgattctacactgttgaggggactttagggtgcttgctgtttgagcccctgagacaggcctcacatccagtggagctggtgtctggcctcagactgcaagaggagaaagtgcacatctgttagtctttaacatgcatcattgaaattcttgcaaggagtctggatggagctggtgttcttccctgtgcgtgaccttaggccagccagtggccagcaagagagaaacacaccaaggttcccagggaggctctgaacaactctttcccggaattgcttttcctgcccaacctagtgtgaaaggaatgtggtgagtggtacatccagggagatggcctacacggataccttctttgtgtctcttattatctttaggtttttactgatgccctgcacagagagaggtctgtaaagtggcaagcaggagtctgctacaatggaggaaaggattttgctgtatctcttgccaggcccaaggctgcagagggaattggtaatatacttcatttaataatagtgttttaagggacattatcatttcatcctatgtggtagatgtgatcatcttcatctcacagatgaaaagagacaaacctgggattcagaggtacttgcctatgagtttcttacagatttcctcttacaatccagaactgctgattcctgggtcagtgtcctttccaatatggcatcttaggcatggcaataagtgagatctaaaagctagttatttgatgcttggacaaaggcttagggcatgggctttgacctaatgaatcagtagattctagtctaatattttaaaggatttgaaatgattccagtttataagcccctttaactgtcttctaagatgtggctaaacattccaaccttccttagctcaaaagtggacaaaacaagagattacacatgttgatactttgggagtcatagaaaattcacatatacataggcagagtggttctgtaattaaccaaatctttagaggtccaaggttaacagtattgaccattcataattagccataaactcagacattttaaaagcctcatgaaaatagaagtatagttttcaaatgttacagaccccaaacaccagtgttttattgcctacagcaagcatagctcacagatcatcacaaggccttgcacaaaggaagcccagtgaatatttgtagatccgatttaattaatgaaggcacaaaccccctggctttcttgctgggtttcatgacatcttattaaacacactttatttagcaagcttggttatttgcttttttttttttgtctcccagcagattgaatgtaagtgacttggaaaaggaagaggagttgccagaaacagctaaaatgtcagtagaagacttgacagcttgagaatagaggaaaaaataaaagcgaagcagacaaaaagaaccttacctcccccacaatacaacattgggctgctgaacccacaaaaatctaaatccgtttagaatcatctatttaactcctcagagacatgcacaaactattctagagaggcttgtgcctacgaagattacttaagaatgtgttgacacatttggagggggttaatttaccagttatcatttactagaaaggctttttctataagaatatatgaaagagtttcctcggagcattcaaccgggcttctttgtagggtatgtgtactgcttggagctacggaagaccacgtcctagaagtgctgtgtccctgaggcacacctatgtgtgttatctctctggcatactttccaacaaggattcttttctagtctatacattctgattaatttgcagtcagaggcaatgcaaaaagcattccttttcatcctaatctctgtaagctccaatatggtacagctgtcagaaagcacttgccctgaagatttcctttatcatcaacttttagagtaaatggtatagatctgccactgcctattctggtttcaagatttggtcttacatcgtttttttcctttttgtggcaaacaaaatacaaaaacaaatcagcaaacaaaaaatgaaaacaaaggaacagacatttatatatatgtatgtatgtatatatatacatacatatatgtatacatatatgtatgtatatatatacatacatatatatatagacagagagagagagagagagagagatatgtttgcatgtatagttagtgatatggtttggctctgtgtcccctcccaaatctcatctcaaattgtacactcataattcccatgtgttgtgggagggaccctgtgggagataatttgaatcatgagggcagtttcccccatactgttctcgtagtatgtgtgagtaagtctcacaagatctgatggttttatcaggggtttccacttttgcatcctcttcattttctcttgccaccgccatgtaagaagtgcctttcgccacctgccgtaattctaaggcctccctagtcatgtggaaatataagtccaattaaacctctttttcttcccagtctcaggtatgtctttacaagcagcatgaaaatggactaatacagtcagatagatgatagatatagatatagaagtagatatataggtatggatttaatgtaattgttgttagcaatgaattatgagcaaattgtctgtagaatgcaagacagaaagaagccttctttctatgctgagtttatccatattcctatgacactgataattaacactgtaccaattaattaattagtacaattaacatgtattgattagtcactgtccataagcaaagccccgagtttgactgaggtgtaaattcagtgtgtggctctagtatgaatgaatgaataaatcatattgatgtgcgtcatgggggcaaggcatagatttactgtgctaatccacgaagatttcttaaagagttaatcactagacataatgtataatgtcaataatggacataatgatggattaaaaatgtcaatggtagaaataatgatggcaatacagaaaagagttacattttattggatatctggtgtttgtctaaaataattcttactactttatctatactctcacaataaatcctcataagaacacattgagacagaagtcattagctgctcattattgaacaggaaactgagaatcaaggaggttaactcaaaaccccaattcactcagctagtaagtgacagaactgggatttcaccctaggtctgcttgtctttaaaatccctccctcctccacccttctttctatttttcaccctcccccactttttcttctcccctcttctttttcttctcctttttcttcttcttcgtccactccttaatgctagctaagctcatagatgtcttctttgatgtattatccctgatatccttttcaagagtaaaatgattaaaaatataagcataaacatttattgacacctactttttacaaagcactgtggcattaaaacttgcaatttataaaagaatggggcaatagagcacatgtttgctaaatgcttatgatgaatcaggtactatatattttacattaccactttttaatcttctcaataacaatatctattttattctcattttacaagtgaagggactgcagccaagaaagtgtaaggaagaaactggtatagaattacatgtcctgtagaaactctgacttgcctaaatagtaaccaattcaggcaatgtctttttagctgggccaagacacacagaaaggagtgatgctctgaacctctaggactgaagggcttgcacagcccctgtgctcaagcacacacagagcctcaaatggaatgttttggagacattcttata

SEQ ID NO: 14994 - DNA, 9311 bp, Human
  misc_feature (1)...(9311): n = A,T,C or G
tgggccagcccagctttcaactcttaaggccccccatccttctaagagctcagctggccttcacttcctatcttagtctgttcaatcccaatcaaatgccaccaaggttgccttctcttcattatattctgatagcccttttgtaaagtgaagtctgttatgaacatgaaatgaaatgatgacaatatccatatatatggggtgtgtgtgtgtgtgttgtctgaaggattttaaaattctgcactactctttgtaacagcattattgatacataattcacataccatacaattcatccatataaagtgtagaattcaatgattttttagcatattcagagttgtacaaccatcaccacaatcaactttaaaacatttacatcacaccaggccagacatggtggctcacacctgtaatcccagcactttgggaggcacaggggagcagattgcttgaacccaggagtttgagaccaacttgggcaacatgctaaaaccctgtctctacacgcacacacacgcgctcacacacacacgcgcacacacgcacgcacacacacacgtgcgcgcacgcacgcgcacgcacgcacacacacgtgcgcacacagacgcacgcacacgcacactggcacgcgcacacacgaccacacgcgcgcgcacacacacacgcacacacccacgcactcgcacacacacgcacgcgcacacacgcacacgcgcacacacgcgcacacacacaaaattagctgggcatggtgatgcatgcatgtagtcccagctacctgggaggctgaggtgagaggatcaccagagcacagaggtgaaggctacagtgagccgtgatcataccactacagtccatcctgggcaacagtgcaagaccctgtctctaaataaataaataaataaatgcacacctccgaaaaggaaccccatatcccttacgtatgatgccccaatctctatattctcaccaactcaaagcaaccactaatctacttcctgcctccctggatttgcctgttctcagcgtttcagataaatggaatcatacaatatatagcctttgatgactggtttccttcactatgctgtgttcaagtttcatccgtgttgtcacataaattggtacttccttcctttttatggccaaataatttcccattgtatggacacaacacattttgtttatccattcatctgttaatggatacttcggttgtttctattttatgggttttatgaatagtgctaccgtggagatttggatgtaagtttttctgcagacatatgttttcatttctcttggatctgtacctaggagtagaattactaggtcaaatgctcactgtttaactttctgaggaagtgccagactgtgagctctgcactcttttgctactgttgatgcactgagttgttgaatgaggggtcagagcatgcctgaaactccagattaaggggggcccattttcccaagctgtcagatttgttttggaaggaaagctgagtaatttaatgggcaagtcattttaaatattaatttttattaaaataattatatctaatagaaagctaaatttatatcacattttagataaaagacttcacagatctttgagcttgaatatgtccctagaattcctggagttaattgcccgtggtcataaatgtaaagtttaagaaatgtgggaaataaaactaaaaataatattaagtgtcattttgtggttctttaataagaacatgaaatattggagaaagggtgaaaagatgtaatagaaaattttttttaaatacacataaaaagaacatgaaattaaatgatgaaaatatccatttcctttagcaggcaaataatacaaatccctgcttgtcactttaaggattccatagttattcactttaacttatcagtaaccagattctgattattgatttggaaattattctgaataggaatttagaaactgaactctctgtcgcttttttttttcccaggtgcagtacagaaggtttctaaaaaattagaaatgcacgtttacagcaagaggttggagatcatgctccagtaagtttttcacccattatttctcaacaagacagtgacagcggccggaaggagccctggattcggctctgactccttcaaggactggggcgtggctctggccaggccactgccatgctcggaggcctgcttctctgttaggaaagagaggggctggaaccgttccctgccagctctgcactcacctgtgacctgctaggtcagccgtttgtgtttcatttaatacagtgcttcaggatgctggcacagggctggcacagttagcaagcgttaaaacattctcatcaaggacaagttcaaaaatcttagctgaatgttactgtatcttcaagaattattttatatatttacttgttaaatgtgaattctttgtaaaatggtgttcttctagactcttcttagtctgtaagcgatgaattaactttaaactaagtatttctttttattttattttattttatttctatttttgggagatagagtcttgctccattgcccagactggaatacagtggcatgatcttggctcattgcagccttgactcccaggctcgagcaatccgcctcagcctcccaagtagctgggatcacaggctcgcaacaccatgcccagctaattttatttttctggagagacagggacttcctatgttgcccaggctggtctcaaattcctgggctcaagggatcctcctgccttggcttcccaaaatgctggaattacagatgtgagcccttgccccatgaaacggtttaacaaagtaaggtggcctgctagtttagaaggcttttatgctaacatttctgttccttcctttctttccccaaaattctacactgacctttttttttttttttttttttttttgagacggagtctcactctgtcgcccaggctggagtgcagtggcacaatctcagctcactgcaacctccacctctcgggttcaagcgattctcctgcctcaacctcccgagcaagtgggactataggcgcatgcccaccacacccagctaatttttgtatttttagtagggacagggtttcaccatattggccaggctggtcacgaactcctgacctcatgagccacctgccttggtctcccaaagtgctgggattagaggtgtgaacccccgtgcccggcccactaaagcagcagtttagtggctttaaaaaaaaatgatagactttaaatgatgactttgtttatagaagttgtcatacatcttcaaaacagtattctctgtgttgtcattttgattttaaagagcattcctcatacaaaaccagccaacagtgcaggcacagtgattaccatggccgttgaaaaggccagagattttactggttcccacccctggagcctctggttctcttaactcattttgcagagggctcaagtctgccagcgttgaagtctgagtatcttaatcatttttagatccttcacccctttggcagtcaggtaaggctgtggggcgggggcaggggacacacatatatgcagttttacctttgatttcaaggaggttagacaaccccctccccacaggctatcctgggacccccggttaaacagccctattgtagaaggtgggtgttgctgaccagggacttgactacaatagttctgttggcggccctgttccctggggctctacaagaatagaaaacccgtgtggccctggactggccccgctctcccacgtgctgcagtcggggtgcagaatggaagttcacattgctgtggctggtcctcaggagccgtggggagggcagtctgcgggaggctgcggcccttccactggactttcactctggccttcttccctgtcctcctgacaccactcctcccgcctcccctccctctccctcacctcccacaaacacaccagaactattcaactctgaggaacaggagtatgagacagcttccattcggccaggaatgggaggttcccatgtccttaaacttcaaagccaatcgtacccttaaaaatgcagctatttccccagttgtttaaacacttaggattagataggagtagatgtattggtttcttcagagaagccaacagtggatcacatgaaaatggaaccttttttcctatccttttgaatacatttctgtgtttaaaatataatttttttggctgggtgtggtgacccacacctgtaatcccagcactttgggaagccaaggcaggtggatcacttgaggttaggggttcgagaccagcctggccaacatggcaaaaccccatccaaaatacccctactaaaaatacaaaaatgagccaggtgtggtggtgggtgcttgtaatcccaactactcaggaggctgagggaggagaattgcttaaaccaggaggcagaggttgcagtgggccgagatcgggacactgcactccagcctgggcaacaagcaagactccgtctcaaaataaataaataaaataaaatataatcttttcctttgtgctagggtcccacctaagtttattcacacatatgatgagcagtaactgcctgaagatgcaaggagttgattcccactccccacttcccccgcttaatacagtgttgtcagtgcttaactgtcctaggctgaccatggtccatgggttgtttagagtcactgcctgcctttcttacctgcattcagcctgctggtggactgctgtttcctaacacctctgtaccaatggggacgatgttgaaattaaccatcaaaactgtttctctcgatgacagaggcaatgtcttagtgccttctttatccccagctactagcacagaaggaatctgccacacagaagatgctcaataaataccaagtttaattaaagtaggagtgcacagctagtgggcttgggagccatttaaacctagatacctggatttgaatgccggctcagctgtttactagctgtgaggctttaagcaaatcacttaacttctgtgtcttgttttcttcacatgtaaaaggggatccttactaaaattataggttaagataatgtatataaaccacctagcatgatgcctgctgaatagatcattcttgaataaagctgtgtattttccctgttttataaacttaataagctgtatcaaggcaaataagaagcttgtctcaaaagtaaatacaggctgggcatggtgactcctgcctgtaatcccaacactttgggaggccaaggcaggtggatcacttgaggctaggagttcaagaccagcctggccaacatggtgaaaccctgactctactaaaaatacaaaaattagctggctgtggtggtgcacacctgtaatcccagctactagggaggctgaggcaggagaatcacttgaatccgggaggcggaggttgtagtgagccaagattgtgccactgcgctccagcctgggccacagagcaagactccatctcaaaaaaaaaaagaaaaaaagtaaatacagtattctgctttagaactaggacctatcttcagttttattttttcctcaaatatataaagccgggcattttcactaatcctgcatttctgcttattttcagggacatatttggagaagactgtgtaagtgtaaaggatgactctattcttagcgtcacagtggacgggaaaactgccaaccttaacttggagacacgggtatgtagctgctctttcctacgtttcaagacatttgggaaataaagtgaaggcataaataatctgtgctctcacactcaacagtctactgttgcatattggcatttgcttccagtgtttccaacatttttttcacattgttctttttatattattatggttgaagttttccgtgtttttccgggttactgcatagtacaaggttcgcgtgtatgccactccattgctgtcctcttccataatacagcttagttcacctcatcccttctctagtttggcatctagttgactctccattttttaaagaagccgctcttctgtttgcaccagcaagatccaagtggattttccaaacagttcaaaaccagcccgggcaacacagttaaaccccatctctactaaaaaatacaaaaaaaattagccgggaatggcggcagctgcctgtagtcccagctactcaggaggctgaggcaggagaattgcttgaaacagggaggcagaggttgcagtgagccaagatcacattactgcactccagcctggatgatagagcgagactctgtctccaaaaaaaaaaaaaaaaagaactagaggccaggcgtggtggttcacgcctgtaatcccaacactttgggaggtcaaggtgggtggatcatctgaggtcaagagtttgagaccagcctggccaacatgatgaaaccccatctctactaaaaatacaaaaattacccaggcgtggtggtgtgcctgtaatcccagctacttgggaggctaaggcaggagaacccaggaatcaccttaacccaagagacagaggttgcagtgagctgagatcacatcactgcactccagcctgggcgacagagcgagattctgtctcaaaaaaaaaaaaaaaaagaagcaactagaagattattagtgagtttcagtcaaattcagtaccaaatgttgagtagatagccacatccattccttgccaagtaatttgtgtggcatagatgaacttccctggagtatcatttactagatcaaactgtgggctttgatgtaaatgtagtttactagactttccccagtctttcaccccagcctcaagtcatcactaattaggaccgtgctgctgtcaggaagcactgcacgcccacaagtgtgtagggcggccgttctgtttcatggtaatcagtcccaccatgacctctgcacacacagatgattgttcttttttttagtttgagacccggtctcgcagtgccgcccaggctggagtgcagtggtgcagtcacagctcactgcagcctcaaccttcccggctcagtgatcctcccacctcagactcttatctgggaccacaggcacacgccaccacagctggctaattttttatgagatgatggtttttttaaagagtattcatttatcttctatataatcattatagacttaattctaacagtcttgtttgtgcctcactttcagactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggagcctgtttacttttaatgtcaaatggcctttatttcaacagcctgaatactgctaaattgctaattaatttgtccattattctagaactaactactagatcaactgcccattattttagaattttggattcttcttccaggcatgtatgtgcagctcccattgaaaccatcaagatctgccgatagcaaccgctgctggttaccctctcctctggggtaaccaatttgagttaataataaggattctaagttgcacttgaatcttttctgtcttcatctccactgctgctgttcgagtccaagtctactctcccctctgaattcctgcaaccacctccatctcctcccctatagctgattcctggaacagacctggcctcaagcctctgctgcttgaaggccttaatgaagtccttgtgataaagatgaagtccaggcacctttgcttgctctagcaggggctctcaatctgggctacccgtgggaatcacgtggggtgcatcacaagtgcacctgtgcccaagtcctgccaccaggaggtgagttagtccggctggaatgagggccctaggttggatcttagttgtaaagctcccccaggtgatccaagcgagcttgggacgagcaacctaaagaaagtcatgctctacgcccatcgccccgccccagggagcggggtcggcctctgcgccggcgcccctggcccttctgttactcatctacagctccgtgatttcaaggcatccttcccacccgttcgtttttagctcggctgccgaacttcattgcacagttgaggtaagaacgttgcattacaaccacgttttaacaggtnnnnnnnnnnnnnnnnnnnntctctctctgctcttcatagtcttgactatgtctgctaggttcgatctctacgaggttcccccagatccacgaggtgacggccagcgtttccgcagtgcctgttcctcgtgggttgtacaggccctccagagtgacgctggggccaggaggccgcggcgctatcccacgacctcttccaggggggcctggagcagccctccgccccaccgagagccagctgtgcttcccgccgcggtacctgaggtcacactcctgccccatgccgaacgcacctgtctccgcgatcggttagtggtcttagaagggcccccaaccgcttttactccgggaacacgcagcgggagggcctaccggactccctgggggcagccttgctgtgggtgagcaagcgcgcaggcgagcttcttgcaaactgactccaaggggcaagacttcgcgcgtcaccaaagtgactgcgtgggtgcccacgagcccggctcccgcaacccacgggcggccactgcgcaggcgccttctcgtggctggcggcccgcccgccccgcccggctgctccatggcgctgtgcaggccgcgggctgcggaagtgccctgctctggcctcgcttgttgctcttcggggactccatcacccaggtacggccgccccgacgctcggcctcccgccccggcctccctgcggggtcgctgccgagcaggccgaggctcctcgccgtcctcttcggcgcccgagacggctgcgcggaggcctggcacgcccgtggagacaccggaggagtggcgggtcccccagtggctgcgctctccgggcccgcggcgtcccggaggtcacgacggcgtccgcgagagcccgggctccaggcacagacgcgaggggacctcggccggctgcccgcccccgccgcctcccacccgggttgagatgcgcggtcttcccctgcagacgcctcctgggcagcggcctttcccctccgggtccgggttagcggccgcgggcgaccgcgcgctgtgtcccaggaggccccgcggccagctccgggcagaggcgccaggagctctctcgc

SEQ ID NO: 14995 - DNA, 42075 bp, Human
ggctcctattttgactttttaatctgtcaggggtgctattaagtatgtttaatgtttagatgagtgggtatgtcttattacacattcttgcccctctcagacttttttctttaattgttaagccaaatcaagtaccacggaagatacaagtagtcttaagtgccgagtaacttgatcacagtaaaacttttttcttctactagtgaagtaatctctgacttgaaaatagtgtttgagtactatagttgagtgttttattctaatgctcgttatttattggctttcagttttaagggacttgttattagaaagtcagtattttgtatttactaaatagtttgagattctgaatgttgcgtggagaggccagacattttcaggccatgatatggcttgctgaccgggttctcaaatatcacattatgcaggggttcagtgaataaagtttaaagttaaatattaactcgagctgagaatactgggctcttttaaaaattacttttctttatttatgtttggagttagagaggcagatagggaaataaatgtgtcattgatattcaagccacttcctttttcccctctcattttcctaattttagttctttctatgtttaagtcttacatgttttgtttttagtttttttgggtacataataggagtatatattaatatcaagccacttctgatattaaggattttgcagcccacagatagcaggttccagaaaatattatctctatttcattttagctatacagtcttaagtatgtatttttgtacataggctacgtatcttatagtattttcgcaaattgcattttaaaatattttagctgatttgttagtgccttttctgcttaggcagatataagtatcaggtgaattgattgtggaacataagtagagacactgcattggaatgaaaatcagttttataaagttgaacacagattttaaaaatgctgtacatagatttgtttttatatttttcagtaaaattttaggccaggtgtggtggctcatacctgtaatccccgcactttaggaggctgaggtgggagaattgcttgagcccaggagtttgtgaccagcttggacaacacagggagacctcatctctaaaaaaagtgtaaaaataaaaaattaactgggcatggtggcacatgcctgtggtgactgagatgggaggatctcttgagcctgggaggttgaggttgccatgtgaccaatgattgcaccactgcactccagccttggtgacagagcgagaccctgtgtcagaaaaaaataaaaaataaaataaaattatagtttgcttttatgtcattttcccatggcagattatatcattagcccatgaatatatctcccccaagctaagaatctattaatactgtctgtagaggtgtctaataaatattcaaagattgagttggagcagatgatgattaagagtaagtgtatgtttgtaagtctctggatttccataattgtaaaagaggaaaaaagatattaggaagattaagttgctaaagttttctgttcaaataatatgttcaataaacattagtaatttgacttttattttctgtttatctcttcataaggtgcaaaatgctgaatgttttacgtcttaatgaacttaggagcaattaaggagactcatcatttcacaagcttgaaatttaggctattaatatttgatcagtccatttttatcttattaggtaaccattaattttagagttttaaatgaaactgaaaaccagtagcataattcgaccatctgttaaaaaaagaaagaaaaaaaaactgcatatggctttaattgcatttcagatacattcagtggttagttctaagaacaacccttatttcctttcttttggtagcctgccctctccctgcaaatgcagctccatttggtatgagcaacaaggcaaatgcctaaaacaatcaacagatagaaggaaagcattaatgctggagtattagtagcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaagggtatatctgctttttaatttcttattcagtttttatatgtgaccactaatatatttctatgaataagctttggaatttagatattttggattgaaagtgaaacctctgaagagttgaagtctaaaggattaaaacggctatctcacgtgtttttacatttggttgtataccagaaaatgtcatgctgttctgtttcactggcattcggtttagtcttttcagtcctgccgtttaggttctgttctctaatcttgcacattgtaaacaatatagatctaacagatttcatttgttcgtcacttggatgtggtaaatacacattgctgtttttgtgtttcacagtgacatattttccgtgactattttaaaaaaccttacttggtgtagttgaaattctgtgcaaaggtttgtaggtagcaagatattgtgtttgcagtaagcctcttctttgaaaatctgatttgaacctttaaaattattaccaactttcttttaatcagattatgtgcatcttgaaatcattcaaattacacagtataattacgcagtaattttaaatgcatgtctatatttaagtcactaacctttgtccttgtaataaccaatcagtgattttgatcccttttcctcccccttgaaagcccagatcctttcaaatctcagtggatcattgtgtaagaatttaagcctgtaaatggtaaaatgttgactagaatatttaaagaatattttattatgtagatggttaaatctacctttttttctttaaaagaaagtggtaggctgtatatctgaccacttataataaattacctttaaattattagagctatttttaagtagtccaaaatagacattctacgtaagcaatttttttcctggctacattcaagttttataattaaaaaaaattatttccttctagcaggattggcaacaatatttctaaaagtatgtagagctaattacagtaacttttacaatgtctttttaaaaatttgttcaataaagatgtggggaaaaggtgaatttaagattgagaccatattgagacattggtaagattttatggttgcaacttaaaaaataatagaaaacaatacagctttgggttttgcctttaggatttctttacatgtgaatttaaagagaaggatttttatttcttcatcctgttagccgttgacgttacagattgatgaattgatatatggtagcttttgctaagtgaaaatgatacaaatgataataatacaataaatacaggccttaaaagtaggtgaaaagtcgtatcagggctcattctgcaactattaaggttctttattaataacttaagtcttaaatcattaaataacatcttaagttctttatttgttgaagtaatttaaaggtattatgagacaggagaaattaagttccaatgtagttcatattttttccagagatttgtttgattatttttaggtactcaaatgtaaaattgaatttactcctgaatatctctggggagcctcactttgtaagtggaatggcctaatattttttagtacctgtctggctgttttggtcggtaagattaactttgcctgtttttctgagtcagtggttaaattatattttagtattttctctatcagcagacaattttattattacagagtaatatttaagattacagagtaaggtttaagttggaaatcactgagaagttggaagctgtcatggaatgagtttttcctcatctaaaaaaaaaatagtttgacagcagagaaggagcctaatctagggtctaggtaaatttaaaaaatatacttaggcatttttctactgcattctccccctgaccaccagtatagcatagtgacagatttgagagatgctctgatttcagtgttctttaaaaggtggtgtgtgtgtgtgtgtgtgtgtgtgtgtgtgtgtgtgtgtgtttgcttgccgattaactggtatttaagatactcgatctttcaggctgaaagcattaataatttgcattcttttatatattcttcatattttctgtttaggatacttatgacaaatgacatttacatagtattcgattactggggttatatggaaaattttgattaaggtagtcaaaagatttttaggagcttaaaataggaaggaatgggtaggcctagggatttggatggggtaggagaatgatataaccactaaaaagctatagttgagacagtaaataactttctgggtagaacagaatatttaggacaggagttgaaagataagattggtgtggtcaaggaatgtagaaaatttagatgaactagattaggtttcctcatacttctctgtagatgagaatcatctagtgcttcttaaaaatgcagattccttgggtcgtgacctaccaaatcagattttgtagggcctggcaatctgcatattaagcatcctggtgtaattcatattgttgggcaaattcgggaaacagtgatctagggtttaagccttggttctggtatattttgattttggctagaataagaaacttacctttttggttttaatttcctcatttgcgtgctgcccagggttccagttgagaggttctctggttttatggaagagataccctgggccagaccgcagaagacattgagttttggatttgattgtaaaagaaataaaaaggatttggaagttttaaagtagggaatggtaaatgatagcagttggtttagggtgctgcataagatcaactgggggagaataacctatagccacaccagttaggatgactgtagttgtgcccagatttaaagtagataggcttgaatttggcctgaaataggaaggaagaagaagcggcagatttgagaaattcaaggaaggaatacttggcatttggtatagatttgcaggacaaggatgaggtgtaaagactcaaggggcaacatgaagtttgaattagagtgaaatattggcaatgacagtcctttagtattagtagaaatagagctaaaatagaaaagatgccaagttgagtttcagacgctttgaatttgaagtgatgatagaacatctcggaagctcagataaatgacaggtttaatgataaagaattgggagtcaaatgcagagtgaggcaggtgaatactatgtgaggagatttgcactgaaagaactattaagaaagaaaagcctaaaacctgcgttatggaggtctgcggctttagggaaaatgaggaggttctagagcagtaaaagaagcaggatagtgtaactgatactaaggggggaaagaattttcaagaaggaatgggcaattaaatacttagagaagctggttaatatgagtgagaaatggatgtgaatcttgttaaattttaaaagtaggtgcaacactgttctttattgttacagtactctttggatttgtcagttaatgtgccagaggtaatctttgagagaagtttctgtaggatagggaaagaaatgttcctagcattaaaactcaatataattatatctcaagacaaactagttttggaccatttctgcagcatacttccgtgtagagattcttttagggctctctgatctttacttatgataagctactttcattttttgaaagccttgaataaagctcatactgacattttggtagagagtagcaggggtcttgctgtttgaaatgccttactcgggaaggccaaaaaatgcccaacaagggaactttggcattaattaattatggggcctactgattggaacgactctcctttcagttctaaactttgttaaaaccgaatatttaggcattcattagatacattttctagatcttgggttagtagtgcagcactacataggtatgtgttatagagaatttagaaggtaagtagaagagtaaaactcacatcgcatagagaatagttttggggtatctttttaacagggtaatgtgtgttgggagggttttgtggtatattttattctgtagtctttttcctccattaagtatttattttttaaatactgtacgctattttaatgactacaatattttaattccatctagttaaatcaggttattgctaaagtttgcaagtacaggttgaacatccctaatctgaaaatctaaaagccaaaatgctccaaagtctgaaacattttgagcgctgatgtgataccacaagtagaaaattccacacataaatacttaacacaatctttgtttcatgcacagaattatgtaaaatattgcataaaattacttccagcctatgggtataacatgtagatgaaacagaatgaatttcatgtttagacttgggcctcactcccaagatacctcattacgtatatgcaagtattccaaaatatttccaaatattccaacatattctagtcccacatattacagtaatactcaacctgtaaaaacaatgctaaaatgattataactgaacataagtctttgtttctatttgtgattatttccaaatttctgggttatgttatttaggctttgggcgccttttacaaaactgctttccagaaagattgtacaaattgttattttcatcagtgaatgtgagtgtctatcatggatctgtggctaaggttaaatagtatgtattcctttcttacagtttttactctaagatagctatttcgtcagtgttaactcattaaattacttgataagaaccagctttatattgtaagatgtgtaagcagtgggagcaatggtggaaatagcctttctattttatttacccaagtctgtgtactcctcatccttaccagggcccctaactgatctttccactaaattatgtgtgtcacagcgaaattaaaattactcttccaaagtgcaactctaatcatggcacttaagggattttcctttacttacttttcaaatgaagtttcttctgtctatcctggatgtttgaaaggcattccatggcctagccccaacctttataatttcgtctgtcattactccctgtcgctagccacactgaaggactcgttttctaaacatacctgttctttgcctttgcttgtgtttttctctccaccttgaaggccctttcttcccatttcattttgctgaagtagtccttatcaaaggcccggttctccttgaggtgttcactaagcctccctggggaggtagttcagtgttcctcactcccatctctcggttttcattttgtacttttttttcccccctaagggaagggcatgaggggtttcattttgtactttctattacaattatttatacataaatatcttggctctttttccagcctccaaatttttttgaaggccaaaaacagtgatggcttcatcactgggtcttctgattgacttggtgcagcttgtcaatgaaggaaaaggctgagaactccattgttcagccaggtttacttctggccttaaacccacataaatttttggaaaattttaaaatatgatttcaagtgggagcaattagaaaaaggattcccccacttttccccttcttaaaggaacaattcagcaactgaaggaacttctgtagattcagaatttttagagtattcctgcagataaggcattctgttaatcatttattccaactttcctgttttactgacaaggaaaccaagaaaacgagagatttaaatatttgtcaggcccacacaggaccatgccacaggtccatggtggcatgaagcctttgtttttattttataatttatatttgcacttgaataaccaaagattgaaaagtatataagctaaaacggcccatgttttgatattttatttgtgcatagtctacttgtggcatgttattgaatgtcgtatacttctttcgtattgtcctcactgcaataaaaaaggcaggcagttgtctgtcacactaatcatggaagaaggtaggtgtggttagtcatttagtacaggtattgtcaaaaggttaaacctagtgggagttctctgggccaggagaataatttcttttcatctttcaggattggattacatgctgggatgtaggcagaatatctaggcagagaatagaattcttaaatttgttctccggttgtcccctaagttccctttttatgtacagccatctcagtatctgcaggagattatttccagccctccaccccgcgtccccctacaccatggataccaaaatccacagatgcccacgtctcttatataaaatggtgcagtattttcgtaaaacctacgcacatcttgttgagatcatctctgagttactttttacaatgtaggtagttgttatattgttcagggaataatgacaggaaaaaagtctgtacttgcttagttacagatgcagtcatcataggtctagctacatttttccatccacagttagttgaatccgcagatgtggaacctgcagacatagagggctgactgtattcacttggtcccatctcttgctagaatttgggctaagggatgatgtttaatttaggcaatacttttctttgcatccttggagcagtgatctgacaccacatttatacttatttatctgctctatcatgaataaggctgacatattactgagtgtgtgtgtattttttttaatctgcttcatggctttcaagtttgtttgattcagctgccccttaggcattggacgtattatagacactaaaatattttgtgtcgtctttcttcaaatactatatcactaccatattctatataacattttcttatgaagctcaaagcaatttaaaaactgaaaaattaccaaattatcaaatattaatgattatttgtactgttcattgattcgatgaacatttatattgtgtgtacaacagttatataaggttatggaagaagaaatataactgatttacttactagtgaggttcattctgtgttttgaactagtaatttgctttgagctcttcccctcccccaactccagtatattaagcttcaagtttctagagttacaggacagtatgttttccatttagtttttgttagtagaaaatagggttttgagcagtaacctcaggtttctaagacttggtgcctacttattttaagctttagatgggccaacaagaaggaaaatttaaactatagtaaattatacattgaaccagtttattttctaattttaggtttctatttatgcaggtcttgatcaattctagtaacttaataaccacatgcttatcaacatgtatcagaaatacagacttgtcataggagaagttctcattttaacattctttacaattgaaaaatcgttaaagtgagtgcaggtagggagagtcatgtatatccaacatacttaaagagaagatatttagctttaccttagagaaaatgaaattaaaggtaggattattctgtaaagagaaaattatcatggtttaggaaaactaggagtgcaaaattagaactgttttctgcccttttttgcttgttttctcctagtaaagctggaaagagtgtaggattaagggaaatattgaaaaccacatgaactaatgaagtaaactggtgaatttaattataaatgaagcatgtatggtgttattgaacttcacttttctcttagagaaattcgtgttatccttagaagatggcaaacagccataggtagtttttatgttcctgcaacatatttgaggcattttctacttgaaatataggaaaaaaagaccactggctgggccttgtagctcacgcctgtaatcctagcactttgggaggccacagtgggaggactgcttgagcccaggagtttgagaccagtctgggcaacatagggaggccctgcctctacaaaattttaaaaaattagcttggtgtggtggtgcacgcctatggtcccagctacttgggaggctgaggtggcaggattgcttgagcccaggaggtcgaggctgcagtgagctatgatgatgccactctgctccagcctgggtgacagagggagacactgtcttaaataaataaataaataaataaataaataaaataagatttgattgactttatcttggcacataaaaaccaataactatgaaaataaatttattttagttcattcttaacataatttagtttataatcacagccgtgcataaggttttagaatacatagaggatgaatcaggtttttgggatttaggggaatgtaatttttgccacaaaattgtatactagcacaaaatggcttcttttgctttatggttgaatttcacagtgggtcatatataatgtccctttacaaaaaatgttcagtggtttaaaaatgtactttcctgggggctcttcctaatcttttgaagtgagaggctctgttttgaagtgcctgttggactgtcggtgttttttggagcaattctccagcatcactcacaacattaactttgtggaatttcatgttaataggaagatttgcaattttgcactgttgatttgggtggttttatctgacaagacatttaggtaatgagtgaggctggatggtgaatttaaacagtaagggatatttatgagcttggattaattttgaagattacttagtggatgttttcttatttatgaaaattttctttcctatgcaacttcataactgcagggaccatttaacaatactaaacttgggtaagagaatcttgtactcctcaaatagtgttggttactagagagctagagacgcatattttttaaatcacaaaccatcttttagttcatgttatgtggggaaaggagtatgtgtgtgaaaacacactcggtgtttacaacgattttaattgtaaaggccgtttgttctcagtaataataataaggttctatcctgggtgtaggattggttttttaataaaatgaatagtaaacattgacttaacttcacatctttatgtttggcttctgtttcctggagattttctagaaatggtattttcgttgctttatatgctgtgtttgtcaagtttattgcttatttaaaaattttaatatcattcttaaattcaccaatgtcttttttatctatttttatagttcatatgtaattacatagattgttatttatagtataaatttatttttaaggtgagaacaattcagattgcttctagaaaacaatttaaacaaaacatggtttattcctattattgaatctcttaatgaaatttattggtctcacctataactctactcgtagtgttagtaaattgtgtctcctgtctcaattatttaaactaaggtagaaatagcatttggtattctcaagtagcataaaaagaaacttgagtattaatatagtcttttaaatacaaaaggtataatagagtgagaccttcatggtcagacttgaatttcagtttgtaaccctacacaatttatttaacaatatgtttacattacaaatgtacaaatacatttgcatcacatatgtaatgcagataatactttttagagttgttatggattcgaggtaatgtatacaatgtactcagcacagtgccttgctcagactgggagattacaaaattattgtagaaaggggaagtatagaaattttgctgattgtttattagtgctatttgtttgtcatgtaaagtgttattttcttaggtgtggtggttcaaattcgccaaagcactgtaacgttatcaaagtaagacaggaaagatttagtggaagagacaaggacctgaaattttgcacgtatctgtttaaaaactctagttaaaggaagaggagatagccaagacagatgctggcttgccaggtatttggttgagatacttttgtagcagtaacaggtacccatcaggctgagacttgctaattgaaacctctttacatatactttcagagaaagttgaattcaccttttttaaaaaatcagggcttagctaagcattacatataatatttgattgcctttcttgaccttatctcttgagctttagtaccagtgtgttcagtttaccaagcatttccatatgtgaaatttcaattcagcttcaaataatttcttaggggtgggtattatttttctaattttacacacagggaaacagagattacattatcttctcagatcatattgatactaacctgaaggaagaaataggactcaaaagaaataggacttaaggtcctcttaatgtctttgtgaagagagctaaactctgcacagatcctttttgtggaccttcgcctgtcagttttttgacaggtgaatgcttactgtgttgagacaaaagcttactattacgtagtactaaatgttcaattctgaattctaattacttttcctggcatttgggaagaatttgattaagggttgtgattcttaataaatatataattacttattattataaacatggttgtgaaaaacaactgaaattttaataccgttctaatatttatatattcatttgtttatttcctatttaactgccattctcattcctcacctggcattattaaagagaacttaatatttgcttttgcttcaaaagtaggtatttttctgccagccattccctgtcctagtatttttaggaacagccagtttaactccccactgccccgccttcccagacaaaagctttttaaaattgaaacctgacttcgggctgttcaaagaagaatgtaagaatttgatttgaggcaaaatgtaattggatgacttctgcacgtaaggcatgcacaatgcaggctgacactatttttagctatggcagatgacagtttgtgattaccaaatgtaggcagctcttcttactgtgcattgagccagaagtttttattttaaagaaaagatttaagtgtactgagttattttgaattaaaattttattttgataaagatgctattacacacagtcatttttcacatttttatcttggagacaaacggcaaggactgcagggcataaattacttttttctaaactacaagggtttgttaaaattgatgaacattatttttagcaattcataagcattcccccaaagttgtaaatggaaaagtactgctaaattcatctcagatctttgaaaggatgtttaatgaacattttgtatgagtaaggttgaggccacagaatagggttaccttgtatgattaaccctttattctgcagtatagaaggagacttgaggaaccaagaaaagttaaactttccctgtataaactctttgtcttaattttggtttttcaaaaataaggaaccactaaagtgattactgaggaatccaaaattagcattttggtgatcctgtagttcttattgaaaggtgtcctttattttaatttgaaaatgaatttaaatgtttctgttctaaaaataatctggccgctattcagacagtgcagcaagcattaatgatgtaggtaatgggaatataaagatgaaaggcatttatcagttttccagggtctagtaaggggagacaagcctgcaaaacagtgttttcttttttataaattacctgaaagcattatttgttatttaataaatgtagacatctgaaaatagtgtaaataaaataaatgttaagtctaaagcgtagaaacattttttaaataaatcaattagaattagtgacctgtcataaggtattcattcattctaatcagtcaacagtaatattgaaaatttagttgtttttggctttctgctcagctctggggataaagttaggtagtaagacatacatgttcttttatggagtttacaacctagtagagaagtatgttgaaatgactatttttttaaagttttaaatctatttccaggacattttcttcacccccctcccaaaaaaagccccccacaccctctagcagtcactcctcttccctttttccccagcccctgacaatcacttatctactttctgtctctacagaattcataacttgcatattcaaggcacttcatataaacagaatcataaaatatatggccttttgtgactggcttctttcacttagcatatgttttcaagattcatctgggttgtaacatgtatcagtacagtagtttcccccttattcttgaggggtaagactctaagacccctagcgtatgccctagaaactgcagataggactgaaccctatatatactgtttattcctatctatacataactatgataaagttaaatttataaattagttacagtaagaaattaacaactttaacaatgaaagagaatcatggtaacagtatactaaagttaaatgaatgtggtgtctttctcaaaatatctcattgtactatactcacctaatttttaactgtggttgactgcaggaaactctaaccagggaaagggaaaatgcaggtaagggaggactactgcacttcatttcgttttatggcctaataatattctgttatatggatatacctttttttaaaacaatccattcatcacttgatagacatttgggttgtctgtctcctctttttggctatcatgaataatgctgctatgaacatttgtgtgttaagtttttgtgttttctagtttcttgggtgaaaattcctaggagtggaattgccaggtaataagataactctgtatttaattttctgaggaactgccaaattgtttttcacagtggctgaattttacattcccatcagcaatctatgaggcttctaatcttcatcactttttgttaacactttttattgctcatctttttgattatagccatcctagggggtatgaagtggtatctcattgtggttttggtttgcatttttataatgactaaatgatgttgagtattttttcatgtgcttattggccatttgtgtaccttctttggagaaatgtctattcaaatctgttgtctattttaaattgttttttactgttgtaaaagtttttcaatatattctgagtacaagtctcttatcagagaattggtttgcaagtgttttctctcgttctgtgtggtatctttccactttatttgtggtgaaagtttttaattttaatgaagtccaatttatcttttttcttcttttgttgtttctgcttttggtgttatatgtaagaaacaattgcctaatccaaagtcatgaaaatttacacttatttttttcttaaagagttttctggctaggtgctgtgactgatgcttacaatcccagcactttgggaggctgaggcaggaggattgtttgagcccaggaagctgaggctgcctgcttttgcaccactccactccagcatgggtgacagagtgagaccttgtctcagcgacaataacaacaacaaaaagataagaaacaaagataaaagagttttctagtttaagctcttaactttgagtctttcggccgttatgagttaacttttatgtgtgatatgaagtagaagaatccaacgtcatttgttttgcagttggatatccagttgtcctagcaccatttgtttaaaagactgtttttttcttattgagttgccttggcacccttgtgaaagtcagttgaccataaatgtaatggtttatttctgggttatcagttgtattccactaatctacctgtttgtccttgtgtaactactctactgtcttgattactatatctttttaggaagttttgatatagggaggttcgagtcctccaacctttgttgtactttttcaagtttttcttgattttttggatcccttatatttccatatgaattttgcaattggcatgtcaattttcgctaaaagacagctgggattttgatagtgtttgtattttagatcaatttgaggagtgttactgtcttaatgtctttcaattcatgaacaggagtctttccaattatttaagtcatctttaatttctttcgacagtgtgttatgtatagttcatatgtcttgaaattcttttcactgtattcctaagtatcttattttttctatgctattacaaatggaattatttaattcattttcagattgtttattgctagtgtatagaaatacaatttttgtatattgatattgtgtcctacagccttgctggactctcattcattatttctagtagctttttgtggattccttagaatttttaaaatacatacaacagaccctcatatcattgttttgttcagtgttgtttcgttataatgtgcatgaggaagagaaaaaaaaacaattccttgctggggccactgtctgtatgggatttgtatgttctccccatgtctgcatggggttttctctgggtactctgtggtttcttcccacattctaaagatgtacacattaggttcactggtgtgtatcagttgtctcataatgagtgtgggggtgtgtgtatgagtgtgccctgtgatggaatggtgtcctgtccagggttggttcctgccttgcaccctgagatgtcaggataggctctggccacccgtgacccagaactggaataagcagcttagaaaatgaatgaacgaatgaatgaatgaatacagattattataaaataaaaacccataaagtatataataatcatgcaaatgcacaacaataaatgatgcagtatgaaggcacttagagatccctccatatttgttgtttctgaactgtgtggtggtggtaggaggtgctcctaccacagtatttgctttgcagacatttgttccttgatttaacccaccaccactacaaccaccatcactgattcaccaaaaattgtgttttaaaaaatctttcttaaatgtatatatagcttactttatttcagtgtttaatagtagaagtgttttgagtctttatttagatttttttttttttttagagatagggtctttctgtgtcatgcaggctgtagtgtagtgatgtgatctcagcttgctgcaacctccgcctcctgagttcaagttattctcctgcctcagcctcccgagtagctgggattacaggcaccggccaccatgcccagctaatttttgtatttttagtagagatggggtttcaccatgttgaccaggctcaaactcgtgacctcaggtgatctgcctgccttggcctctgaaagtgttgggattacaggcgtgagccactgcgcccgacctttatttagaatatgatgatgtttttgtgaccagaaatatgccatagaaaatgaagtcttgtttatataaattagcctatggtaaaattggttctgttacatgtcatttcacttaaagttgcagtttccagaaagctatcctcaacatttaagtgaggatttactgtataagatcatgttatctttaaatagagtttaatctcttcctttccaatatggatgccttgtatgtctttttcttggccagttgcactgcatagcacccccaggaccagaagtggcaagaatggatgtacttgtcttgttcctagtcttagggggaaagatttttaccatttagtttgatgttagctgtgggtttttgtagatgctctttatcaggttgataatgttccattttgttcctagtatgttaaatgttttatcttgaaagggtgttggagtttgtgagatgctttttctgcatctgttgggatgatcatgtggtttttgtccttatcctattaatatgatttattgtgttgattgattttcgtatgtttaatcaatcttgtatttctgagataaaggccacttggccatggtgtataatcttttttatatgttgctcgatccagtttgcttgtattttgttggggattattgcatctatattcataagggatatttatctgtagttttcctttcttgtgatgtctttgtctgattttggtatcaggattgaacaaacttctaagttaactaataaatctaaattaactaataattctcttgttgaccattagaagcaacagtatttttctcagaaaaacactatatttctcagaagggattttaataaagttctatacattcctcctattgagaatcatttatcctgtataaacaatctttcaaaatttttttattaaaaccaatttgaggaatctgtaagggactagaaattttgttggcaaatgtcaattaagtcagccacactgtttggtatcaactaatatttttttcattcttgcagcttcactaacaatcttttcagcttctttacggaaaaagatggaaattcttctgtactttgcacagtggggttggtggcagtgtagattgcctctcaggtgttcctattctaggatatattcatattatcttatgtgtgactatcagtgcctagttgtctcatttctcttggctgttcttccctttttgttttcctccagggctctaaagggtctgatggctccaccagagcattcctagtacttgtttcagtatgtctgtcatgatacctgctttgagctactctcatgtagctgcttacatatttttattcagtatgtgtgggcttacgtatgtaattttcagagcttttccatttattgaaaagaccgtgttcctaggaaccatatgacaagaggaaaggaagtggtaggttagggcttactatcattgagtactgctgggccttatacatgactattctggtatcattaactttgggaaaattgacttgattcaacgcagaacaccagaatcatcaacttagttatatactgctagaattttaactgttggctggatccaaatatttattaacctaacagacagggtgttctttttccaataggaaagcctactgggaaaaataacactcataagactcttcagtagtaccgaatagaaacagaatggggtgaatttttttctgattatagtcatgattcatgcttgccattagagtgggaccatttcagatggcacagaaaagagtaaagaagcaagtaaaactcattgataatcccgttatgcagagataaaaacactgcttagtagatatactttcagacttcatagttatatgtttaatttcttttcttttttttttttttttttccgagatggagtctcgctctgttgcccaggctggagtgcagtggcgcaatctcggctcactgcaacctccgcctctcgggttcacgccattctcctgcctcagcctcctgagtagctgggactacaggtgcccaccaccaagcccggctaatttttttttttgtatttttagtagagacggggtttcaccatgttaggaaggatggtctcgatctcctgaccgcatgatccacctgcctcggccttctaaagtgctgagattacaggcgtgagccaccacgcccggccatatgtttaatttcttaagtgagaatatactgtgagtctttttgtaacatgctgttttcatttatcattatggacatgtttctgtgataatgtagatctgtatcacttttttttaatggctacacatttctcttgcataaatataccctgattttatttaattagattcacatagtttttaaaagtcatttttcaacaacttaattatagttctctactgtgggaaagtacttatcaaatatattggagtaaagccctgttctcggtttttgggtctaacagtaggtgaaatattcacattaaaatttgtcccttattgattaaactatcttgttaatttcacttagcttttcttcttggcctttatgattcatcttgcatgttgtaattatctgcctacactttgcccatttgttatgcatgcacacgtataacattttgaagcactttaatcagctaagccttcaatttggcatcatacaatggagaatatgagtttttatccataggaatcctgggttcagatccatgttctgccacttattaatgatgtgatctgggtctagtcatgtaggagctgggtttcactctttcaagcctacctttcattaggtttgtttgtttgtttaagagatgaggggtctctgtgtttcccagcctggtctcaaactcctggcctcccacctcggcctcccaaagtgctggaattacaggcataacccactttgcatagtggctcattaggttttaataattgaaagagataatgttgtataggctactgcagtgtttggcataaaggaggtgtggagattggagaatgtagatcagcaatcaaaacatctatcaggcttaagcgtatcatttttcaaacttttaaaaagtttctctcatacagttgccataatgatagagtttataattgcttgaaaaattgtaggaatatgaatttgttattttcctaaagttttaataatgtctggtacttaagatatttctaggaaggttcaaatcagaagactggtatgaataaaaatatttaagcttccttctccccaaaaaaatctagatctaaaaaggaaggaaatattttaaaattatattgagcacagataatgacccagtagtaaaacttcatcggtttggatccactgacagggaatttgaatgcagtactaatgtgtgtatctttgtactgactgtgggtcatgttaattccttaagggaaaagagagattagaagattaatgccctttatggacgataaaactgaaggccagagaggttggagtcgtatccaaaatcacacaattgctgagctggtacatgctaggatgtgggtctcttgaatcccagtcctgatatttccttctaccatattcatttaggtagaaattatagactaattataaataattcatatatagtcactacacctgtttaaacagtaactctgttataatattaggaagtttgattagacattaatttatgttgtacagtgcaaacctctcaaatctaaagtcattgatttcatggccaggttttactgagtagtttttaatgatggtaaaaaatagcaagtacatctgcatttactttaacttctcaccaatagtgattttgaaggttaattaatgtttctgagcagtttgagaaccacttttataaaggagcatttgttcatatgaaaaatagatttgagaggccgggcatggtagcccacgcctgtaatcccagcactttgagaggccgaggcgggcggatcatgaggtcagcagatcgagaccatccttcctaacacggtgaaaccccgtctctactaaaaaaacaaaaaatcagccgggcatggtggcgggcgcctgccccagctactcgggaggctgaggcaggagaatgccatgaacctgggaggcggagcttgcaatgagccgagatcgcgccactgcactccagcccgggcgacagtgcgagactctgtctcaaaaaaaaaaagtaaaagaaaaatatatttgaggtacaccttacttgctgattcctttgggctattagcttttacttaccctataatagtaaaaacttagataagctttaaaattctttcccatatggtttataaagtaacatgtttacaatataacacaacagtatagtttattaacctaaagttaataataagtttgaaattttcttctttatgtatttactatttaagtattgagtaagatgattgtgattgtggtaataataacagcaacaaatagcactgacatttattaagaatttattgtatgctatgtactctattaagtgctttacattaattatcttactaatgaaaaatctagtgaatcacatctcaatgagatcattcctatttttttattgacaaatcatagctgtatatatttatggggtacaatatgttttgacatgtatacaatgtggtgtgattaaatcaaacttattaaagtaccgccttgttacctattatttttgtggtgagacatgaaatttactctcagttatttgaaatacatacaactattgactgttgtcaccctggggtgcagtaaatctcaaaagttttttctcctttctatctagaaactttatgccttttgttcattcctattttaatatacattttatagatgaagaaactgaaatatagaggactttagtgactttcctgaggtcacgtagctcgtaagttattcaaccatttttttagtctaggtgacccaactatagaacctaagttttctgtttgtgtgtattaagtcaccgttgtagggtacaaaggcagcctcacaggaaagagtgatcctaccaagggctgtctttatcatcactccccgtgttctctcactgtaccctcctaataaaaaaaaaggcattaattattagaaccactgttagcagaaagatgcttacagttaggcctgtacctttaggttttctaggtcgcattcattcttcaagacccagctcagtttccatttacagtatttcacagtcttaacatttcttccagtttttcccttttctgagttcttatagcagtgcaatgtttattttataccttcattgacttgcttttatatgtcttatctttcctagaattgtaatgttggacaagaccttcaagaatcagaatgagttttctcattctgctaggttgagttacttgaacagtttcacctcattaagtgtttgctgattgccagaaacctattagcgttgctcttatctctttattcaatatgacattattcgtaatgtccctttgacaacctatagataggccatttcaagttcttgtcagtcctcagttgtgctagtacaatagtagaaactagtggaatagcactaagcgcctttagatgttttaggcaggggctgtaacaaacaagtttgggaatatttgaataaatagttgaaatcagagtttgaaaacaaacttcgaaatcatatatagaatgttaaattaatagcattcaagccagaccatttaggcaactgaaataagtgtttgaatccctgctatgtactggacacagtgatgggcatttaaaatatcctaaacagtactcatgatatactagcagcagttaagggctttgtactaatatccaacattgtgcagttcacatacatagttttccctacagaagtacccttaagagcaaaggaaagttacatacatcttaggggaccttggggatcaaaaccaaagcagccctaaaactgtgatttttctttgatgtcacctcttcttagaaagagtatatccatatttactataaatttttttctcccaattgttcacagttcagagagagattaattacatcagcctatgaattcaagagcactttggcacacttcggggttctccttgcattgagcataacccgattttgagacatcaggctatgcttacttgatcccctcagtggccctgtggccatgtccaagagcagacatgctaaattgggctttgtctgactccttactattaataaacattatgtaaatgtgtaacacatttacttttcttttttctttgacccctaaatttttatggcattatatttatcaactcttagaaggaagtagcttttcaggtaatcgaaaggctgtttgttttgtctttttctttgtaggaaattcttcttttaatgatagccaggttaagttacaattttgtttctaaaagacagatcttaagagcagagttattactagcacaaaaaaatcaaataagaaaaaaagctcattcatatgtgtagtttttgtatctcggcctttttaaatttattttctgcatataaatatattttggtatcactgaagtatctcattttagtgtgttaatattttttctgttattggaatatatttattgaattatttgaatatatagcatgcattgtatgagatgaaaaaccccaagatgatttttttggagacagagtcctgctctgtcgcccattctggagtgcagaggtgcagtctcggctcactgcaacctctgcctcccgggttcaagcgattctcttgcctcagcctcccgagtagctggaattacaggcatgcgccaccatgcctcactaatttttgtattttcagtagagacggagttttgccgtgttggccaggctggtgtggaatgcctgacctcaggtgatccacctgcctcagcctcccacagtgctgggattacaggcatgaaccaccgcacccagcccccaagattattttaagtaactccttgttttggattagaagtcttctaggctttggagacatttaatcattgtgtatggctagaatgatttggttatgcagaaataaatttgaataaaaaacatttcgtggtcaaaaataaaggtgttatactaatatacaactaagagtgggtttaaaatgtgggttataaagttagtgtttctttaacttagtgtttctttaaatttttaggtttgattttactttatgtagtagcctttttgttttcatagatggagcaaatccaaattgataaaataacattctaatttcagatttctttttcaatttttagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcaggtgagatggctggaaaacaaggcatgcattggcaatagtgtaaacaggattggtattaagacttcatctactgtctatagagttacaagcatgcatttttttgttaaagataattgcagttatttgcttgagctataccaaaaacatctgcttttgagattttctaaaagtcgttttaaaggctcatgatggaggagactgtttatgtatcattaaactaactctgctacttgttaggaatatttattagagttaagcattggttatcttacttgaatgagtgttgtatctttttaacatgggtaggtttgatgaggatattctttattgctttttatgctgtctgataacgtgctttctgatatttcgtatctttctagtatgctgatgttttctgttatgcttttctttatgtattttctttatctagtttcttctcgtttcttaaggctttactttttaattattttttggagagctttatttcagcatctccttgtctctcaactatcatcttctacccttgttttcacaagtatactatagcattatatagttgctatggagacacaacctcagcttgagtcttctgccctcacctcatactctgcgtgtttttccccctcttttttaattgacatataattcatataccataaaactcattggtttttagtatattcacagaattctacaaccatcactattttcatcgcacaaaaagaaacttcctacttattaacagttcaactccccaaccaacgcccgacaacgactaattcaccacgtttttaaatgaacttttcccctcaaacttgttaatttctatccataacaccactaccatgctagttttcaggctcctgttttgatgttatctttgttttcatctcatataaagaaaatcactaaatattgttaggaaaatcacaaaattttgttcttttccactgcttcctcagtctaaccaggggcctgtaaagcaaggccatggccaaatgcagtctgctgcctgcttttgtaaatagtttgttggaacacagccatgctcattcatgtagctggtttcgtactgtaatagcagaattcagtagttttaagagagaccatatggacgtgaaagcctaaaatgcttaactatctggccctttacagaaagtttgctgacccctaattggactccatttgttactacattgacttgtagttacctcggattacttcagttcttacagatgatgtccgattaatttttctagaagtaccactttttttctaaagagaaaaaaaacaaaagaaaatgcaccggccctctatagactgtaggatgaagtccatatgtctttgtcttgtctctcatttaccccttccagagttttgtacccatgttcatgctgccttccttagctgcctcagtcatactttttatttggttcttagtttggttcaagacccagctctttggagaatttcctaaccctgaccccaaatgatccgaaaattcagttcctactgcattaactaagcctttgaaatgttaattgttttgcataaggagatcatttttcttcaaatagattgagataatttaaaaactatttctaacttgttagcttgaaagtaggggaaacaaaggaaaaaactatttgtggcaaggtaatatctgtttgggcatatgactatgtacctacctacaacatgatccagttgatattaatgggtaaacttaaatggatttacagactttgaaagaggagacctactgaattattttgtttattgtaaagactggtgatttttctctggctttctctttgtgatgaagtaatgatgttatacaagtttagggggagagaccaacatttattgaatagctcctatgtgtctaaccttttatgtacatattttaataagtttattttaaatttgtgataattctgtgagataggtggtatcactccattttatggggtgatggggaaaaagttggaattcagtaacttgaaattgtagtttgaaaatggcagagccagccagacgtgttggctcatgcctgtaatactagtgctttgggatcctgaggcaggaggattgcttgaagccaggagttggagaccaccctgggcaacatagtgagactcccatctctacaaaaaattaaaaattagccaggtgtggtgatgcatgccagtagtcccagctattcaggcagctgagctaagaaaattgctagaacccaggagttcaaggctgcagtgagctgtgatcatgccactatactccagcctaggcaatagaacgagactctttcaaaaaaaaaaaaaaaaaaaaaaaaaaggccgagtcatattattatcaagccacaaatcataaagaagtatgatttttaattagttatgctgaaatatgtaaaaatattgtcaagccaaaacttctaaattttctacagttccaattttacacatcatttgatttttgaggtttttggaaaatattagtgatttatttccttcttagaaacaactttattcattttttaaactttcttcaaagagatgggtctcactgtgtcgcccaggctagtctcgaactcctggactcaagcaatcctcctgcctcaatgtcccaagtagctgggactacaggcatgcaccactgtgcctggctagaaacactttatattcttaaagtccttttatagtcattataaagtaaattcagccaacataccagtttaagcttgttggacagtttttcctagtaccccttaatcatactagtagaggtgatattatgtggtttgtatctaatacctgtggttactgagtgatgaacagtgctggcattgtattaatatcacataaatgtcagttgaattagtgtaaatatctacaggatgtcattgatggggagtactgtctttatggcttctgcttaggcatcttgtcttcagcaagaacaagtaacagtggtacaaagaagcagaataccaaccagggttatatcagccactttcctatatttctcaaatttgggtaaacaaataattgctggtttaaatatcagtgcgagtatttgagtatttttaacttgatattaataattcagttttttgttaataattgtctaacagtgtgttagaccatgtattagtaaagatacattcctggtccataacagcttatactctagtaggaaaaatatacaagtatacatgtgtctatatttcagagctgaatctagtaaatactataagactaacacaaaagaaagcattgttagaattatacaggagtgagagagaacatcagggttttatgaaagagattggcagataaggctctatgtatgggtgagatttgagatggggctaactggctaaataaggtatcaccagaggtaagagagcattgcagattgggaaaaccatatgattaataagggctacattaaggttaaaaaatacttagtgaatgactcatttctggctgcaacataaagagtagttggaagtaaggttggaaagatttaggaggatgtccctggttgaaaagttggagtcatagaatcacagaatgtttgagcctgaaggaactgaggaaagtctgtttctcaaatttacagagttggagcacttacccagagaagttaaatgccttttgcaatgttgtatagctaggtagtggcaggtcttctaactcttgcttgagttcagcctagacagcactatctaagatagctcacataaggttattctggcattggctgacggaatggatttggatgcaggcagatcagagattggtttggagagtgatagaatattccagctcgtaaatagtaagtgcttaaaatagagtgatggcactgtgaataaaaaccaggagacatatttggggcatgttgcagaggtaaaactatgggacaaggagttgtctaagatgttatttccactgtaagaaactggcatcctgagacatagggaggttatgaggactacttccaacagatacgagggaacactcagcacttctgagttggttgtaccctgccaagataaaatggcttctttgaaacagtaatgaaactgtttcttacattcctgtggacttgactttttccccagtatagtatttttatttatttatttatttatttatttatttattaccaatacaatacttttaaatttaacaattttagccatctcggtatggattaaaacatctagatgatgtaactcttatgttttgctaggattgctactgtgcttttggcagccactttacaatctggtgcttgacatattgaacaatttcccctaaaggttagtctgagagagtttaggatttggaaatgaaaaagatctttgttaggaaaacgtgatgagacaacatagtgtcaactttaagaaaaaaaaaaaaacaaccatagtcataactaccatttactgagtgcatccttgtgctcagttgcattaggcacttttctcactgaattctcatgataatctccactttataaatgaggaaactaagtttagagggaagaataaataactttgcaaaattacctagccaggtaagtggcagagcatcagattcaagcccagatcagtctggcttcaaagtgtatgctttttctgtgctagtcagcagacagtgcatatcaaggaaataccccttactgctgagtttttatattgcccctaatttggaaacagttggcttttatagtagaatattttcttaatttcttacagatatataatttctgattgacatttaggggaaaatcactccaattagtgacaattatgatgtgttttgttttctagggcatatctggaatctgaagttgctatatctgaggagttggttcagaagtacagtaattctgctcttggtcatgtgaactgcacgataaaggaactcaggcgcctcttcttagttgatgatttagttgattctctgaaggtaagtttattttgcctttcatttttgatatacccagaatttagtatcaagagagttgagtgtaaaattctgttcttctatattcaagtaaatgataaatattaattaaatcacatggctgtaaacttgtgttttaaaattcagaatccaatcaaataaggatgaagaagtgctattccctttttttttctggtcatacttaatacagagagtcctgtattcctttttaaaggagaataagttataaatcatacttgtgggccgggtgtggtggctcacacctgtaatcctagcactttgggaggccgaggcgggtggattacctgaggtcaggagtttgagactagcctggccaacatggagaaaccccgtctctactaaaaatacaaaattagccaggcgtggtggtgcatgcctgtaatcccagctactcaggaagctgaggcacaggagaatcgcttgaacccgggaggtagaggtttcggtgagctgaggtcacgccattgcattccagcctgggcaacaagagtgaaactctgtctcaaaaaaaaattatatatatatatagtaatactttcggaaatcataaagattaaaaggaaaggaaattaatcggaattttgactataagcataaagatcgtctaatgcattatcagatttattcattctgactttgctttacagtctagcacttagtttcttagcttgtatgtgattcatatgtacatgaaagctatttcatatcttggactctttcttattctagataagatttaatattctgaaacacttcaactaatcttcaattggtaatcattggaagtttttctttagtttttggatctcgctacataagcagctgttaagagtctcaccttgcaaataaactctcccaaagttctgactgacgaaacaggcactaaaccacagttgtgtaatttaagcctgaagcactggacctgtagtgcttttctttttcatagaacttgtcatttgtgttgtatatgctctttcctgtgactctgcagaaaacaggcagacttgtttccaatctaagcctgggcagaaatgtagtggtggtaattctcataatttttcatttttcatttccaagagaaatgttctagtttatatttatcacacatgccaaggatatagtagtaataaggtgactgggcctttagactcagaaaaacaatttctgaactggtcagaataggtttaagtgcttaaagtgctttttaaaaaaaaaaaaaaaaaacattttagcctttataacctagtagttgatacgttattttcagctgtttgcgtctctgggcttacaggtatgagccactgcgcccagccgcatctcttatttttatttatgacttggaacttaagttacttcctaataacatcaagggtaaataatgtagtttccttttattacttacctctttcgtatagagtggttgcatttagtgactaaatctgtagtggtgttttaaaatgatctgatgttagtctgtaaataaaaagattacggttatgttgtttggcatgcttggttaataagtttcaaaagagatcaactaaaaatattttggagcaaatgaaatagaaccttgtacatacagcctagaggaaaccagttcctattcatgtattattaccttctatacgtagctgacttctagggtagaacatgtgtgaaaagtgattgaggaggaggtactgatgccgcttaagatggatggtttgtgggtaggaattgactgagaagaaatactgtctataagtagtaattcagagcttcaaacagcaaaggaccatctctgaatttagtagtcaaagattggtgggggagagaggtgacttcaaagaaaagcctggtgagcttaggggagaggagagatgcttgttgtttttatagattcaataaacacggcaacagagatacaccaaaagtcatcctcgatgtttgcacagtatagcagtgaaggcagctatatgtctacaatttaacatttttcttgagagaaatgtcattcttgaataaatctatttttaaaattgatctgggaatgattcattatgctctagttttctgagtttgagtataaagtttccacttgtctttaatcaaaagaaaacttatttattctttcagagaaaattttcatccatacacagtccattgtgtagatacggggcaagaggagagagaaaatgttagaaaggggctgatgagatcttaagaaacattttaaatctctgttttgcacacgtatttgagaatcgaatatgaggactttttaaaaaaagttttgagaaataatttctttgttaaatcttatattttaatttcttttgaaaactacatttttttgtaaaagcaattatgttattcatgaggaagctagcataaatgagagaaatcgaacttgataagttcttgcattgagtgactgctaatttgaaagtaacagaaagtaacacatgatgagacagatttcctttctggaacacttgttgtttcttagtattgaaaaaaaggactttcattaaaattataatttatccttaaggattagcaatccttttaaaaagagaagagaagaaaaacgtacttgattggtttccctgagttgtgtttttggcaagcccagagctcaaggaaacctgcttggtgacttccccagctggcaattcatttaggactgcaaataagtaacagttgcctcatcatgttagcacttaaagtgaacctggcatttagatctcaaaatctagaggcaaatgaataaggcagggaatctgtccttttctccccatgaaaggtaaagcccttggtaattcaggtgcacactctgataatgtacatgaaaggtcttccttgataaacgataaaccttgtgattttgccacacaagaatttagctaaaccctttcctaatgtcattgtatatgagtagtacagattccatgtgtttgtttccattgaatatacagaaatactgaatacttccttaaaacagcttttattgaaaaaaggaagctgataaaaatcactttgcttttttataaaaacgcttgataggattacctttctagagagacttctgtgtatggccacacttatccaccacagtttttgtttatatagagagcattttaaaaagaagaaggttttcctggccatgcacagtagctcacgcctgtaatcccagcactttgggaggccaaggcggaaggattgcttgaggccaggagtttgagaccagcctaggcaacattgtgagactgtttctataaaaaaaaaaaaactgaaaaatcagccagccatggtcgcccatgcctgtagtcccagctacttgggaggctgaggcaagaggattcttgagcccaggaggtggaggatgcagtgagccataatcataccactgcattccagccacggcaacagagtgagaccctgtctgtttaaaaaaaaaaaaaaaattattaaaatcttaatcttaagttccttaatagtggactgtattactttttgccttttagccacaaaaactggtagggaaagttatattctgtcaccctaaagcaagcaaaaaatgtttttccaattcccattctttttttactttttcaacataaggaaaaatgtatttaccttgtttaaacggatttattttaatgccttacagtcagattttaaatttatgggaagtttgctaatagccccagtctctccagttgagatgaatgttttttcttatttaaataacaatgagttttttaaaatttataggaagtagctttttattggaattacattgattttatatgattcatagctaggaaaatggaaaccatcttaatttcaggaaaatgtagtagaaattactctcatttctaaatttttgtcatttagaaaagacatttttatcaagctctgtgtttacaaaataatagtttttaaacaacaatttgaaagaagtatctctataactcattgtcttcataaatgcaaaatctgttgtgtgccctcaaatttatatctacatttttagattctgggtcacaattatcactagctctttttttttttttttttttttttggagatagagtctcgctgtgtcacccaggctggagggcggtggtgcgatcttaggctcactgcaacctttgccttccaggttcaagtgattctcctgcttcagcctcccaagtagctgggactacaggtgtccgccaccacgcccagctaatttttgtatttttagaagagatggggttttgccaagttggccagactggtctcgaactcctgacctcaggtgatctgcctgccttggcctcccagagtgctgggattacaggtgtgagccaccatgcccagcctacaattatgactatttccatttgaaaccatcttcctcagaaattgaaattttagagccgctcttgctagcatgtgaaaccttttccttgcttattgccttttggcgggggcagtgaaggaggagcctggcctttcaaaatgtgatcaaaaaaataaccgaactccagggctcattagtccttttataaacgccggtgtgaaatgatgggtatccgtgtgcctggtccaagtttcctggtggttgacttgggcgaataaaaataagacatgttctgcagagttctccttttaaattcttgtgtaatattccgtttgttttgctcctttgcaattaactacaaacttctaagtcctagaaaagatttcaagtatttatagagtgagcaacgatcattttcctagtcaaatagtatggcaaaaatcactgttttaaaaagttgtggcattaaactataaatcctccctcccctcgcttcccacccccaattatgaaagaaaagcatatgacaatgcctactgggctcagcttttgggctaattgagtctgactgagccttcttagcaggttcctgtcttttgaaacctcaaatcccaaaaagctgtctaataattttacttttttagggactaagaccaggtattttcagcagaggttcttacttttctgtaattgaggcgcaactataatgttccagaacacaatcttaaatctgaaagtgagaggaagaaaaaaaaaaaaaacggcctgagctccagaaatagctgacccagaagaacactaaaatctagctctcaggctcataggcagctgttaacattcacattttgacagcttcctttcaggtttcttgagctctcagaaaaattagaaggaagtgggctggggatatagagagagtccaaactaccaactaatgaatgaatctgaaggagacacagaagggcaagtagagtttagagtttgagagtgcaggaaagttttgaaatggtcagaactgccagagtaatttctgagatcttactaagcactctcccaccgtttgccttaaagataccccttcccccaaattgaaacatcacaaatctgcagagctctttaatcaggtgtgttatacacagtgaatttaattctcttattgccctggaagaaagataaaccagatgtggcccttgccccttttcagtaagtatttgttagatcttcattacattttaggcctccttcctccagtctcgatactgtgcaatggagagataagctttgacctcttcagttaataagtattggctataatgttgcaaagtatttgccatggaatcgtgtagaatttgttaagtccaaaatgagagcaccctgtttgcttctttaaagtgtttattgaccttattcctgccatgttacaaatccatcatttgtggtggattcccattaataatggttactctctaggttagttcttgctgccacccctttctctcctggtggtgtgttccctgaatacacttaaccactatttctgttttgggccgccgaagtattcagttttctcaacatagctgcaacatttaaaaattatatgatagcacacaaaagtgtacatttctggcaacactggcctggaatatttgcatggccacagcgtatggagcagggttgtaagtgcccctttgagaggaagaatgcatatcactgtgtgcctcagttctctcccagcctctcacatacatgtatgtcacctgcctggccctaaggacatttgagacctccctgtgttcttctctttgtcttgggatagcctggcttttaggaagtgttctcaaagaggcaagtgacatttgagcccctacagtggctcaggtgtgaagtcttgggcttttcccctgtggacttggagtgaagccttgtcagtgactgtaatgaccaaatgaggagttattttagcttgtgtttgttactatcttctgtcatgttaagggcatcttcgttgctagagtaatttcttctaaaatatggaaggtcaacacttttccctttagacttgtggatagtgatggataaaaataactctcttactctatagtaaacttgctcaagtgcaaaagttatatttagcttcagcaataggagtctataaaactgtgagagaaaagccttactaactgaagtcatccttcaaacctttctaccaggggttccaatagcaattgctaagaatacggcagcttaaaaaaattttttttcaattgacagatattaagaatgcctgatatttactgacttgaacattagttaaattcagttagggtgaccagagtgttgctatttgtagaactgttgcttggtagagtcatccaaagtgtcttcctaagctgtaataaatatgcttactaatgtttgactgcttaattaatggtcagtaagcattcagtcagagttcgtttaatacatggagaaagatatatgctttagatcaagggttagcaaaccactgcttgtttgggccacggcctgtttttgtatagtgtgggagctaagagtgggtggtgtacatttttaaagggttatgacaacgacacagaataatatgagacacaaaccctatgtggcccataaaacctaaaattctactgtctagctcttcacagagaaagtttgctgatccccgctttagataatgggggtgctctactactccccttttcatttatagtgttacataagcctaaataatcactgtagctggtggcatcatgtttgttacctactaagtaggtcaaagtgattgccagacatacacatgaaggccttgaattagaaagcaaaggaactgatgatgaccaatgtttaacaaaattcagactgactttgtgcctgatccttcaaaggctagaggtgatatttttggtacctgaaacgtaatttccctgataagtactctttgcccaattattgcttatcagctgagatattaatgtctgaattattcagctcatatatcttcaagcactcaactagttcatactttgaaatcaattctaatagacaattctcataacacctttatagtcttcccatttaaaaggtaaatgttgttagggctggaggggtaagatgcacccttggtatattgtctgatctcagcagaatcaactacttggtagtgtagtccagagaaaatgggtcaaatctattaattattttaggattttgaaattcataattgagactcgtgacttaatagtgaactgctcatggtactttacccagtcttcaagttgtatgccttttgtaggtaggcatttagatgggatgcttttgaaagcataattaagaaactttacttgaattttgtttataatgggctaatgttattttcttatagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccgttctttttgaaaagttgtatatttcccttttcagctctcatttcactcttcagtgttcctgttatttatgaacggcatcaggtaatttcctaactaactgctgacttcagaatagagcactcactctattacatgggatttacggatgtattagtgcccattttcaatgtcttacaaaaatgagaagtgtgatggtttcttaagcctttagcttgacacatagtagtggttaataagattctttagcaacggtaataattcctttatacctctctttcaggcacagatagatcattatctaggacttgcaaataagaatgttaaagatgctatggctaagtaagtatttaaaatctgcagtgtttttactaggataaggtgtgctggattgtgagaacagtattttcatattgcaggcataatgagtaacaaatctctatcagaccttaagtgtgacttcagagttgccaaaagattgtttttctaacatttggaccattcgtttctgggtttattatgtgtttaaggctttgtttaaatctaattcatgaggccaaggtggcaaaattatagcttagaattaggcagctttaaggatttcatttattgtattagctgaataacatacaagtagttcttggaagatggtattttaagcagcagcaaacaaaactgatatttacattgactttttcattttcagaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaatatgctttggtattttcatttcatgaaattgcagcagattaaaaatgcacacagtgggtaaactgcttcaaccagcaaatggtagcttgtgcttttagaagggtttttttcagctgatggtgcagctgtttgtttgtttactgtggaaacaaaagtcaacaaatgtgtttacataatcaaattttatttgacacataaaatgtttaagtgatgtgttttatactttgaaaataaattcatgcaccaatgttttaactcacatatatcatacagtgcaggatttatgaacatacataaaatcaaaatcataccatataaacgtttacaaataagtttttcatgacacacggacactattgctctttaaatatggttgtacatgtcatcattaatcgattcattgttcttccacatggttatttcaatgcaagatccgatcagcatgaagagtctagtacaagataggcagacatggttatcactctgcatcaccagtcacatggttacagaaaacagaattgggactgcatagggactctactgcgggcccaacaacctattagtggattgatgtaaggcattagtaaattggcatataaaaatagcttaatgagtgatctaatccatttagaatgctgaagcacttctgtggtaaatgttagtctattctacaattgaaaatgcctcattttaccttttctctaaactgacaaatgcaagtagccagtaactgtaggtctagaattttcgttcactgaccagaaggactaataggcgtctatgtgctcagaaccaccagtcccgcaccaactctcctttcagtgagcactgtcagccacatcctgtagtcactggtcagctacatggaaagtgtgactgaggggcttacggatggcttctggtaaagattgtccaagtcatattccgtcatacaaccaactccaaggaactctaactcactttataattttgatttaccagctattccttgggtttacaatttgttctgcagataatttttttataatctggacttgacctatatagttcgcctgaagcaatcaaatgaagtcacctcaactccactcagggtggtacaccaaggtgcagccttgggttaccctcatttatcttaagatttaacgagataagtcagctcattctcatagaccttcctgagcctttttccccttccattttgtagtagaagtttgtttaacttgaattctattttggattttgtgggtttggcatgaaacacaatgaaaacccataattctaccctgtcccgaacttcaattcctttgctgctcaccttcccataagcaggtaaccgatgtctttcatttaggaagccttggcgtgaacacaggacaagggtgacacactgaatctgctaagggtcctgcagccctcctcagctttgaggttttagcaccataaggagaaaggagaaattggtgggaggtgagacagcagcccacacaactggaaactttcaaaggcacttaatggatataaaactctgcaaatgaaacatttaaaaattaagtttctcaactcctttatacatggctcatttggttttgaaagctaaactggagaacagaggctagcgatatttctagtacttcggtgcatctaacttaggctgtcttgttcaacttatttgtaaaaatgaacattcttgaagtatatagaaacaatagcaaaacatctttgtaaaagttttgatgcaaattaaaagctacatattggttagggtaaccgaggcttcaaaattcgtcagcgggctacattatcagataggatttctttgtcaatgtagttagtatgtatactgtttagtctcaggaacagaggcaagcagtctttaacattttaaa

SEQ ID NO: 14996 - DNA, 8841 bp, Human
ttccttgcccaccttagcgcacccgaggtggccgcgctatgataattacatgataactgggtcaattacaatgcagaatagttgggtctcttctctccaagacctagctggggttaaaaacaggtggccggggcgggagctgtcctagatcctgaaacgcactgtctagtttcggatgccctcaacagaaccggggtggacggtttatggcgcagatcctgggttgagggcacgggcagccatttggaatgatcaaggctcaggtaaggggcgtttccagcgaaggagagacagtccacttggcatttggattccccaaattcttcatgtttaaatggggcagggagggttcttacagaatggctggaaggagccaaggaaaataaaagtgtgtgtggattttttttgtgtgtgtgtcagtttataaactctgcacagattatggccactttaatgacttactgttcctttgatgcttttgttataggactcgatgcatgtatgtcatggtgtaaggacaaaactcggcccctgtgctcctctaatctttacaaaaggtcatggccagcgtgcagttttacagtaacaagcaaaatgatttgttgagctcatagagagcccctcacacctatgaagttctaataagtgtagttctactataaagttaatctcaggatgagcaaatttcaagtttctatttttccagagctttccatttttggattataatactttccctacttaaaaaagcacaacatttgatatttccccaataatttgttgctttaaaaatgacacaaaaggtactatttgttcattgtagagaactgaaaatacacataagcaaatacacatacacataagcaaaatatacaatacaaacacaagaccatctttcagggaagaatctgaagttttagcaatagcagccatctaaccagtttagcaacagaatataagctctgagagggtgggagtgaatatgttaccacattgtacaacacagcacatagggcataaggaggggaaatgctctctggggctttccaggaaggcctgaagtcattgcttctagcaaatggaaatcactccagagtagttatctttgacaagaattgaaatataattgagggaactatcagacctgtaagattttgttttttcctttactaatatgttactttacatttgcatttggtgacatacgtaactaccatttttctgtgactgtaacatctgggcatttttcagagctaaatgtgctatggtcaacttggagctttaatctaattgcctggtccaccaagttctggctgtgtacttgaatagatcactggcagggtacaatgggaacagcctgtcccttggagccaggagaggacaccaaggttgaccaaagctcgttcagttgcccctttagccgaagcgcacctgggccagtcactggctgccagtgccatctaatggctgctctgaaaatgctcagccttgcccggcaacccttcagaagctagcaccgtgcaggcccagcgcctggggaatagggcgagggtggggtagagagaaggaagtggcctcctgaagtagaaatcagcgcttcagaggactttcacttccaaagcctcccctatataaaaaagatttggcccacgcctccccaaatgagagatttattttaggcaaacttattttaaaatgccagcgttcattaggagtgacaagacacttagtcatccacgctttaatgtgaattacttttctcatctaattacatttctttctagcagctggctgagaagatcttctgaaatccaaaatgattgtagggttggcggtgagctgatctccggcctcgaggtggcttcagggggcccacctggttaagggaaatttggcagtgcgagggtagtgctggagagaggggtgggtacagggggctaggggcaccatggatgccccctccttactgtcccctggtgtcttgacctcagcttctgcccacaggcacttgctggattctccaaaagtatctgcagtggctgttccaccaggaggtaattcccttctggtctctttcccctccacatctgcatcctcttcaaatcctgccatttcagaccacatttgagagctctagagaacaagacatctgacacgtgacgtgtccagaagatgagccagatttcaaagaactgagatctgctttaaaaacgaagctctccaaagttactggagtctgggtaatagtgatcaccagagtaatttgtgtgcaggacatcaaatcaggctgctcgaaatgctgcctaaattggccagtggttttatttgcttttctgtcaacctaatattcataggaaatagagtttcagaggaatgataggatcctggtggaataaaaagggaaaagaccatcttgagcaggagtttcagggtcctccgtttttcccaagttactttcactcctgagatcttgcatgttagaactacagcttaatgtagtgaaataggaaagttctctgttaggagcttagccttaccttgtcatggacattaaagtaattgtctctctttgggcttcaattttcccatctctcatgggaagggctgaaccaagcaatccccaaaatagcttccagccttaacctttttaggggtctcgtttaaatagaagataacagggaaatggtcacagtttacccaggtccattccctcctccttatcacaacttataccaccgctgtactgcacacctcctttctcagcattgctgctgtccttaaaatgcctttaactccacaagagagtgtgttgttaatgttggctcaaggtccttcctggtgagtggccaacattgttttgctccttgcaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggtacgtgggccatgactgccatcttggcttagacattagatgggactggagctgggaaagctcaaaagaaaagggtgtggggaaagggaaattcattcccagtgataggcgtgattcaatccagggcaggagcaaaactttgcagtgaagtaagaaatgggagaagaaatcagggaaggaagcagcttcagggagaggggttgagtccacaatttctgcttggttatccttacttcttgccccatcttttatggagaccttgaaccctttaagctagagatggtgctataagagcaataatggacccctcaatctattctgtactttaaatctttagcttcccaaactattcctttttaagaagctcatatcacttgccattttcattccatatttcttacccttttatctactaccggttgcaaaaccagccaggtagttcttcaaatcatctctggaagaaggaaaaaccaggggcccttttttttttttctttaattggtgccaaatgtctcatgtttattctggaggactggccttctgctgtgttcctctacagtctttccagagcatgtgaaggccctttgcatcaggcaggagctccctccaggtcaccacagggtgtatgtatctgcctgtggggggtgtgtgtgtgtgtgtgttggggggcataaatgagtaatgatgccaaatccagagattaaaaggcacactgagaccaggcgagatggctcatggctgtaatcccagcacttttagatgctaaggtgggaggattgcttgagcccagggattcaagacaagcctgggcaacatagtgagacctccacttctacaaaaaataaaaaagttagccagatgtggtggcatgtgcctgtagtcctagctacttgggaggttcacttgaggccaggagtctgacgacacagtaagctatgatcacaccattgcactccagtctgggtaacagaatgagaccttgtctcaaaacaaaacaaaatgaaacaaacaaacaaacaaacccccatactgttagtgtcagtgaccggaattttaatcttgttgccatcacctggcaggtgctgagggtggaatgtacataactacattctgtgtattttgtcaatgcagaagctgagttaaggtgaagatagaatgaggtcctcaaagacacagaccagttttcatgtgtaatataaaatagaaacaaagagcccaggggattctgtgagttccagtttggaaagacccaagagtctcttgacttgagacacccacagcacagctcaccagggagggtgcactggacacagtcaggacccatgggttctagacccagttttgaggtgtgggaccttgaccaggtcctatcacctctctgagtctcctgtttcactatctgtccacgggaggggagtgtaaattagttttttccattgttaacgttccacagagttgtaattctgaacacctggagtaggcaatgtccagctcaacagagtgggtaggatccttttattttctcctttgctattcccaagaaagagagcagccagtgagcttttcatctttttatcactgaaaactcaaggctgcagcctatgcagccattttcctaagctaatatgtaccacaatagagtcctctagggacaaggagcagagacacaggttccacagacggtgcaatggaaataacgctagctttccacccctccctccagtcagaatgagattacagggaaataagcttgccccagagctcactgggggatctctcagaaatcagctcagaagtcgtgaaagaaccaaggtgcagttttggaggcttagtgcagagatggagctggggtagggcataaagtaggttttccatcactgaggtaaggttgaggcattattttttattttttgtttatttatttatttttttgagacggagtctcgctctatcacccaggctggagtgcagtggcgcgatctcccctcactgcaagctccacctcccaggttcacacaggttgaagcattattaaaaatatgtttaaaaatatgggccctagtagccagacttctatcacctggagagattatcccccaaatttcagccccactcccctcctggacttgaattaaaccatatgtatttattcaatattctttttatttatttatttatttttttgagacggagtcttgctctgttgccctggctggagtgtggagtgcagtggtgtgatcttggctcactgcaacctctacctcccaggttcaagcggttctcctgcctcaggctccagagtagctgggattacaggcgcccgccaccacacccagcttatttatttatttatactagagatggtatttcaccatagttggccaggctggtcttgaactcctgacctcatgtgatctgcctgccttggcctcccaaagtgctgggattataggtgtgagccaccgtgcccggccctcaatattcattaagtgccaacaactaccacccgtctgcctttcttggagccactcctttatgtcaggcatataacagtaagactttggtcctgttcacaaaagctaggggtggctagatggctagacaaaccatggaatgggatgggaagtgtgttgcagttgccaggcagaagcatgaaggggatgggacaaaagaggcagtggcaagatcttagatgcccacgagtgccaagaaagcaggtgggcagacctgctctgtagggaggcctcgacgcttgacacgcccgacactgtgccctgtgtcctcggcacgtggcgagggcggccagggcctaggcgcagtgacgggcgcggcagccgggccggggtgcggggcacgggctgccctcatgccctcgcgtcttcccccaggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagcagcatggatcggaggagcacagtggtttccatgcggtaggatatttcacaggacttagtgagcgtgaaaggaaaatgtgcttcctgcccccacccccaaatggatcttcgagggatcagatagtttgggtgaaggcacagggtggctccagcacctctaggatggccgtattttccacacactccactgagtgggagactgctcagctagcacacgtgtaaaggcaggattcctgcaagagtgaccccgggcgctcaggggctccccggctccggtccacctccaaaagccagttggacaggttgaggcctacccacgcctgggagtgctctggactgtcaggtgagaagtcttggtaatgtctccggggaactgctcgtagcaatccatgggaccttaggcaagtctctgaacttctccaaaatttagttctttcatctacccctcccttcccagtatgagggttattgtgaagattaaaggagaaaatggacataatcttctttttatcatagaagctaagtgtgagagctgagggttagtatcagttccaatttcactcccaggctactcacagatacgctcagacatacggtctctctcacacacacacactcatggagacacacatctgtttaatacaacatactctacgcagttgcttcttccagcccctagggcttaagccctgactcaggccctctgacccctcctgccgtgcccaggctcctccctccccgcgtgtttcagctccagcccttctcatccttagtacttcccccaggcctctctgataacagcttcccaaccaactggtctcctagtttccagctgctctccccagcccatcatatacgaattcttcacgttagtttacacaaaatcttgctttttcccacagtcccaggctcaagagtcaaaacagtgcccccaccccaatttctgtcaattccaaactactaagcatggtgggcagggcccttgtagacgggcactctctccttaccaaaccctgcttcccaagtttccccggatgaaggcgctgcctcacactcgttggtctcctcacaggtctcgcatcctcctataccctctgcctggaaccccccaccttcccctgccattttgttgtcattgttgttgtttttgagatggaatctcgctctgtcacccaggctggagtgcaatggtgtgatctcatctcacttcaacctccgcctcctgggttcaagcaattctcctgcctcaaccttccaaatagctgggattacaagagtgcgccaccacgcccggctaacttttgtatttttagtagagatggggtttcaccaagttggccaggctggtcttgaactcctgaccccaggtgatctgcccaccttggcctcccaaagtgctggggttacaggcttgagccactgcgcctggccagaaagccagattcttaagacaaggtgttccccagtatggcttacatggaatgtgctagaatgaataatggcctaggccttcctgaggatgctcccatgctgggcatgctgggcctgaggtttccatcttggtagcctcctttcccccacaccttctccctctgagacaggtaaagtcatggttggtggaggtggctaaatgtcagtggtatactgttggtattttcagatcccgtttgcttctcaaaaaaaccatttactttaaagaaatcaaacagacagccatgtggtgacaacattaacatttatttgaaaagggcatcgtgatggctcactgggagatcgcgactaatagtcctagagaatgattttgctaagaatccttcttcctatacttccccccactccgcctttcccacttccctaaaataaaactaaccaattcaatgggtttaaaatacagaaaaccgccacgggcactaattctgcactcacatataaatacaccagctattatatacacatattgtcaactacaaactatactacacacacatgcacacacacagcc

SEQ ID NO: 14997 - DNA, 30444 bp, Human
ttatttttgtgttattttgcataaagtttatctcttacctatgaaggcagaagccactaagctactcagaggcttgttttaataaattagagaatgccagtattgcgactcttaacctgctgagtccttctggcagagctctgctggaggactcatcagcttcttcagcctcgggcagcagcagagcatagtgagatacagtgaggctctggaatcagactactggactccaaactcttgctgactgtgtgatcgtggataagttaggtgacttcgctggcctcttcgtccctttataaaacaggaataatgcttcctaatggggatcaatgaaatcaggcttggacctgtgcctggcacacactaagcactcaataaatgtagttaatcctggtattttcttatattttattggcccttctgactacagcagcacctcaatgtaatcagtagcgactcctaagtccctttcttgagtcatgactaacaactaagaatcatgagaccctcttttaaactcaggggagtcacttaatccctgtaggcttcagagagtttcacctgcgacaagaggagtctaacctgatttcttgagacctcttactaggaagaaaatctaagtgaaaagccagcagcttctgttctgcctacacagattctcaaggcatttttcctacaggttaccgcttgatgtttcactatccagcagcaatttttctcttgaaagataatctatctttgccagttacccatgaagggattactccacccctccacctgagttctggcttaaagccgtttttccttattataaaaagccgtttattattaaagccgtttttccttattataaaatatgtgcttaaggtagaaaattttaaaaatacagattaagcattaggaaataaccaaaatctcaccatgcactacttaatatgtagatgtatttctttagtttttcctttcaaagtctggatcattctgtatatatagttcagttagcttcgcatcatgagcactcttcccgaccactaaatatgcttcaaaaccataagggctcccatgaatatccttgtgcaaagctctttgggtgcatctgattattttcttaggctacatctctagcagcaggatagagagtcaaagggtaagggtgagatttgtttggtcatctgcaaacagaacctgactgctattttaaaaggtgtaccgatttacacacctggtgcctggtctagctgaagctaggttcaatttatactaacgtttttagtatttattttcaaataatttggcgtcctacccaggtaaatactcagtttgacttcactttgcactgtcccttcgggctcggttttgcaggaggacagcactttggggcatggctttaaaaagtcggccagtgcacaggcggaacagcggggacacaggagccaccactttaccgcgagcccagcagggggcggaggactgctgtccactcttcacacagtcaggcccttcccaagggcgcacctccagggaaacagctccagtctaaatgttaacgatcaccccaactcccgccgcacccactccccgcagccaggccttcggaccgaagaccacacccacttccgccctcgatgtctcagcacctccccctccgcccgagtgcctcacctcgaggaccactttgcgcatgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgagctagaagggagaaggtaggggaaagacccattgtcggaccggaccgtggccagggtggcgggctgaacggccttcttaaaactccttccgtggccgggaagcccgctggaccagagtagccgtggcctcgggagcgcgccggggccgcgggatgggcgcgggggtgggcatggactctgctggctcggacgatgggagagggcgggcggctcaggaaaggggatcctagccgtgacatttgtgtcatccgcggcccaggggttgtgcctgagtggtgtgtgccctgccgtctgggtttgaatgggactagatgtgatgtgactgttgccatttttcttttattagcaaggacattggagtccctatcaccggttgcctagacaacttcatgggaaggcccttgggaatctgagatggagcaggcgaaccctttacgtccagatggcgagtccaaaggaggtattcagagggtcgccgcctccttcctgctgctgcccaaagatgacccgcaggctgagagagccctttcctcctggaactgacgtgggacctggcctgtttgggagcagaatagtgaaaggaactaacattgaagacaaagggacaggcagccaagattattcgaggaggaaaaatggcttcgtttctaggctcccaccccttttgaaacggataagttgcatccatcatatgctcagtgtttatattctgaactgcggttctagccagggaggtccctttcctctccccggattttttgggccatgtatgcattactcttgagggagggccagtgtagggcagtgactttagtgttggctagaactggttttgagtgttggctctgccatgataaatattgtgaccttaggcaagtcactttattctctgcctctgtttcttcatctggaaaatggaggtgaaaatagcactgtagttgtggttgtggaaaaagtatttcttttgtggtggaaaagtatttaactcagacttttcaagtgaagcatttagcacatgtctaatatataggaaatattcaatgaaaggcttaattctttacatactttgtgtcttaaaatgtagaaggtgtttaaagaatgcttgttagagttgcttagaattacgaaactattacttttacttagtccttagtcaatcctttggaaactgagatttgcgtttgaatttctgtccaggagtaagttgctttcttctttagtgcctagtaatatttgtggacagttctggttttgtgtgactttatgttctttgctactaatactttttagaactttgaaatacttactcaagcctgatgcctaaatccaaagggttctacgttagtactttgggaaagcttgccataaaacctaacttaaattacagttttaaaaagaatttctgagcgcgtcagtgaatttggttatcctatttttctctgggtcatcattatcattgataacagagaagtaactatattcagcttaagatgacttaagctgagactttagataataaaagtatatggggtaagatttattgttactttaagactaaaaataagtttggtgactttatgtagtggaaacatgctacactcaggagtaacctgttctctagtccaggccttatttcatttctgttaaagtaagtgatgaggtggaagttttggattatcaagagacttagaccagtctccttattctctacccaaaacaatatttaaacacttagctgttacccatactggttttatccctctgcttgtttgatttcagttttttgcttattatttgaattctccccactcatttgagaaggaaggacatggagttgtagttgcaaccagatgatttattcaaataggcagggattttgaccttttctgggacaaagctgactggctaggatgagatgcaatcataacttccaaggtaaagcaggcccagcagatacactccctcttttctgtagtagcaacgctaaacaacaacgctacccccttggtgtagagggaatcaggtcggtaaagaagctgggcaggtttgagagcctgagaagagggctgtgtggaagtgcctagagaaggagcagcatgatactgttttgaacacctacttatctcagaaactttgggaatattgatatctactgttttagtaatatagaatttccataaagtagaatttggtgaggcgtctcctctaccaccctaaattattctatgtgtgcgtgcttttcagatcacctcctggttggacattaatttttgtaagctccgtgaggacagggacttcgttttgccaccacagtatgaataacttccagcacggtccttggtccatagtaaattctcaatgcatagttgttggataaatagagatttgtgaataaagcagttaatcacgtgctaattattaggactaatttatttaattagaattttggtttctcacgattattattgcggtaatgtgggtttttctgtggacatgagccaagtgaatgtaatctccaagagtgtcatgcctggttgtccgtgtttcggtaaacatttccggagtgttggccgggcgcggtggctcacacctgtaatcccagcactttgggaggccaaagcgggtgaatcacaaggtcaggagttcaagaccagtctggctaacatagtgaaaccccatctctactaaaaatacaaaaattagccgggcatcgtggtgcatgcctgtagtcccagctaattgggaggctgaagcaggagaattgcttgaacctgggaggtagaggttgcagtgagctgagatcgcgccactgcactccagcttgggcaacagagtgagatttcgtctcagaaaaaaataaccatttccggagtgtttaccatgtgtaaacactttgtgctagggttaagggatccatgggtgaacacaaatgcacacggtccctgattttggaactttaaggttcagtggaaaagataagcaaatcaaataatcacactaatgaatatacaattaaaactatagtggccgggtgcggtggctcacgcctgtaatcctagcactttgggaagccgaggtgggaggatcgcttgagcttaggagtttgagaccagcctgggaaacatagtgagaccccatctctttatttaaaaaacaaaaacaaaaaaactatagtattgtctcagaaggatctttgagagcttatgagctggcacctgaccttgttctgaaggtgctacaaaggtttccctgaggaaatgctgcttgcattgagtgctaacgagctagagtagctgcaggtgaaggtggataaggggcggctgtggaagagcctttggtgtgtgtgttgggggtggggggatcaggtcagtaaagaagctgggcgggtttgagagcctgagaggaggcctgtgtggaaatgcctagagaaggagcagcatgatactgatgagggtaagagagatccagaggccagtaggcctcgtaggcagtgtgaagtcatcgaaaggctttagccagctggatgacacgatccagtttagattttgaaatatggcttcagtgtatgggccacctaggaaacttgtaataggccagaaatggtagtagcttgaactacaatggtggcattgcagatggggaaaatggaaatattttagagatactaggaatgtttattcaataggatctggtaatggattgggactgggtcagggagaaggtgtaaggaagaaagtactggtttacacagctatagatggataatggttccagtcatggaggggtttagaaggggagatgatgaattcagtcttggacatgttgattgtcaggttcctgtaagtcttccaagtagatacactgagaaggcaggtggatattctgctttctcaagaagcaggagagaggtataagctagagatacatatttgtgtggcatcgacatgtatggccattaaggctgtgggtactgatgagatttcttctggaaagaagaggtcttaggactgagctctggaaaatttcagcatttaatggtcaaggaggagagtaggagccttcaaagcagaaagtggggtcagagaggtaaaatgtaagtgtcacaaaaacaggttgtctgttgttcatcactatgttcccagtgcctgaaatagtacttggcacaaaatagatgcttaataaacatctgttgaacaaggcataccaacaggccgctatgctaagattcagaggaaaagagggtttcgtgaaggtggtgatcagtaggagcatatagtgctgggaggtgagataagggagcttgaaaaatgtcctttgggttcagcaacatggatatcactgttgatcttagagtggttttgtaaaataatgggaacagaagtgagtttcaagtgggttgaggtatgagtcacaggcaagaaaatggagaaagtgagtacaagttgagcactgaagatccaaaatctgaaatactccaaaatctgaagctttttgagcactgacatgatggtcaaaggaaatgcttatttccagttttggattttcagatatgggatgttcagccagtaagtgtaatgcaaatactcccaattccgaaatctgaaacacctctagtcccaaaacgttcggatactcaacttgcatggacaactcttttaagtagttttcctggaaaggaaaggggagaaaagggagatagtagctgaaggggatttgtgggcaagaataggcctgtgagtgtatgaaattgtgtgtgtgtgtatgtgtgtgtatatatatatatatatatgagtgtgtgtttgaagacagttgagacttgagcgtgtgtggaagggaaatgaacacagcagagaaaagggtaactgatcatttagggtttctgagaaagcaaggggataggcctcaatgagtaaaataggataattctgcatatagtgcgtgtctgtttctatttgatctcacacaaattttttttttttgagacggagtctgtcacctaggctggagtgcagtggcacgatcttggctcactgcaagctccgcctcctgggttcacgccattcttctgcctcagcctcctgagtagctgggactacaggtgcccgccaccacacccggctaattttttgtgtttttggtagagacggggtttcactgtgttagccaggatggtcttgatgtcccgacctcgtgatccacccgcctcggcctcccaaagtgctgggattacaggcgtgagccaccgtacccggcccgatctcacatacttttttttaatggttttattagccataaaaaccataagaggtttctagtcttaattggataggtgaatgagataagtttttggattccgtcccaaggcaaggagagaagattaaggttttcatatatgttcatccatatgaaccctacaaaatagatgctgggtgtacttaagaagctcgattaaataaagtctggggcttcctttttttttttttttttttttttttttggagacagtcttgctctgtcccccaggctggagtgcaatggcactcaatggagtgagtgatcttggctcactgcaacctccgcctcctggattcaaacaattctgcctcagcctcccgagtagctgggattacaggcatgcgccaccatgcccggctaattttttgtatttttagtaaagatggggttttgccatgttggccaggctggtctcgaactcctgacctcaggtgatccacccgccttggccccccagagtgctaagattacaagtgtgagccaccgccctcggctgtgagagggcttctctccggcctgtggtaaagctagagaatcatcctttacacactagagatgtggatttgcgataaactgcagacctagataagacactgctgcctaatcagcgtgtgatagttcatatcctctctcgggctgtctttgaggaggatcctcttttacatcactctccaacctaggaggttgatgatctttgatttcaattgttagctcccctggttttataaattgacagatatctaacaattcagctggccacaaagttctggtaaaaaaaaaaaagagtcacctgttcttccctgagatgcttcctgttgccacagtgagaaatcctcagcttcttgtaaaattctccttttactctccttaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgagtagaagggtggtatcagcagttcctttagagtataatgaacaaacgtgatttgggaattggtgaattggccattttttataatgtgttttacttgtgatcttactggattgattgcagtccttgatccctcaaatgatcaaacctgtagagtttggccaggcacggtggctcatgcctgtaatcccagcactttgaaaggcgaggcaggcctatcgcctgtggtcaggcgtttgagaccagcctggccaacatggtgaaaccccatctctaccagaaatacaaaaattagccaggcatggaggcaggcgcctgtaatcccagctactcaggaggctgaggcacgaattgcacctgggaggcggaggttgcagtgagctgagatcgagccactgcactccagcctgggaaacagagtgagactccgtctcaaaaaaacaaaaatccggtagagttacagtgaatatcacctaacattttttaatttttttattatactttaagttttagggtacatgcgcacaacgtgtaggtttgttacatatgtatacatgtgccatgttggtgtgctgcgcccattaactcttcatttaacattaggtgtatctcctaatgctatccctcccccctccccccaccccacaacaggccccggtgtgtgatgttccccttcctgtgtccatgtgttctcagtgttcaattcccacctatgagtgagaacatgcggtgtttggttttttgtccttgcgatagtttgctgagaatgatggtttccagcttcatccatgtccccacaaaggatgtgaactcatccttttttatggctgcgtaatattccatggtgtatatgtgccacattttcttaatccagtctatcattgtaggacatttgggttggttccaagtctttgctattgtgaatagtgccgcagtaaacatacatgtgcatgtgtctttatagcagcatgttttataatcctttggatatatacccagtaatgggatggctgggtcaaatggtatttctagttctagatccctgaggaatcgccacactgacttccacaatggtggaactagtttacagtcccaccaacagtgtaaaagtgttcctatttctccacagcctctccagcacctgttgtttcctgactttttaatgatcgccattctaactggtatgagatggtatctcattgtggctttgatttgcatgtctctgatggccagtgatgatgagcattttttcatgtgtcttttggctgcagaaatgtcttcttttgagaagtgtctgttcatgtcctttgcccactttttgatggggttgtttgtttttttcttgtacatttgtttgagttcattgtagattctggatattagccctttgtcagatgagtagattggaaaaattttctcccattctgtaggttgcctgttcactctgatggtagtttcttttgctgtgcagaagctctttagtttaattagatcccgtttgtcaattttggcttttgttgccattgcttttggtgttttagacatgaagtccttgcccatgcctatgtcctgaatggtattgcctaggttttcttctaggatttgtatggttttaggtctaacttttaagtctttaatccatcttgaattaatttttgtataaggtgtaaggaagggatccagtttcagctttctacatatggctagccagttttcccagcaccatttattaaatagggaatccttccccatttcttgtttttgtcaggtttgtcaaagatcagatagttgtagatatgtggcattatttctgaggcttctgttctgttccattggtctatatctctgttttggtaccagtaccatgctgttttggttactgtagccttgtagtatagtttgaagtcaggtagggtgatgcctccagctttgttcttttggcatgggattgtcttggcaatgggggctcttttttggttccatatgaattttaaagtagttttttccaattctgtgaagaaagtcattggtagcttgatggggatggcattgaatccataaattagcttgggcagtatggccattttcacaatattgattcttcctatccatgagcatggaatgttctcccatttgtttgtgtcctcttttatttcgttgattagtggtttgtagttctccttgaagaggtccttcacatcccttgtaagttggattcctgggtattttattctctttgtagcaattgtgagtgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtgtgatattggctgtgggtttgtcatagatagctcttattattttgagatacgtcccatcaataactaatttattgagagtttttagcatgaagcgttgttgaattttgtcaaaggccttttctgcatctatcgagataatcatgtggtttttgtctttggttctgtttatatgctggattacgtttattgatttgcatatgttgaaccagccttgcatcccagggatgaagcccacttgatcatggtggataagctttttgatgtgctgctggatttgggttgccagtattttattgaggatttttgcatcgacgttcatcagggatattggtctaaaattctcttttttggttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatctatctggtcttggactttttttggttggtaggctattaattattgcctcaatttcagagcctgttattggtctattcagaggttcaacttcttcctggtttagtcttgggagaatgtatgtgtccaggaatttatccatttcttctagattttctagtttatttgcgtagaggtgtttatagtattctctgatggtagtttgtatttctgtgggatcggtggtgatatcccttttatcattttttattgcgtctacttgattcttctctcttttcttctttattagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgtttgcttttgcttctctagttcttttaattgtgatgttagggtgtcaattttagatctttcctgctttctcttgtaggcatttagtgctataaatttccgtctacacactgctttgaatgtgtcccaaagattctggtatgttgtgtctttgttctcgttggtttcaaagaacatctttatttctgccttcatttcgttatgtacccagtagtcattcaggaacaggttgttcagtttccatgtagttgagtggttttgaatgaatttcttaatcctgagttgtagtttgattgcactgtcgtctgagagacagtttgttataatttctgttcttttacatttgctgaggagtgttttacttccaactatgtggtcaattttggaataggtgtggtgtggtgctgaaaaaaatgtatattctgttgatttggggtggagagttctgtagatgtctattaggtccgcttggtgcagagctgagttcagttcctggatatccttgttaactttctgtctcgttgatctgtctaatgttgatggtggggtgttaaagtctcccattattactgtgtgggagtctaagtctctttgtaggtctctaaggacttgctttatgagtctgggtgctcctgtattgggtgcatatatatttaggatagttagctcttcgtgttgaattgatccctttaccattatgtaatggtcttctttgtctcttttgatctttgttggttgaaagtctgttttatcagagactaggattgcaacccctgctttttttttgttttccatttgcttggtagatcttcctccatccctttattttgagcctaagtgtgtctctgcacatgagatgggtctcctgaatacagcacactgatgggtcttgactatccagtttgccagtctgtgtcttttaattggagcatttagtctatttacatttaaggttaatattgttatgtgtgaatttgatcctgtcattatgatgttagctggttattttgcccattaattcatgcagtttcttcatagcattgctggtctttacaatttggcatgtttttgcagtggctggtaccggttgttcctttccacgtttagtgcttccttcaggagctcttttagggcaggcctggtggtgacaaaatctctcagcatttgcttgtctgtaaaggattttatttctccttcacttatgaagcttagtttggctggatatgaaattctgggatgagaattcttttctttaagaatgttgaacattggcccccactctcttctgacttgtagagtttgtgccgagagatcagctgttagtctgatgggcttccctttgtgggtagcccgacctttctctctggctgcccttacattttttccttcatttcaactttggtgaatctgacaattatgtgtcttggggttgctcttctcaaggagtatctttgtggcgttctctgtagttcctgaatatgaatattggcctgccttgctagtttggggaagttctcctggataatatcctgcagagtgttttccaacttggttccattctccccatcactttcaggtacacctatcagacgtagatttggtcttttcacatagtcccatatttcttggaggctttgttcgtttctttttattcttttttctctaaacttctcttcttgcttcatttcattcatttcatcttccatcactgatgccctttcttccagttgatcgaatcggctactgaggcttgtgcattcgtcacgtgggtctcacgccatggttttcagctccatcaggtcctttaaggacttctctgcattggttattctagttagccattcgtgtaatttttttcaaggtttttaacttctttgccatgggttcgaacttcctcctgtagctcggagtagtttgatcgtctgaagctgtcttctctcaactcgtcaaagtcattctccgtccagctttgttccattgctggtgaggagctgcgttcctttggaggaggagaggcgctctgatttttagagtttccagtttttctgctctgttttttccccatctttgtggttttatctacctttggtctttgatgatagtgacgtacagatggggttttggtgtggatgtcctttctgtttgttagttttccttctaacagtcgggaccctcagctgcaggtctgttggattttgctggaggtccactccagacgctgtttgcctgggtatcagcagcggaggttgcagagcagcgaatgttggtgaacagcaaatgctgctgcctgatcgttcctctggaagttttgtctcagaggagtacccagctgtgtgaggtgtcagtctgcctctactgggggatgcctcccagttaggctactcgggggtcagggacccacttgaggaggcagtctgtctgttctcagacctccagctgcgtgctgggagaaccactactctcttcaaactatcagacagggacatttaagtctgcagagttttctgctgccttttgttttgctatgccctgcccccagaggtggagtctacagaggcaggcaggcctccttgagctgcagtgggctccacccagttcgagcttccaggctgctttgtttacctatccaagcctcggcaagggcgggcgcccctcccccagccttgctgctgccttgcagtttgatctcagcctgttgtgctagcaatgagcaggctctgtgggcgtaggaccctctgagccaggcacgggatataatctcctggtgtgccgtttgctaagaccgttggaaaagcgcagtattggggtgggagtgacccgattttccaggtgccgtctgtcacccctttctttgactaggaaagggaactccctgaccccttgcgcttcctgggtgaggcgatgcctcgccctgctttggctcacactcggtgtgctgcaaccactgtcctgcacccacggtccgacacttcccagagagatgaacctggtacctcagttggaaatgcggaaatcacccgtcttctgcgttgctcacgctgggagctgtagactggggctgttcctattcggccatcttggctccaccccctcacctaacatttgtcaggcactactggtaagccaggcaagttcttcctgacaggttcttaacctgccctaataaacacctaagtttgttacctcaatcatatacatattgggtatatgcctggtagaattgctgagtcataggatatgcatattcggtttagtaaatactgccagtttttgaaagtgattgtactagttttacattcccagcaatagttgtataagatttcccttgttttgcatttttaccaatacttaaaatggcctgccttgagttgttgatacttgtgtcatttttgacatctgtcatccagactcaacctcctagggagcttgacccttcccttttttcagttttctctctagcctaggttcagtcagcaagacctatcagatttttcttttatattgcctttgtccttcctccattgccacagctcaaatattagtcatatatggagtaaatatcaggtgatttggatatcaggattatgacagtagtctgccagttggtgcatcttctagtatttctgcttttccaataaatcctgcacagccaagaaaatgcttcatgaaacaccgcaccattgctctgctcaaaagccgtcaacaacccttcattgcccattggatatcagccttcctccccctcttccttttccacctgtacctctcttccttcctcccttcttccgttctttttttttaattaaagtgtaatatatatgaagtgcactatgacagagattaaagtatagagcattaccaacacccagaagcctccagtttgcctcttcctagtcttctcttaagtcttctcttaaggtacccactattctgatttctgtcaccatacataggttttacctgattttgaactttatataaatgttaaaaagctaatttatagcttaaaaagtacaaactcttatgtctggcttcttttgctgaatgttctgactgtgagattcacctacactctgcttatagtgctcattttttttattgctgaatagcaattctattttatgagtatactacatttatttacccattctactgtgatgacatttgggttattggggttatttcactttgggacaattatgaatgctgctgctgttaacattttgggtgtttctgtcctttgatataaaaatatacacttatatattgggtatatgcctagtagaattgttggttcataggatatgcatgttaggtttagtaaattctggcagtttttgaaagtgattgtaccagttttacattcccagcaatagtgttaaattccattgtcctgcatttttaccaatacttgctattgtcagttttaaaaatttgtcattctggtgggagtgtaataatatgtcattttggattgaatttgcatttgcttcataaccagtgatggtgaatccctgtattgaacatttgaaaatcttctgttgcaaagtgtgctttattcaaggcctttgtgaaatttttattaggttgtccatctattaaattgtagaaatctttacatattttgagtgagttcttttttgggtatctgtattagagtcttccttagactgtggcttgtattttcactctctaatggtgtcttgtgatgaaaatctttgttttaatgaagtttgatttagtaattaaactttattcttattgcccttgtttcttgtttaataaatctttgtctaacttaagatcatgctgatcttttccaggtattttattttttttattttttttgtttttgagacagagtctcactttgttgcccaggcaggagtgcagtggcacgatccggcaccctccacctcctgggttcaagagattcttctgcctcagcctcccgagtagctgggattacaggcatgcgcccagctaatttttgtatttttagtagagacggggtttctctattgttggccaggctagtctcgaactcctgacctcaggttatccacccgcctcagcctcccaaagtgctgggattacaggcgtgagccgccgtgcctggccaggtaataaaagagccacctggctcttttatttatagtttgtgaagagttttaatcatgatattatgatattaaattttctcaaatatttttactgcatatattaagggaatcatatgttttctctcttattttattaatttgtggtatatattgattgctgtttaaatgataaattgccctcacattctcatagtaaacctaatttggtttgatgtatcatctttttaatataatgctaaatctgacttgctgatattagttattagaacttttgcatctaaattcatgagagagactgccctattatttttttgtggtaactttgtcaggttttggcatcaagttttatgttgctctcagaaagcaggttgagacattttccttttttttttttctattctttgaaagactttagataaaattggtgttattttttcttacattttgatgaggaattccccggtgaagctctttgggccttctctgtgggaaggttttaatttccgatccaatttctttgatcagcataagctgttcagatttcctgttttttcttgggtcacttttggtatgttgcattttgcagtttgttcattttatgtaaactctcacatttaaagtttgaaatttttttaaaacaacctactgtcttgtgactaggatggatcagtgatgatgtctcattttttattctgatattggtcatttgtgcttgctttcactccatttctgtctcctcgatcagtcttggtgtgttttatcacttttgtgcctttttgcaaagaaccaacttttggctttgctgattttctctcgttcatttgttttgtattttcattgatttctgctcattattattttcttccattactctctgaattttagttgttcctttagcttcttgagatgaatactttattgatattttttagtcttcttttctcttaaatacatttaaagttaaaaattttccctctaaccacaggtttaaatgtgtcccacaagtttttctttttctttttctttttttgtttgtattttttcttttttgttttttgtattgttttttccttttataccccacaagttttgatatattttcattatcatttcaattcaaatattgttaatttccattgtgttatcttctttggcccgtgggtttgttttataagtgtaccaattaatttccaaaaatttgagtatttggttttttttttaagttactaatttatagcttaattccatatggtcagtgaatgactcagcatgtggtcagtttttgtaaatattccatgtgcattaaatgtggactttgcatttgttggctcttatattctacatatatcaaataggcctagtgtgttcatcatgttgtttaaatatcttacatccttagctgagtgtggtggcacatacctgtaatcccagctagttgggaggctgaggcaggagaatcacttgaacctgggaggcgggggttacagtgagccgagatcatgtcactctactccagcctgggcaacagagtgaaactatgtctcaaaaaaaaaaaaaaacttacattcttattgatttacttgtctacttgttttattactgaaatagattttttaaaatctcccactgtgattgtagatgaatttttccccttttattctatgtttctatatatattgggtggcaacaaatttaggactactgtatcttcctgatttagttgacttttttttattatgaaatattccttttaattttaattaaacttcttgccttaaaatctattttgatattggccgggtgtggtggctcacgcctgtaatcccagccgtttgtgagactagggtgagaggatctcttgagcctaggagtttgagatcagcctgggcagcatagtgagagcccctcatctttaaaacaaaattaaaaattaaaaaaaagtttactttgatgaatcctagtacaatagtaacttttttggttaacgtttgcaggttaaggttttttttttttttttttttgagatggagttttgctcttgtcgcccaggctggagtgcaatggtgccatcttggctcactggaacctctgcctcccgggttcaagcaattctcgtgcctcagcctcccaagtagctgggactagaggtgctcgccaccatgctcagctaatttttgtatttttagtagaggtggggtttcaccacgttggccaggctggtctcgaactcctgacctcaggtgatctgcccacctcggcctcccacagtgctgggattacaggtgtgaaccaccgcacccggcctgcagggtaagttttttctgtctttctgcttccaatctttaaatgaccttacgtttaaggtattcttcttgtaaatagcatagagctagatatttttaatccatcttgacaattgttgtctattgttattatttattattgttattttttttttgagacagagtctcactctgtcgcccaggctggagtgcagtggcgagatctcagctcactgcaatttctgcctcctggcttcaagtgattctcatgcctcagcgtcccaagtaggtgggattacagacgtgcaccaccacgcctggctaatttttgtatttttagtagagacaagggtttcaccatgttggccaggctggtcttgaactcctggcctcaagtgatctgccggtcctggcctgccaaagtgctgggattataggtgtgagccactatgcctggccaatgtttgtcttttaattggagtatttagtccatgaactttttttttttttttttgagacggagcctcgctctgtcacccaggctggagtgcagtggcactatctcagctcactgcaacctccgcctcctgattcaagcgattctcctgcctcagcctcctgagtagctgggattacagatgcccgccaccacacccagctaattttttgttttttgttttttgtttttttttttgagacggagtctcgctctgtcgcccaggctggagtgcagtggtgcggtctcggctcactgcaagttccacctcctgggttcatgccattctcctgcctcagcctcccgagtagctgggactacaggcgcccgccaccacgcccagctagttttttgtatttttagtagagacggggttttaccacgttagccaggatggtcttgatctcctgacctcgtgatccacctgcctcggcctcctaaaatgctgggattacaggcgtgagccactgcgcccggccaatttttttgtatttttagtagagacggggtttcaccatgttggccagtctggtcttgaactcctgacctcatgatctgcccgctttggcctcccaaagtgctggaattacaggtgtgagccaccgcgcctggcaagtccatgaacttttaatgtgattactgatctatttggatctcaatctaccatagtattttattgtcttatttgtcacgtatagtcaacattcctttagtgttagacacatatttacccttttcagtgctcttcattttcacatttccatctgcgattattttctttcagttaagtagctccttttggtacttcttttggtatcgctggcagtaaaatctccatatttgtttgactgaagacatctttatttcactatgttttttattttttaagagtatatttggtgagtatataattagatattagaatttattttctttcaaactttatatcattctgttgtcttctagggccatagtatcttgtcaggtgtgaagttttggccttattagtcaggtgttaatcttatgtttgtgaatataatatgtctttttcttcgggcttaagattttctttgtctttggtttttagcaattttagatcaatgtggctaagcatgatttttttttttatcctgtttggtgcttgtaaagcttctttaattgatgtttttcatctgttttacaacattggccaatatctctttaaatagtgcatcttctcagtttttctctatttctggggctcccatgtatgggtgtttttgtttttgttttctgtgacctatgtcttagtaattttctaatcttatttttttctctgtactttaatctggatatggaaaatatgcctactttccactccacgtaagatcttatttgtctagttggcttttaaatctattaaaattctaatttgagttactgtatttttttggttctaagatttccgtctcattcttttctgtatagattccagctctttggtctgggtttccatcttttagcctgttttaatggccatgccccattattgaaatagctgaatcccttggcatctgttctgttgtcttctttttcctcttggctttcagtcatctgtttctctttcctggtatgcctgtagttttttttttttttttttttttaattcaatgatgagtattgtgtatgaaaaaatatacggaggtcaggtgctgtggctcacgcctgtaatcccagcactttgggaggccaaggcgggtggatcatctaacgtcaggagttcaagaccagcctggccaacatggtgaaaccctgtctctactaaaaatacaaaaattagcgaggcgtggtggcgcacacctgtaatcccagctactcgggaggctgagggaggagaatggcttgaacccgggaggcggaggttgcagtgagccgagattgtgccattgcactccagcctgggtaacagcaaaactctgtctggaaaaaagaaagaaagaaggaaaaatatatgggttctgagtatgttatcttcctccagaggaaattttagtgtttttctggcaagtagatcgtgtatgggcacatcacctttattcagttgaggtggtctatttccggtttcccttactcctagggcttagctttttttaggaccttcagttgaaagtttgggagtgtgttggagatgggtctattaaggctcctgttccctggcaggccctgaaatccacattttgttctagcaaaatctctgcttggctttttcccctttagcagcttctttccgtttggtttctcagtccccagtcacacctgtgcagcttaggaattagcaaatgccgggagggaagattgcaagcagaacgttgagttcctgtttctatggaatcttggcccgtagaaagtctgctttgataccattaatgtccagtgtttgttccggatgagactgctgcggagtctagtttatgcctttctatgtggcccagtgtgccttgcatatgaataaggaaatgctctgaggccagaggctgcagggaagccagctcagagcatttgtcagtactctccaatcctggctatttggatccttctggaatgccttcaaaccatttgctctctttgcttgcttgtttctttttggtattttatccagcttgcatagttgttctcagagggcgggtcagcctggtaccttctgctgggccatagctagcagcgtaagccttggagccctggcacttgaaaccccacactgtccaagcacaacttacccagccttgcctcttcacagccacctgttgtgtccaccctgtgcttagcctagactttccacacaaccttttcttgctgctctctcagtcctgtccattcccatcaaaaatcgaattgttcttcagacctgtacagtctccacttctgattcctggcattgtgacccatgagattcttcctctgcagtgaattcatagcaataactgaccggccactgtagcatttcttgatgtattatatcatgtgccttgtatttagctttcatccagttgggggagggcggggatgttgtagtgtacctctttgtaccaagattgatttgctgcatatcttgcaggtgaaagcatgtattgccaatgtagaacccaaccaaacagtggagatcaatgagcaagaagcattggaagagaaattggaaaatgtgaaagccattctgcaggcatatcattttacaggttttgtttgtttttttaacctaatttagtctgggtctgcctctagtgagttagtttgctagatgtgttatcagtcctggaattatttcataatttatagtattttacaccctctgccctcatcactcacacacacacacacacagacacacacacagctgacgtgctatttgtaggcctatcttcacctacaagattgactggcccctttgtacagcagctcagttggtggctggcttattccactcatcttaacagttcgtcatgtgccagaccttgtactagaactgtctttactgctggcttgttttctgccactagtgaaatagtttgaactttccaagtctccgtttcaccgtaaatagggatttattctcccatctatgccacaagatagttgtgggaagaactggggactctgacaaattacttcacactcagaaataaagaatagctataaattaaatttttggccttgcttatgcctgtaatcccatcactttgggaggctgaggcaggattacttgagtccaggagttcgagaccagcctgggcaacatagcaagacctcatctctactaaaaatttaaaaatgagccaggtgaggtggcatgcgcttgtggtcccagctgtttgggaggctgagatgggaggatcatttaagcccaggaagttgaggttgcagtgagctgagatcgtgccaccgcactccagcctgggtgacagagtgaaaccctatctcaaaaaaaaaaaaaaaaaaatttctcaatagtttgacatttaggttgttttttcatttttaccattcttccatggttttaacaactcagtctcaaagtgagccggagccaaggggaagaatgagcctatgatactcattgaacaaacatttgtgtacaaagtatacatattctaggcactgtggaagctactggaggcacagatgagtaagacatcaccttggcctgctgtctattgaggtgtcttcttgtttgcctcaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcaggtatctctctgggatgttatatgcctcatccgtgggcccaagatcaacttaaaagggggatgttttttgtattttcagtgtttcctaactgtgagttagaagtttgaccgttacctttccgatgcttgtttcttatttatataaaagcactatcccaccctcttttcttttgaaactctggatggcgttgaagcctgggtactggttaaaggattatgcacccctgaatggtggtcttcaagcttttatcctaagattgtacagagtgcagttgctatacttttgatccatcagggatttatggcgtgcctactatgtaccataccgagtgccttgctgaaccttgggtatagatctcattagagaagaaaggtttctgcagtgccatggaacaatgctgtccatcttcccctaaactctagcctacctttttgggttgcagttgagctaaggttgggtgaaaaaagtagataggaaattaatgcaaataggctgtaagtgcctcctacaagcttagcatttccccctctatggatttggagtaactctgaagctctcagctgtagatttaacttaaattgaaatgtggatgcagtcatgaagcatcttagccgtgtaacgtcagtgaagtttctgcagaaacagtctcttgcgaagctgtacccctggccatttaggcctataggcctttccaggctgccagtgactcttagttatcttaggcatctttttcattagtccttttttcagacctttttctgtccctcatttatttctctgaaatgtaatcgatgggcctctttttggttgacgtaattgaagggtcagtaaacaccacctttggaactgcagtcatcctctacttcgttttgttcctcacccctcttagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggtaagaagggtgcctcagtgcagaaattctcatatcccagtttatttgagtgaaacagggaaaataggtagaatccatgaagtagacctcttgagacactttctctgtttatatactatacattactcagaccggtaagatagaacattcttgtttctaccagtcttttccttcctctttgtaaatggtaaacatgattgtccccattttcccttctcctttgcccacccacctcagcagtgttctcgcagcctatgatttgttttcactgggggccctgcttcaggaaagacacctaatgataaggctgagtcatgggtcagttatggtggatggagccagaagactcatttcactgtgaagacaaatggacatgacacgtcagcacacacttactcctccctacggagcagtctctaaatggaaatccttccagactggctgagagagagattttttggtgaacctgtttcagttaaatgtgacatgggcaataatgaaaaattgggtgaaatgtttttaggaggcagaaattttgaagctgccccagatttcacaccatcggtctttgatttctctgcgcagttagattccagtccccagtctctagattgcattggtccagtaaggggcagccttagtccagaccaaaaaaaaaaaaaaaaaactgtatgggtccagtgggtccagaatatcagtgatccaggttccgattcccccagctgcactgagtgagattgaatatcagtgatccaggctccgattcccccagctgcactgaatgagattgaatatcagtgatccaggctccgattcccccagctgcactgaatgagattgatggaatctttctttttaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagaggtaagtaaccagtactgaagacagtaccaggtgggtagtactgtctgatgaagggtacatcacccttctgatgaaaacagacacctacctgttcatctggatggaagagcaggtttgagtatagacactggcatttttgaacaattcccatgatcacctggtcccttcttaaaatgctcaagatgttttttaaaggtattagttgatcatacattttagttgaaaatcatttgtggggcaataaaagccattttttgaaaaaggtgtatcactcaagaagtacttatggaaaaatatcaaattattgagggcattaacttctgggaaagaccaggcaattaagttgtcacagtaactgctactaatttaatgccaggaatagagatgccaaaaatcctaaaattttcagaaagggctctcacagaaatgtagcactccactcaaactgcaatagcttgattctgttgagaaacactgatctaaataaatggaaaaataacccacattcactaatgaagataataaggaagacccaatatttttttttttaaaaaaggaaagtatttttagcttttatgaaagctttaagtaatttttcctcattttcctgtttgaaacttttgaaaaggaagttcttcagtgtttggttaggcgcagtgtattctaggccactgctttataaatatggtgtgagaaagcagtaggataaaataatcagagttcagtgtgtctcatattttgtttcctaaaagtttagtagagctgtgaatgtactaggaagtcccctctgaaaaagcacagttagttagaaatctgcccataaactcagggggactcaggcgccccccgggtcttccctctcctgcaggctctccggttagtgtcctgatttgccgtaaccatgggcctctgacctgctggcacctctggttccttggcgtgtgggtcactcacagatatgaaaacctgtgtctggctgaccaggttctcctgtagccctcccttgcccaggcacagataggagtcatgactggcccaaggccacgttcagacttaaccctgcaatggccacgaagtaacctccgtgtgggagagctccaggaacagtgcaggggattaaagccagcttggagtaccctttagaagaaagtttaagaataaaagagacagggccaggcagcaggcgttccggggtacagtgagctatgatgagaccttcaagctcttgccttccaggcctgtggtggggaccagtggcatgagtcagcaaagtaccagcactcctcagataagtgatattaacagaatttccacaatcactttcaagttgaataaagcttttaataaaacagtcttgttctttatcaatacctgtaaattctcttaaagcagtagcaaaggcgactgtagcaagagctcaaaaggcaaggcaatatcggaaagtgtatttaacagaagattaaaaatataaatgtagaagatctgtttatatatttttctttcagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgg

SEQ ID NO: 14998 - DNA, 5749 bp, Human
gagaatcccaaagatgtttgtttacattggctattattgtaaaatagtcaaagtataacatcatgaaccaaaatagtgtcaaaacaaaatctgttccactgtggcacgtatgtgacagaaacacatgcacacaaagtacatcaaaaggctcgaactgtgggaggactcggatagtaaatcacttccagacttaatatcagaagagatacggtgcatccaacgctgtcagggacagagtcgcaggcagcattgcctggcctggggaaggccctccgcaaacttctggctggacaggaaacagtttacctccttcctccaaactgagggggctgaatttcaggaaggtgagctccacctcagtgccacccactctgcctccctggagaggcgtcatggggcgcatagctgtcacgtgacggtcagagactgctggccccaccagctgagaaattaatcattaattgaaggaaaaaacactgtttccccattatcgagcttttctttcagcttctaggcctgccccttccgctttctgaaatgcaaaggaggtagagattgaggcagaaagtaaataagatttgaatattgcctttcctggagttttctagttcattgttttctggagcaaatattttcaaaaacaagaaactgacacactgtggtcaaaacagaattctagataagctacaattatgtgaaaattaaggtatttaagtaaatagctgcaaactttttaaaacttagactgaaagaacgagttcttaaaagattttcagccaaaaaaaaaaaaaaaaaccttgaacccgtattcagtactagtgctgaaaagattccaaacctcatatgacagaatatttttttttccttagtgtgaagatgtctatcaatggctagggccacctatctgtcacaaagctttggaactcctctaggtgttggaatgtgacaccagaaatcacaattagtgcataattaatcacattactttgccacctacacggaagggcacagaccggcagcctttcaagggcagtgtatgtaaatgtagtttcaatatgcaaattctcctaattatttccgattaatacgatcattataatagccctgcctccttcttgaaaaggaaccctgaaagcgccctgcctgtgagagctccttagcgaccggtgaggttgggcatggtttgcaataagtactcattttcttgagtttacagtaatgcctcccgcgctgctccgggttgcaaaagcccacactaagcctgtcgtcgaatgcgtgcgtgggtggtttgtttgtgttaacataacttttccttatctgaagagacgaactcactctacaaacgtgactcttcagtgacaacctaatttgcgttttcactttcttctgaaatgctttctatctttcctcacgctctccctccgatgggttgcagtgaactgtggcttcccccctgcggtgctgaactcgcccgtgtagctgtgattttagagctgccgacagctctaaggtgtgtagggcttggtctgggaacacccccagggcaagggtcccgccgcgcgcttggaattagaattaagaatgcatatttaggcgcccagggtctgcccccttctccctcctcctaaacctcccccttaccatccgcgttcccctcccccatcttcccttctcttcctcctccctcctcctatccctcctcccgcctccctcctccccgccccccgcccgccgctccccgccccccgccccccgccagccccgcacttactgtactgtactctatttaccaccccagctgggctcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggtaagacctgctccggggtccccgccccgccgccgcacactcccgcggtcgtctgggctgtcactaggagatccgtagcccagacggtgactttcgtatgagctatttaactttattttcttcagaatctgctgtagattgagctgtgcgtgaaattgctagtaagttctgacatgttaatgcgtctgtctttaaatctgaattgttaccataaacgtgtttaatggaacttgctggtctgtggactacaaaaaaaaaaaaaaaaaaacaaaaaccctttctacttaacattgtcttaacctcgtactctttatcctctttctttccaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttggtaaatgcatgcttacttcgcggtgttacccgtactacattgtctcactagacatgaaggagcttgtagctttgggtgctcgagatcacagaacattttcctttaaaaggaaatgatgccaataacttactacgaaggcggccgaggaacgtgtgtattggctttgtagcaaatgtaatgccctggatcttcctacgagtcctctggtactatgaggtactaacctccactgtaattaatcttaccgccacaaattccatagtgatcctccttccctaaaactatagtcctctgggattctctgggctagttgaggattgctaccctgtgccttcaaccctgtgatgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacgccagggtttgcccaatctttgagtgtttggttaaatgttcaaactgtggcttcctcccggcgccagtcgcccgcctctgcccttaggttacattctcttaaacatgcctttctcccccactctttcgcaggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaatacctgaattccgagtggtttttaagatctctggcattcactagctcttttctctccctgtctccccctctcggcccccccccccacacacacacacacacattgttttctttatccccttctccttcatccccccaccagcagcacccctgaagcttttacttgtgtacagagaatcttatcagatgtgtggtaaggcagagggctgagttgacagggactggggaggctttgagcacagaagtgcctcgagtccttaagagaaagcttggttctgtgcctcagggctgagtttaaagccaagaatgagttgagtctgggagtgtggaagcactacctgtctgagtgggcgttaagacgcttctctggagtaaatgaaagttaatcaggagaagaaaagaggctgtacagaattcagaacatgatttcaggtttaagggaaggcagaaacacccgagggttactgtttgcacagggaactaagctgtcacctggccccgggctcctgaggcctccttggcttcgcctgcgtccacacctgtagcccccccgccacaccccacccacctccgggcctccggagacggggctgggccgggcgcattttcccggacttttcgatcgccctcagccttgactgccgccctggactggaaggaagaggcagcgggcagaagcctttcccagccaaagaccgcgggtggccacgtgctcaagactggtctgcgttttcagtcccggggcgcgaggtgggctgggaggctctggaaggcgggtcccaggtggacgcgaaccgggggaggaagggatccgggcggggcagcagctcacctggggcggaacaggtgttcgggcggcgccaccgaggagtccgcgcgtctccccgccctgacccccgatcgctccccgcgggcgctggcgctggaggagggcgggggccgtggagccgcggccgcccggatcgccctgcggacccgcgccggggactgggctctgccggggccagcgcggggcggtcgtgtggttgatcatcatacccggagaagccctgagggccgtaggggcgtcttccccgtcgcaggctacccgcggacctggcccccaggtccccgccacctgtcgccagccgcggccccggccgacctctgcgcggcggggagggaagcgcgctctggtcccaacccgacccccgcctcgcctccgggagaggcgcagacgccggccgcacgctcgccccccagccacggggacccgcgcgtagtccgctcggacggccctggggagcgtccccggacggaagcagtgcgggcgggactgtggggcggcccgggccctttcgagcccctgccgg

SEQ ID NO: 14999 - DNA, 46288 bp, Human
tacatcttagagtaaaacagcccaaacaaagtgtattttacaacagatcaggaagagttaatgaggttaatattaaggtccttatacccattcaaaaagctttgtacttaagaatatggaaaaatatatgcactgccaatgacaattgtaggttcagatctaactaaagtaatatgtaaaacattacattttcttgccttttcatatttagaacttaatgacttggggtcatgagaaacctcaaagttattctgtaacagaatgaacctctggggcaaatgaagtctgtacggtttaagtcctacaccatgatggccctaaactgagctttcttactgtaaatctagtttttataccttttttggcctcatttcttgctgacagattgtcactttttggtaagttaagtgggcttggaaaccagataactgcatttgtaaaacttccatgttaaaaacgaatacacagaaaaggaacaaactgttgtacacacacccgggattgatctcaggggaattatgctcagtaaaaaaatccaatctcaaaagattacattgtataattccatttatataacattgagatgataaaaatcatagagaattattagtggttgccacaggttagtgtgggaggtggctatggctatcaaaggacagcatgagaatccttgtgatagaactgttctgtctcgactgtgttggtgattacacacatataagcatgataaaattgtctacaagtgaatataaaaacgagtacatgtaaaactagtgaagtctgaacaaggctgggtgaattatgtctgtcaatttcctgaaattgatattgtactataactatgcaagatgttaccattgggagaaactaggtaaagagtatatgggatctctgtattcatgtcactctaccattaagattaaatattaaaaaaaatgaatgcacagaatcagagaggcactcttaaagtgctgtcaacacatggcctttgaatacaattttgggtgctcaaagaatttgtagattgcttgatggttctaaaaagagaaagctcaaaagagctagatcctacataaatgaggtactattggtgttccatcttcctgagatgaacctgttaactagggcagttgccgtcagatctgtttttattcgcagtattttgcttaagctttaagatattttgttattaataattggccataaaacccttttgtgggcagagggaggtgtaggggcggggcgtgctatggaacttcaaatgggcaaaaccgaaagtactatggctgattgcagctgtaacaggtctttggagatacgtaaaatcctttaaaacagtgactgtctccctttatgcataaaaattttttctaatctactgggtgctcagaaaggatcacggaaagaggccattattaaataaaaagcagaaattataccaatgtgactttggattttcaaataactccagccctacctgcagagaggcagattcaaactactagcgatgttaagaactgaaatggattttaatctagtgataattaataaaataactgaattaccttcccaatagtattagttactttcccagtttattagggtgtggacaagaaaaaggattactgggtttccactttctagtccagagctctttttcacgggaacagagccctgtaaaagtttccctctctccaagcactttctccccttgactgttcctgaagaaggaacgatttccagttagcgtttaaattagcatagtgcttaactcagagcttggcttgcagggaaaactagaaaatacgtggtttcattgctctgcggcctaatcaaaccctggacaagagaagaggaagaaaataggatatacttgcagcgcgcaagcgctgcacaaagaaagcatgtcctctctgagtcgccgtaggtgctaggtggctgtggcttcggtcgttaccccacccccttccacgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccgggtgggggtacgggtgggggtgcgggtgggggtgggggcggagggctaggaagctccgggtcggacgctccatcccgtcctttgtattggccgggggtcttttccctcccaagacccctaggcgtaccctttcaggcctagggctgctttgctggaggaaggggaggaggaagcgggtggggcgaggtgggggtgcagcgcgttgattaagggacccgcggacatagagtcggaacccaccaaggaccgcgataaagcgctttagggttttggcagagtattcaggcacaaggtctcttaacttgagcatgcagattgtgtgttgtgtaaaaaccatacggtccataacattgtggggtgtggctggggggactgtcactgttctgtgggccttcattcggctatacagcattctcaaacactggaccgggatgcgatgagggagtgatagataatataccttatgccagagctgataatgtggtttttactagaatttatttttatgggaacacgatatagattgacctgccctttctaatactttaaaaggtcactataggtacttgtttgtgggtttttttttttttaatttgtaatgatatgtctgtgtttatttttctagattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctaggtaaacttcgatattattttgagaatgaaatgaaaaaagaaaaaacaaaaataaaaaactcatatttcatattcctttataattagaaatgcttaatttttgtctaaagtttttctaggatctcttcgatagaccttttattaaaaatgcgaacttctttaaatattggttgtttgaaatagaacatctcagtttatcttagtaaacctaaagaaattgtaatagtttagatattcctcaaaatgtcataatttttgtagacttcaatatattaatgtggctgattattttctctaggcaacaggttgaggatgtgtattggaatatcttaattccatcgtgcacttaacttcatgttacttagcttgtaaaaccaaaagaactttgttctttggattacccacccaaacaattaggtgaacactggaataaacatgtattttccagaaaagtttaccttttcattttttatgcatttttgcaaataagaaaacaactatatttctgaactttttgtaatgtttaatttttgtgggtacacagtagatgtatatatttatggggtacatgaaatgctttgatacaggcatgcaatacataattatcacatggaaaaatggagtatccatcccttcaagcatttgtcttctgtgtgacaatccagttacactttcagttatttttaaatgtccaattaaattattattgactgtagttaccctgtgtgctatcaaatatcgggtctaactcattttttctgtacccattaaccatctccacttccctaccactacccttcccacctctgataaccatccttttactctgtctccgtgagtttgttttgatttttagcttccacaaataagtgagaacatgtgaagtttgtctttctatgcctgacttatttcatgtaacataatgacctccagttccatccatatttttgcaaatgacaagatctcattctttttttatggctgaatagtactccattgtgtatatgtaccacattttctttatacatttatctgttggtggacacttaggttgctttcaagttttgactgttgtaaacagtgctgcaacaaacataggagtccagatatctctttgatgtactcatttcctttcttttggatatatacccagtagtcggattgctgaatcgtatggtacccctgtttttagttttttgaggaccctccaaactgttctccatagtgggtatactagtttacattcccaccaacagtgtacgagggttcccttttctccacatcctctccagcatttgtttttgcttgtcttttggataaaagccattttaactggggtgagatgatatctcattgtagttttgatatgcatttctctgatgatcagtgatgttgagcaccttttcatatgcctgtttgccaattgtatgtctttgtgaaatgtctgttcaaatcttttgcccatttttaaatcagattatgagttttttttttttcctgtagagttgtttgagctccttacatatctggttattaatcccttgtgagataggtagttagcacatattttctcccattctgtgggttgtctcatcacgtatgtcgattgtttcctttgctgtgcggaagctttttaacttgatgtgatcccatttgtccgtttttgctttggttgcctgtgcctgtggggtattattcaagaaatttttggccagaccagcgtcctggagatttttcccaatattttcttgtagtagtttcatagtttaaagtcttagatttaagcctttaatccattttgattttatttttgtgtaagttgagagatgggggacaagtttcattcttctgcacatagttttccaagcaccatttattgaagggactgtcttttctccaatgtatgttcttggcacctttgtcaaaatgagttcactgtaggtgtatggatttgtttcttggttctgttattttccatgggtctttatgtctgtttttatgccagtaccatgctgttttggttactgtagctatgtaggataatttgatgtcaagtaatgtgattccttcagttttgttctttttgcttaggatagctttggctattctgggtcttttgtggttccatataaattttaggatttttttttttttctgtgaagaatgtcattggtattttgatgggaattgcattgactctagattgctttgggtggtatggacattttaacaatactgattcttctaatccatgatcatggaatatctttccatttgttgatgttctcttcaatttctttcatcagtatttatagttttcattgtagaaatctttcatttatttggttaaattaattcctaggtatctaattttatctgtgggtattgtaaatgggattagattacttcttcaatttctttttcagattgttcactgttggcatatagaaatgctactgatttttgtatgttgattttgtgtcctggaactttactaaatttatcatatttctgaattttaaaaatgtataccgtgtctcctttttgtgagtgattctgtcaagaaaaaaaaaatttataattaatatgctttccaaagtaatgattcttgtttaattgaactgctaaaaataaatacaacttaaactgataaatattgtttaaacagagcagagtgaaaattatgcttcaaatatagaaaggatcttttagaagatagtttgcagtttgaaaagaaacttaatattttacttgcctattcccacttcttaatcagcagtaatggaatacctcctgattctaggttacttaatactaggtttctattgaggtctatttttagagaagggaaaagaaacccagttttatgatatttaaaatgataccattatatacataagccacatatatttcccttttttcatgttcatgtaggatagttgaatgcaaaatagtgaatacattcattagtgtttttcctcataatttaaaaattttcattgttagatcctcaggatacctaaggttatagctaggaaggtaaagaataaaatctgcccttagttggaacaatgccctagtcttaattgaagctgccttagctaccttcctccaaccaataaataaatacatactctccagtttaatgtatatttttgccattaagaagagttgagactgggcatggtggctcatgcctgtaatcccagcactttgggaagctgaggcaggtggatcacttgacttcaggagttcgagaccagcgtggccaacatggcgaaaccccatctctagtaaaaatacaaaaattttaagtggctattaaatgaagagttctgtgggccagatgaaccaccgcatctgaccctcagaactctgtttcatagccgcttagctctaatcattagaaatgtatttctcatatttaggcccaaatctggttcccggtaactactacccattagttgtagttcttttcttcataatggccctaaggttattgaagacttgtaatcattctttgttctccccttcccaagataattcatttattttgatgatctaaacagttgtagtacagtgtgctactacatacttctctgcctttgagttttggatccagaagatttttagtactataaattcttcagtatgcaatgataatggtgtgaaattttagatagttttgcgtaaaatactttatgttgcagagtttttaggctaaataacagtaaactagcattttatctttaatgtgtcatccttaattctaaataatgactactaatctagaacatttgaattacctcccagttttccagatgatatcttaagaaagattctaaagttttacagcctgcctgcagaactatgatgagattttagaaataatccactactttagttttcagcctttttgagtatgacgtttctctttctaatgttaaaaaagttacatatttatcctcccataatagtagttttaactttgttaaaatgcacacaaatagctaaaagctgttttgaattcaaaatcaattaatagtatgtatttacattttgaaaaatagctatatgtgttttgaaacacgtttacttggtatgactgtagattcatggagcctgcattaactcaattggttaggaaccagaaatctaatccagcgccttcatattatatataaagagtctgatttccagagataaatgacttgagcaaagacagattatttggtggagaaccaggtggagaaccttgtcacttgggtttgtacttttattaccattgctgatactgaagtaagaaggtacattttattttgttaattgcttttaaatttatgtgatgaattttcttttgaaataattgtgcttttttttttaaaaatttttgattcagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggtaaaccaaatcataattatttctgaatattgctttgaatttaaatgtaaaattggtagaatgggctgtgttttaattgttaaaattgagtctttgataagatgtaagttgtagagatttggaattgtaaaagagttatttttaaaagttttattgtcacttttcagacattttctatgcattttatgtgtatatattaattaaaaaacagtgacacacatataagacattgatgagataggtaaaaattgcttcagtcaacaagaatatgatggaaattgtcggtaatctaggttttttctcaaacgtattttttttccattggaaagttttgcattaaaattttctttttgtaaaaagctgaaactcagcatttcatattttaatttttatatcaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctataggtaaataaagatactgctttggcttcattctgtgagtactgtttagtcttttagactagtggttccaaagtggttgcttgcagactgaatatagcttgaagatatattttgtatggccagcactgtattttttattatgaacattgaaaagtcaaaagatctggcagcgctgttcctagcttccacaagacaacattctgctgaacttgtataacagtaaccccctttaaataagttatatactttacagtttatgacagtgcttgtcattctcaaccgtattactccaagccactttatatgttcacttgcttagcctctataggcttttaactttggtccttgttttagaattcgttttgtggaatgtcggtctttttactgtcagaagctttgaggaaggaactttttaaatgagaagggctacagttataactgagtccaattcttagaaagctgaagattttgaatttttatttgtttttgttttgttttgagatggagttccactctcgttgcccaggctggagcacagtggcgcgatcttggctcacaacaacctccacctcccggattcaagtgattctcctgcctcagcctcccaagtagctgggattacaggcacccaccaccacgcccagccaatttttgtatttttagtagatatggggtttcaccatgttggccaggctggtctcgaactcctgacctcaagtgttccactcgccttggcctcccaaagtgctgggattgtaggtgcaggctgccacgcccggctgagattttggatttttaaaccaatttaaggaaccagttagatgaagctagaatgctcagtttttacagtcacaggtatcaatttattaaggactacaatgtaatttttataagcatctttgtactttagtagatttgttggttaagatataatttcatagttatcttactgttagattttatccattaaggaaagtggtattctggttaataatgtagatgagccaggcgtggtggctcatgcctgtaatcccagcactttgggaggccgaggcgggccgataacctgaggtcgggagttcgagaccagcctgaccaacatggagaaaccccgtctctactaaaaatacaaaattagctgggcgtggtggcacatgcctgtagtcctagctactcaggaggctgaagcagaagaattgctcgaacctgggaggcagaggttgcgatgaaccgagatcgcgctattgcactctagcctgggcaacaaaaccaaaactccatctcaaaaaataataataaaaataataataataataataatgtagggtgagttcctttaatgttaccatacagactacacaaatttcagaatttaaactatagtgcacatagaaaaattaggccatttataggacaattggaaatgtgaacactatgtcttgatattaggaaattattaattttgtgaggtgtgatgatgaataattagttttgcaagtaaagagtccttgattttagagaaacctaccaatatatttacagaagaaaggatacattgcctgtgatttgcttcaaaataatatggcaagaggtaaatttggcaaggatatagatgaaacaaaactagctatgaattataattgttgaagcaaggtgatggattttattaagctagtgttcactcttctctgtactaatatttctaaatttccaaaagaagaggcaagtcagtaagcaaatagtacacaactaataaaattcaagggactatgtttttcctcttaatgtaattcttaatatattgatatgcttaaaatgtatgcacaacagttattagagacattggttaacagatggtgtgttgaataaatcagctttttctgtattgaactagaaaacgtataatttgataatttaatagatgaaggtataactttgtgtttccttctaccagttcctttttttttttttttttgagacagagtttcactcttgtcgcccaggctcgagtgcaatggcacgatctcagcttactgcagcctccacctcccaggttcaagcaattctcctgcctcagcctcccaagtagctaggattacaggcatgcgctaccacgcctggctaattttgtatttttagtagagatggagtttctccatgttggtcaggctcatctcaaactcccaccctcaggtgatccgcccacctgggcctctcaaagtgctgggattacaggtgtgagccactgcgcccggctccttctcccagttctaattgatttgaagtttcaaaaagcaggccgggcgtggtggttcatgtctgtaatcccagcactttgggaagccgaggtgggtggatcactcgaggtcaggaatatgagacaagcctggccaacgtggcaaaatgctgtctctactaaaaaaataacaaaaattagcctggcatggtggcacgtgcctgtagtcccagatactcaggaggctgaggcaggagaatcactcgacctagaaggcggaggttgcagtaagccgagatcactccactgcactctagccttgtctgggcacggtggctcacacctgtaatcccagcactttggaggccaaggtgggcaaatcatgaggtcaggagttcaagaccagcctggccaacatggtgaaaccccatccctactaaaaatacaaaaaattagctgggcatagtggtgggcacctataatcgcagctactcgggaggctgaggcaggagaattgcttgaaccctggaagtggaggcagcagtgagctgagatcgcaccactgcactccagcccaggcaacagagtgagactctgtctccaaaaaaaaaaaaaagcaaaagtatgttgtaaagtttgattaaatttaattttggtattgtccagagagttactaaaatagtaaagtaggcttttattaaatatggatgttacctgttttatttaaagaaattttgaacatcttatacctgatgctcctgaactgatacatgattttctggtgaatgagaaggatgcaagttgcaaaaggaatgcatttatgatgctaattcatgcagatcaggtgaggtactttttaaaaaatactcttattactgtatttaagtgacaattaaaagtattacatagacttaatcatgtttttagtcagtaattttgtttatagttcatgtggtttgtgtattttgaaatttttaagcttgtagaaaaatacatttttttcttaacccttctctaaaatattgcatatgtatacattcttttttcaattaaacattgaagaggcattttagagcagccaccctacagtttttaaaaattaaaattattatgactgttctttcctatgatggtatagatctaaaattgtttagtagagaaaaatagtagctttgcatagatacatccttagccatgcctgtggaaatagggtggccttcagtgtagaggtgtatccttttaggttcttcaactttcatacacgggtgccaactccacatcctgctctgctggtggttaaagtacatggatctacttttggttagcaattactctgtacaccttgatgccatctaatcttgaaattttctagccagtatttatcaccaaaatatgggaaataatatgcatgaagtctgaaaaatatggaggccttccagtcctctgaaatctagacactgtgacttttttcccccagatcttcctttaatggattgtcccccagttatttaaaattgtggtaacatacacataacaaaaaaatttaccctcttaaccatttttaagtgttcaatgattttaaatacatttataatgtagaaccatcactatcttccatcctcataactttttttgtcttgcaaaactgaaactctgtacccattaaaaaatagctccttattaccacttcctcccagtccctggcagccaccattctacttgctgtctctgtgattttgactaagtattccggataagtggaatcatacagtatttgtccttttgtgactggcttattttacttagcctaatgtcttcaaggttcatttatgttgcggcatgtgttggaatttctttcctttttaaggctaaataataccccattgtaaatatatgctacattgtgtttacctgttcatccattggtggacacttgggttgcttcaatcttttagctattaggaataatgctattgtgaacgtagatgtacacgtatctgtttgagactttgctttctgttattttgggtatacacccagaagtggatttactgaatatacagcaattctgtttttaattattttaggaagtgccatactgttttgcacagcagctctaccattttacattctcactagtagtgcacaagggttccattttctccacatccatgccaacacttgttgctattgtttttttgatagtagcaatgttaataggcacgtgaagtggtattcaatattgtcattttgtcttcctaaacaagattatgagaaagctgcgtatatgagcagtgttttgtcctcttgtgtaattggttttactgaccaatgcttttggcattatgctgttaacctacattgaggggcgtaatcagaaatagtccaataaaatttattgatacttttactggagagatgttttcagcattgtagttctgtatattacagtgtccaatatatgaggacacataggagatttttcttttaggtctcagtaataggaataactatacacctaagcagctggttttgattgtatggataccctgaatcccataacacatagtgttttccctctttggtttagctgctagaaaatcagatcccaggtttgtggctcatttccagaaaatatatttaactttatgtcttatattttatatgttaattttattcttgatttttttcccagttaatttctctttgccctgatctcctcatttgttttatattgagttgtaatgtgtgtattttttaagatgcattaagtccttctattgaatgaggtggagaatgataaatatattcttattttttttaggatcgagctttggattacttaagtacttgcattgatcaagttcaaacatttggagacattctgcagctggttattgttgaactgatttataaggtaagaatgataatctatgatgagtaaaataaactcagcagtttaagacagggttaaatactttctttctgggataattattgctaggataatatattttaatagtataaatattttatagcatagcctattaaagcctttgtttcttttacttttggtttattgtattttccaagtagaatacttgcttatatcctttctaaacctccataaagattttgataaaaattcatggcttgagccagtgtagctgcacataaatcattgtgaacttcccagtcactgaatagattataattaggctttaaaataaaattcaagattttcttgagcatacatcagactaaaatcaaacaaaaaagccttaaatactttttatgttccctgtttgtaaaagagaatagaaaaactttaaatgcattaatatgacattgtaggccattgacaggaaatctaaaaccagctaagaattttggatttttaaatcaaatactatattggcaacactttactatgatatatcctttgaaagagttggttacatcttaatgttctgataaaaggtacaagaagatccaactttgctattgataccattagaggccaacaaaacataggtccagatggctttattaaatatgatagtatggtcaaaacaccggtagacattactaactgattatagctgtcttgcttctgtaagaaaggggctcctcttaacacaaggtaccagtagtttggaatgggaatttaagatgaaaccaagacttactgtacagtttttttttgttttttttttgttgttttttgttttttttgggcagagtctcactctattgcccaggctggagtgcagtggtgcgatcgcggctcactgctgcctctacctcctgggctcaagcgattctcctgcctcagcctcctgagtagctgggattacaggtgcacgccaccgtatccagctaatttttgtatttttagtagagacggggtttcaccatgttggccaggctggtcccaaactcctgacctcgtgatctgcccaccttggcctcccaaagtgctgagattacaggcgtgagccaccatgtccagcctatagttctttttaattcatgtgtatagtttaggataccactgaggttctcaaaattagcggttccctgctatctaatgacttaagtagggtccatgttatagtaaaaggaaataacttttaagtcatgtccatgtaatagagttttgactatatatattttaggaaaatctactacaaatactgacttcaaaagagaaaaaataagggatatttactatacaagtaaaggtatcaggatacatttagaatgggatagaaatttttagttttctctccaatgttgaatatagtctcaaataataagtagtagtacttgggaaaaatgtgttatctttcttgcttgaaaaactggtattttccttttattagctattgagatttatatcatccgtcatgtttccctttggcatccagaataaacatttaggaccaaatttaatatcctgtgacagtacccatattagtgtactgggttaatgtgtccttacttttgttactttacattttctttttctctttcacttgtgtatagcatacacattttaagtcatcagaaaaccttttacgaaacagtaaaaatataaattatgatgggatgaataaataagtgcacagctgtaaaaattattttgttcacaccatcctatctagtaaagccatttcttatctatgtttttgttggcctctaacttgcttctttctgaaattactgatgttgtgtcatagtgtctcatcccattttgtctgatattttcatgtcctcataagactgttcttagctttcatattgagaaaactagcatcccataagctgacattcatgaaaaaactccatttgaaaacaagcgttcctgaaatcggttgaaatgttaatgttttcttctccaggtctgtcatgctaatccatcagaaagagctcgttttattcgctgcatctataacttattacagtcatccagccctgctgtaaaatatgaagctgctgggacattagtgacactctctagtgcaccaactgcaatcaaggtactgtgtatttcttttggggccagattagatgatagattttctgtcttagcactcatgatttagtgacatttcaattcactatgtggttacatggcacagagagaataactacaaacttataaaattatttgatgccttacattgttcagccttccttcttttcttccttcctgctttcatacacacatatatagatacagacagagaatgacagtacagttaacctctgacaacacaggttcgaactgcgcaggtccacttatacatggactttttttctacctctgctactcctgagacagcaagactaatccctcttcctcttcctcctcctcctcctcagcctactcagtgtaaagaggttggggatgaagacctttatgatgatctacttcctcttaatgagtagtaaatattttccttatgcttttcttaacattttcttttttctagcttactttataagaatacattatataatacatttaacatacaaaatatgggttgttttgttttgttttgagacaaggtattgctttgtcacccaggctggagtgaggcaatcttggctcactgcatcctccacctcctgggtttaagcaattctcctgcctcagcttcccgagtagctgggattacaggtgcccaccgctatgcccagctaattttttgtatttttagtagagatggagtttcaccatgttggccaggctggtcttgaactcctgacctcaagtgatccgctaacctcggcttcccaaaatgctgggattacaggcgtaagccaccgcgcctggccacaaaacatgttttaatcaactgtgtcattggtaaggcttctggccaacagtaggttattagtagttaagtttttggggagtcaaaagttacgtgcgtggctgggcacagaggctaacacctaaaatcccagcattttgggaggccaagctgggaggattgcttaaaaccaggagtttgagaccagcctgggcaacaaagagagactctatctgtacagaaccttttttttttaattagctggtgctaggtgtggtggtgcatgcctggagtcccagtactttgggaggccaaggtgggatgatcgtttgaggccaggagttcgaggttgcagtgagctatcgtggtgccactgtactccagccaaggcaacagagaaagacaaaaaataatatgaattagctgggcatggtggtgtgtgcttatagtcccagctattctgaaggctgaggcatgaggatagcttgagcccaggagttcaagactgcagttagctatcattactccagcctaggtgaaacagtgagaccctgtctctaagaaaataaaaattaaaagaaaaatgttacatgtagattttaagttttagtgagtgttttcaataatagagtatttacctttctccctttctctaatttattctatcaagactatatcatcagcccctaatctattcagagaatgagctgttctaaaagccaaattgtttaaattggagaatttactgctttacccaaaacttgaactttttttaatttttgattttgaaataattttaaacttacagaaaaattgcatagtacaaagttcttttctgttgttgtttttttgttttgtttttgttttttgagacggagtctcactccgtcgctcaggttggaagatactggtgggatcttggctcactgcaacctccgcctcccagattcaagtgattctcctgcctcagcctcctgagtagctgggactacaggcgcatgccaccacacccagctaatttttgtattttcggtagagacagggtttcaccatgttggccagaatggtctcgatctcctgaccttgtgatccacccgcctcgacctcccaaagtgctgggattataggcatgagccaccatgcccgatgaggacaacattcttatatatttttcacccagcctttctcatatgttcacattttctataatcatataattgtcaaaactacaaaattaacatcagaacaatattattaaccaaactacaggctttattcatatttcatcagttttcccactgatgtcctttttttgttcaggatctaacctaggatcccatattgtatgcagtggtcatatcgtagtctcctccaatctgtgctagttcttagtcacttattatttttcatgaccttgacgcatttgaagaatactggctggtttgtttgtaaaatatcccgtaacttgggtttgtctgatgttttctcagattgaggttgtacatttttggaaagaataccacagaagtgatgtgtccttcttagtgtatcttaccaaggagtacatgatgtctgtatgtcttattactgatgatgttaaccttgatcagtgaaggtgctgtctgccagatcttccagttttatgatttcttctagtgtaatcagtacatgttgtagggggagatactttgaaactatgcaaatatgttgttcctcaaattcacacctacttattttagcatccatcagtggattttcttacaattattgctttggtattctaatggtggttttctatttctctcattcagtatttatttattggaattcttatgcaaggaagggctgttctttctcttccctccctcccttcttttccttccttctttctttgtatcagtatggacattttattctatcattctaaaatactttacacattttttgtcttattaatagttattataaatactaaaatattttaacaactctgggtgatctttatattcttgttgtttgtgtactgcaatgcagatgagttagactttgcctctaaactgaaatatgcttaatcgatgtacttcttgggattcttttcctgcatttttctggcttgttccttagttttaacccttaaattttggctgttagtaagtatgtctacctatagcagctttttttcatccttttaatttgtaatgcctctaatcttctgtaagtttgaaaaataacaagggactagaggaacccattcctcagaacaaaatgtataatatataaactctagtacagggattaattaatgagtgtattttggcttcatgggagtgtgtgtgtgtgtgtgtgtgtgtgtgtgtggtgtgcgcgcgcatgcttattttcaaattttatgatagatgaataacttcttaaaatgtatttctttttttatataggctgctgctcagtgttacattgatttaattattaaggagagcgacaacaatgtaaaactcatagttttggatcgcttgatagaattaaaagagcatcctgctcatgaacgagtactacaggtaagtgttatctgaaaaagagagatcctaaataaaatgtttttcaaatttaggtcattctcaagctttgcccatcttggttaacctaaatgcttggaaactgagcagtttatattttgatcagctaaagtgttaactattgagtcatcatagccttttggggtattatctttaccacaaaaaatatttctaaaatggctggacgcggtggctcacgcctgtaatcccagcactttgggaggcagaggcgggcacatcatctgaggtcaggagtttgagaccagcctggccaacatggtaaaaccctgtctatactaaaaataacaaaaattagctgggtgtggtgaagtgcgcctgtaatcccaactacttgggaggctgaggcaggagaatcacttgaacccaggaggcagaggttgcagtgagctgagatcgtgccactgcactccagcctgggcaacagagtgagactctgtctcaaaaaaaaaaaatgtttttctaaagtgaatcagtattatatttttttatcttttcggtttgtactgtattgactattcttagcgacagtgacatactcattttaatttgaatataatttacatttcgtggaaaattattataccaattgagaataaaaggtgatctgattctagaaaattatcaccatatttgtttaatccatgagaataataatggttataaaaataaaaccccatggcaggtaaatgcagtgctgatcttggatcagaacaacagcaacaacaaatttctatgaaggacattattgggacagattgagaaatatgaatatggtgtgtatattagttaatagtattgatcagtgttaaattctctgataattataatgtggttatataagaaattatccttacccttgagagagatacactaaaattatcagcagtaaagagcaaatgtgggccaggtgtggtggctcatgcctaaaatcgcagcactttgggaggctgaggcaggtggatcacctgaggtcaggagttcgagaccaccctgacaaatatggtgaaaccctccctgtctccattaaaatacaaaaattagctggacatggtggtgtgcaactgtagtcccagctactcaggaggctgagacaggagaattgcttgaacccaggaggcagaggttgcagtgagccaagatcttgccactgcactccagcctgggtgacagagcaagactccatctcaaaaaaaagaaaagagcaaatgtgggaagatattaactggtgaatgtaggtgaaggatatacaggagttcactcttagaacttttttatcagtttcgaattgtttttaagtgtgcatcttttaaatgttacattttcctatggagtcaaataatatcacatttaacgaaattgttaataatttatgaatgttatctaataccaagtctatatgtagattttcccagttatcccaaaagccctttttgtttagtttgcccattttgtgaccatgtatcgtatttggtggttatgccctttcagtctcttaattttggacagtatcttttttttatgacactgatttgttgaagagaccagaccagtaatactataaaatgcccctctttctggatgtgtatggctactttcttacgttgtttagcttgttctttgacttctgttactttctataaactgtaagttggagctttagctttagcttgacagagtcaaagtaaacattatcagtttgaatgtgtcatgtgctattatttcatattgcagtgtatcaggagacccaaactatctagttcttccaccactagtggttttgttattgattaaagaattaaagtgatgatagataaaccccaccattctgcagtgaagatttttttcctgtgaccagaaagattggtgttaattcttgattttttcttcttttttaggatctggttatggatatcctaagagtattgagcacaccagacttagaagtacgaaagaaaactctgcagttagcactggatcttgtctcttctagaaatgttgaagaggtaaaaggaaactctgacagcactttgtagctatcaggcccaaatatgatgtaactctcacttatttttacttcattctataagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtggtatgtaattctgatgactttaattttgaaattatctaaaagaattttttaaaaaatatagttatttgacaaactccagaaatctcagctgcctagaaccattaaatctcatggtgagaagtgatctttatatctacctctacctttaaactcagaagggtgaggactgacttctttcacttatatattcatcaaaaaaacaaaaacagtgaccaaaaaaaagctttgcatattattttaattgatgatacagttacctaaagtaaaattatgctgtgtatatatattattcagtaaggcaaataggtatttattttaaatagctttagctcttaaaggaatcagttataggaaaaattcacatatgtagaatattttgctgtcactgtcagataagtgaggtatgttattataatttgatttttgcctttgagctcttgagttctctctaaaatgattttagttacaatttaggaggatcgaattcatttatttatttggagttttggatctctagcttatcttttatagtgaattttaaaataaattttgctgcacataaaatggaaaagccattgtgactttgtttacataatagtacttgtctctcaatttacattttgttgtgtatttgaaaattattaagaattacaagggtcaggcatggcacttcatgtctgtaattcgagcactttgggagggctaggcaagaggattacttgaggccagggattcaagaccagccagggcaatatagggagaccctgtctctacaaaaaaattaatattagctaggcatagtgtcatgcctgaagtcctagctcctggggaggctgaggctgccagaggatcacttgagcccaagagttcaaggctgcagtgagctatgattgtgccactattctctagcctgggcagcaaagcaagaccctgtctcttagaaaacaaaaaaagaattacattcttttaatttatttcttgtcctagataattttcttttcgaaaattattagttccattttcttttttttttttttcttttagttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagtaggtttaaaatacatttaaatgtaaggtcaagtaagcattttatcagtttttatctttaaagggtcagttgatagaaaatagaatggagaggacaatcaagccaaaataagacaagtttgtacaacaagcatctcgctaactccactctcatttagtctataataaatggcccaaaataatttttttaggagtgatttagctcagggtctctattctgattttctctaaaacattgtgaatcttaaagtaactaaagagcatatttttaaatggcatcactttttggctattactattatttatatcttcctttcacatttaatgaagagaaagattgaaaatgcaacctaaatctgtctttcccttcagagagcctttgctaatgagaaaggactgttgcatctaaattttgcttcatttaaagcatctgatggatagtctctaacagacttgaaatatgtctcaggaaggaagggacaagtacaaaattgtttttatgatatgaaaatatattaatatttatggaagtgagcagagcaggatttgcttcctttgtgagaagaaaatcatattaaggatttgctttttttttttttttttttttttttgtgagagggctttccggcaaaaaccagaaagcctgctaaacaaattttaaaagagctatgacattaagaatttgtttttgacagccataatctcttagagctttggtttctataattaagtttttctgaataaatttaattaaaatcttaggggaaagatgactaaggactttattcagtttaacattttaaactaaagaattgttggctgggtatggtggctcacacttgtattcccagcactttgggaggccaaggcaggagaattgctggatgtcaggagttggagaccagcctgggcaacatggtgagactttgtctctatttatttttttaatctaaatgaatgaatgaatggttgctttctttactattatttttttactgatcccttgtacttcttctgtatccattgttcagttcaacaccttgcctcttcagtgactgaaaataaaaagtgaattactttttacattaaaataatacattccctgattttttgtttttgtttttgttttgtttttactttatttatttatttttttaagagagatgagggccttgctttgttgcccaggctggtctcgaactcctggactaaagcaatcctcccacctcatcctccccagatgctgagattacaggtgtgagccacagtgtctggccataaaataatacatttcttagagtagtaagagattaagccaaatttgccttcactgtgtcctaaatggacactttactgggaaacattttggtattttatttttactgctaggtttaccagttttagaatgttcctaataataagaacagttattttacttttaatctttgtgatttctggagagaactgaaacctaggttttgttagattctttctgaaatatttatctaaaatactttagaactgcagaatcttgttggtttttgttttttgtttttttgttattgagacagaagcttgctctgtcacccaggctggagtgcagtggcgctatctcagggcattgcaacctccgcctcctggattcaggcagttctttttttttttttttttttgagatggagtcttgctctgtctcacaggctagagtgcagtggcgcgatctcggctcactgcaaccgccgcctctcatgttcaagcgattctccagcctcagcctcccaagtatctggactacaggtgcgtgccactgcatccagcaaattttttttgtattttcagtagagacgaggtttcaccatgtttgtgaggctggtcttgaactcccaacctcaggtgatccgcccgcctcagcctctcaaagtgctgggattacaggcgtgagccactgtgcccggcctcaaggagctcttatgcctcagtttcctcaatagctgggattacagatgtgcatcaccatgcctggctgatttttgtatttttagtagagatggggtttcaccatgttgcccaggctggttttgagctcctgggctcaagtgatccgctggcctcagcctccgaatgtgctaggattacaggcgtgagccaccgtgcctggcccttgtttttttttttttttttttttttttttgagacggagtctcgctctgtcacccagcctggagtgcagtggcgcgatcttggctcactgcaagctccgcttcccgagaatgggttcccgccattctcctgcctcagcctcccgggtagctgggactacaggcgcccgccaccatgcccggctaatttttttgtatttttagtagagacgtgatttcaccatgttagccaggatggtctcgattctcctgacctcgtgatccgcccgcctcggcctcccaaagtgctgggattacaggcgtgagtgcctggcccttgtttttatttgagcttaaattaacaaagaaagatctctgcttcaagatttgtctgccaagttcatgtttcagatcttgtattgtgctaggatttaccgaggagcattatggatcctgggagaatactgtagtaccaaggaagacattcagagtgtgatgactgagatccgcaggtcccttggagaggtatgttttactttagtaaatgttagtttatatggtaatttttcctttaggaaaatctgactttttatagtgatttgcttacattatttacacttctgagttagattttgtttgaacaaaatgttctgtgtttattaaaaaaaaaaaaaaaaaaagaagcagtagcttgtaaaattctgctttagcctgtattctgaaggaagaatgccttagagtaagtctgacttcagaatatttatgcactaaaactgacagtattcttcatcctaacaaccttatggtagaatagaaagaacagtggactaattatcaggagacctgacaattagttctagtcattgttgtgtcgacagttagctggaggaccttgaatataagttcctcaacctaacttgacatcagtgtttttcacctataaaataaattaaaataggtaatgattaaatactcttagtgctcttacattaggtaatggactggtattgagtaataaatacataatagccattcagttaatttaaaagttagttgatgaggttattatgtacaaataagtcggatttatttcattttagaaggatgagtactgttttggttaacatttcaaggaaaggaatgaagaagaggaatacgacttaatgaccatctgctttgtgttagacactgtccaatgcatttttctattaggtaaaatgtgtagaaagaattaagatttccacttagcagattaagaaactgaggtccaaagtagtaagtggcagagtgagaattcaaaccctggaatatccatctctgaagcccctattctacctactacattatcctgggaaggaaataaattgaaagcagagttcccagttccaaaaatcccattagggtaatgccttttttagagaaacaatcaaatatttaaagataattttgcttgctgttgatactattactaaaatgatgtttccaattgacttttagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacaggtaatttatggcacatataccctgccagctgtactacttttattattactcttgtatgtaaaacagtcaaatgatttctttcctcttgcttttgcaaccaaaatgaaaatctttgccatttaaggtacttgagaagcggaggatgtttaagttcttccccctaggaattgtattgatggttttaattctctgtcccttccagtgtttttatggaaataactgttctgtttaaactcaaattatttttactcagaaaatgctaagtgggggtaactgaagatatttgagttttgttgtttattagcatctgaaaacattttgaagatttttcaatttctaaatgatggaataaaattgtgcatttttctattaagtaaattttaatggtgaagatggtgaaatctttgcctaaaattttactgaatacccactaagtgctaggcattgtgctaagtagtttgtctcatatagtcttgacaataagcctttgagatagaatatattatctccattttatggaagaagaatttgaggcttacccagtaaataaacaggtaagctggaattcggaggtacttcattagctgcaattacgtatgcccctaattaaatattgtatctttccatattctgatggcttttgtgtcattcaaagataagttttcctttttttttttttttttttttttgacacagagtcttgctctgtcggccacgctagagtgcagtggcgcgatcatggctcactgcaacctgtctcctgggctcaagcagttctcctgcctcaatctcctgagtagctgggattacaggtttgtgccaccatgcccagctaatttttgtatttttagtagagacggggtttcaccatgttggccaggctgtcctcgaactcctgacctcaggtaatccgcccgccttggcctcccaaagtgctgggattacaggtgtgagccactgcacctggccaaagataagttttaaagtcatgtattatttttctttttccttctttcttctgggagctaaggagttagttagctaaggtatccttatcactgaaggatggtaataagagtgtttaataggcctatatcattcatttatacagaagctgcatgctgcttagcaagttggtgggtttgattttccttggttgctttgcagacctcccttgagaggattccttctggatggagatttctttgttgctgcctcccttgccacaactctgaccaagattgcattgcgctatgtagctttggttcaggagaagaaaaagcaaaatgtaagttcatttattttacatttaaccaacaattaaacattgagtgcctactatatgcattgaacagtgagggactcaaaaattaatgctaagtttctgtcatgaaagagtttatgatttaatagcagaagtggacacagtaatatattactctaaaattgataaagtatcttcctcttctgtttgggctttaaaaaaatgaaaattgacaaagtaatacaataacaatgtcatgtgattattccagtggaagagaaaggatttatgaagtcacctcagtttgctgggattagttcaggaccagtgaaggaaatgtccttctctccagcatctgcatccattcggtcattgtctgttttatcccagaatgtctcttaagttattctcatctgtagttcatgcctgctttgtagcttctgaccgttctaaccaaacacccatttacaatggtatgcagttggtcctccatattcacagcttctgcacctgcagattcaaccaactatggattgaaaatatcttttttaaaaaatgataaacagtaaaaaataatagaaagttgaaaacaatacagtgtaacaattatttacatagcatttacaggcatacttcattttattgtactttgcacatattgcttttttttttttttttaaacaaatgaaggtttgtgggaaccctgagttgagcaagtctgttagcatcatttttccaaataagcatatgctcacttcatatctctgtgttacattttggtaattctcacaatatttcaaactttttcattattattacatctgttatggtgatctgttatcagtgatctttaatgttactatcatagttgttttgggatgccaggaaccattcccatataaaatagtaaacgtaatcaataattgttgtgtgtgttccgactgctccaccaactggctgttaccccgtctctttcctccttgggcctccctattctattccctgagataccacaatattgaaattaggccggttaataatcctacagtggcttctaagtgaagggaagagtcacatgtctttcactttaaatcaaaagtgagaaataattaaacttagtaaggaatgcatgtcaaaagctgagctaagccaaaagctaggctgcttttgccaagtaggtagccaagttatgcatgcaaaggaaatgctcttaaaggaaattaaaagtgctactccagtaaacacatgaatgataagaaagtgaaacatttggcaggcgtggtgactcacaccagcactttgggaggcccgagacaggcggatcacgaggtcaggagttcgagaccagcctggccaacatggtgaaaccctgtctctactaaaaatacaaaaattacccaggtgtggtggcaggcgcctgtactcccagctacttgggaggctgaggcaggagaattgtttgaacatgggaggcagaggttgcagtgagctgacatcacaccactgcactccagcctgggagacagaacaagactccgtctcgaggaaaaaaaagaagaagaaagaaagcgaaatagctttattgctgatagaaagtttgagtggtctggatagaagataaaaccagccacaagattcccttaagccaaaagcctaatccagactaagaccttaactctcttcaattccatgaaggctgagagaggttaggaagcttcagaagaagagtttgaagctagcagaggttgattcatgaggtttaaggaaataagcccgtcttcataatgtaaaagtttgacatgaagtagcaagtcctaatggagaagctgtggcaagttatctggaagatctagccaagatcattggtgaaggtgaccacactaaacaacagattttcagtgtagactaaacaaccttatattggaagaagatgccatctaggactttggtagctagagagaagtcggtgcctggcttcaaagcttcaaaggataggctgactcttttggtaagggctaatacaaccagtaacttaagttgaagccattgctcatttcccattttgaaaatcctagggctcttaagaattgtgcttaatcaactctgtctgtgctctgtcagtggaacaacaaagcctggatgtcagcacatcctctttacgggatggcttactaagtattttaagctcaccattgagacctactgctcagaaataaaagactccttttaaaatattactgttcattgacaatttagctggtcacccaagagctctgatggagatgtagaaagaaatgaatgttttcatgcctgctaagacaacatccattatgctgccactgatcaagtagtttcaactcttattatttaagaaacagaatccatagaacatttgtggtagtagcgcagagttggttacaatgtcctaccacagcaatttctgacattcaaattgggcctgtagcaatgggactccttttgattccttcagctttcgtattatgttggttatctatacagcaggtttctaaattgaaacactttcactcacatcactcatatttccttcgtttttggagactaacagcttgatctaaaaaaaaatttttttttagacggagtctcactcttcttgcccaggccggagtgccatggcatgatctcagctcactgcaacctccgcctcctgggtttaagcaattctcctggctcagcctcccgagtagctggggctacaggcgcctgccaccacgcctgtctaattttttttgtatttttagtagagactggggtttcaccatgttgaccaggctggtctcgaactgctgacctcaggtgatccgcccacctcggcctcccaaagtgctgggattacaggcatgagccaccgtgcctggccaggttctttttgtttttgttttaattccattataagaaaagccataaatgagagccagataatttacaaggtatattatcccttaattgatttgatttttgagcaataatttattttgtaactcttttgtgggcatttatttattcaggtctggtcacagtataatctttaaagtatgttttttaaaagtctccaacatttttttatctcagagttgaatttgctttcctctcctggttgcatcacttctggaagttgggagtgtttactgatacctgcttaaaagagccagtttcttgtaacataccgagttaataatgtttgcactgtttggtacaagaaggaagtttggttgcttataatctcactggcactccttcatttatgccatttccaacactcttcatttctttgtgtaggactaagtttctggtatcatacatcttttgcctaaagaatttgctttaacttttcttatagtgcagatttgttggcaacagattgttccagtttttgtctggaaaaagcctatttttttgtacactttagaaagttacctttgtgggtataggattctaagtcttctgtttttttttcccagtagtgtaaaagtaaagctccattgtcttctggctttttggtgagaagtctactgtcattcttatctccctgggtggagagagagagagagtgtgtgtgtgtgtgtgtgtgtgtgtgtgtgtgtgtgtatttcttccactggttttagattttctccttttcacttggtttcagtaatttgattaggatatgccttagtgtggttttcttcatgtttgctgtacttgtggttcattgagcttgttgggtttgcaggtttatatctccatcagtttgggaaattttcagtcatttcctcggatttttttttctgtcccctcctctctttcctctccttttggagacagtatccaaacttgggggacatatacttactcttctgctggtttttcccaggcctccagtagtttttcatgcatgtgtgcagatcagtactcagccaaaggcaatttggcaagggcttagagcatatgtgtcaggataatgctacatgagactaaaaaagtaagttgcaatcacttgtggaagactttgaatagcgagctaagtaatacggacttcagtatgaaggctgacattcattaaaggtatttacatagggaatgaaatgattggtgcagtataaagattaagatagcagcatcaggtgatcacgcttagcagcacaataattggacagcctaactttaggtaccttgtgatgcagtacagggtgaaatacaaaacatcacctatctggtattctaatcaaaagtgtgggatattctataaaacaactggcctcagttctttaaaaaagttagtgcgattaaaaacaaaacggcagagaactggtctagattaagagggataaaatgcatgaagctgatcctggatttaaaaaataaaacaaaaacattttaagacaatttagggagatttatttgaattcagagtatagaagctgtattttggaattgttgaatttttcaggtgagaaaatgaaattgtggtttgtaggaaactgttctgactcttaggagatgaatgctgaagcatttatgaggtgaagactttttcacatgtcagccaaaaaaaataagtgtacatatacagaataggtaagcaaatgtggcaaaatgttaacaattggtaaagtatatcattcttttaacttttctgtagttgggattaaaaaggacagcatcagcatatgaagtggttacagagaaggactggagcaagggaaaacagttaaaaagcctctgctgtctctaattgaggattaatgcaggtcttagagagtggcagttaagagtagaaaggaaggagaagaatgcaaaaacagatatggacataaaatccaaagaatttgaaatcttattcaggtgaagtgaaaatttagattgtgagttataatgaagtgacatgattgcaatctgagaatcaagacaatatcagtaaccgatttctttactttcttagtcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaaggtaaggtatatatgatgaggcaacaaaagtgttttgtgtctcttcgtgcagtggctcacgcctgtaatcccagcactttgggaggctgaggcaggaggactccttggggccaggtgtttgagaccagtgtgggctacatagcaagcccctgtctcaacaaaaaaaatgagaaaattagccaggcatggtggtatgtgcctgtcattccagctacttggaaggctgaggatgaaggatcgtttgaatctaagagttcgaggctgcagtgagctgtgatcataccactgcactccgcctgggcaacagagtaacagcctgtctcaggaagaaaaaaaagaaaagaaaagtgctttgtgggttttcttgttgttttgttgatttttcagttttcatatgtgagggctgtctctgtcaaaagcctctaaaaaactatcttttcatattaaagagagactttgttatattctcaacacagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtaacaaaatgtctgatagactctaaattatttaaatcgactccttaaggaagttgttagtgctgctatttttaaaagaaagataactattttgtcaagtcactgtgataggtccattaaacctcagttgaaactcagaagctgatgaagtaccttactactatatgtgatagtactgtaagtccatcagatggtttaactcgatccagttgtgtctggaatcatagaccaataaatagaagttgagggaaggggatccttaaaggttagctgaggtttttaaagggaagctgaacaggcaacagccctggcctcttcccacaccttgacctcaccttctcttattctctgctactttaaacagagcagttctacttttatattcttaatatattgagttccatatagaattttattaggaaaatgattctactctcttaaatatataaatttaagaatcagtgatccctcatctattagactgaatgaacagtcttacattacttttgtttaagataaggtcagtagcagaattggaattactaaaacaatttccctcccttaaaattgggaattgatatcaataatattacatttataaaatttttttagtttttttgaattatagttaaagttgcaaaagatttgccattttaacccatttgtaagtgtacagttctgtggcattaattaaattcatattgttatgcagccatctccaggactgttttcatcttgcaaagctgaaactatgtccattaaacaataactcgtcattcctacttcccctcaacctctacttacccctagccaccattctactttgtgtctctgtgattttgactattttaagtacctcacagaagtggaacaatacagtatttttccttttgtgactggcatatttcactcagtataatgtcttcaagattcattcatgtcatagcatgtatcagaatttcctgccttattaaggctgaataatattacattgtaagtatatgccacattttgtttatccatatatccatccctggatatgtggattgcttctgccttttggttactgtgaagaatgctgctgttaacacagatgtacaaatatctgttcaagtccctgcttttagttcttttgggtatatatctagaagcagaattgctggatcatatgataattgtacttttaattttttgaggaacctccattgtgtttttcatggtagctacactattttacattcttaccagcagtgcacaagagttccaatttctccatatccttgccaacacttgttttgtttttttttgatgatagccatcttaatgggtatgtgaagtggtatctcattgtggttttgatttgcattttcctaatgattagtgatgatgagtgtcttttcacgtgcttattggccacttgtatattttctttggagaaatgtttgttcaagtcctgtgcctatttttaaattgggttgttggtttttttgtttgaattttaggagttattaatattctggatactaacccccttatcagatacatgatttgcaaatattttcttccattctgtgagttgccttttcattctgttgataatatttgatgcataaaagtgtttaattttgatgtttaatctattttttcttttattgcctatgcttttggtgacaatattagctttttaaagtacagtgctttcagtgtgtttaaatttggagtgggagggcatttgtaattttatttttgtggcattacaatcatttcttactatataatctgtttagtgcctcagtttgtggagcaagggctaccacatgatttggattttatttggatcctgagtttcatagatcaagtagtgagtttagatacttactgagggatttaaatgaaagtgtatccaaatttatttagttggcaaaattgggataatgtttaatgtatttgctaaatatatttaacatttttctactactgaacttataagctcaaaaatcaacatgtataataccttatactgagttattgagcttaaaaacaaatagatgtcttaaactctaggacctgttatttcttaatattctggtttcaatttccatttctgcattataaaacaattttattttacctatctcaaaatgacttctaagcaactctgttaataacctaccagacttaatcatttggccagggtatgtttggtgaaattgcatctgtcatttgattatgtctttgtttttgttttgacaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggtgaggaaacttaccattcaggaaagagattgtcacatagtagatctttatgacagattaagggaggtgcacaggtttcagtataaaaattctcttgaaccttttctgacattttgaatcaaggcttagtttttcatttatcatttagtttccttaaactccagttttctgaacctctgtcatactgaatttttatgctcttggcacattcaggtggattcatttaataagcttaatctagcaaatgtcagtatttctagttataatacgagctgtttaagtcgcagattgaccaggtagctcacttagttaatttctaattgcctcattacagaactaagtattttctgaatgcataactgttagataccacatgtgaccaaagtaataaatcatattacatttagcaatatgagatgcattttttttcttagtaaagacacatgggtcagactgcttacttccacatctggttttgaagttggaaaatataaattgtatatgggaacagtgcagtacccccatcagatttcatatggcttatgcaagtgttaaggaacttcaagatatcaaggggaaaacatacttttgccctgttgtcctcagcatagcttgatggctgtataaaaaaccatgtttcttaagcatttacaagtctttatgcagattgttttatctttcttcataatgaagtatatagtttaagacttaagctttttgagaagtttgcattcattcattgaaataaaatgaccccaatctctacaaaaaatcaagaaaattagccaggtgtggtgggccactcctgtagtcccagcgactcaggaggctgaggtaggaggatcgcttgagcctggaagatcagggctgtagtgagctatgatcatgcagttgcactccagcctaggtaacaaagcaagaccctatctcaaaataaataaatggtaggctcaaagtatcctcccttcccacaaattaaatatggaattattctgagatgcctattaccttttaaaagaaaatatgcctattgatggtgaataataaggatggttaagtggtttctttattttgtcctcattatatttgattcatactcttctcatattcgtcatattccttattttcctagaaactattaagctgcatacatttaaggttttatggttagtgtgtgtgtgtgtgtgtgtgtgtgtgtgtgtgtgtgttatttttaaccatatccaaactctttctttcaggggatctgaaacttgtggaaaagccgtctcctttgactcttgctcctcatgacttcgcaaatattaaagctaacgtcaaagtagcatcaacagaaaatggaataatttttggtaatataggtaaggtgctgttttatggcatgtaatgtttgaatacttttactgaagaatttctatagtgagtagctggggacattgtatgaggagaggatctaaatccatttattcataatttatgagatactctctatggtaccacgcattgaactatgttctggatgtacagaaatgaaccagatagagtcactgtcctctagaaactgtcaggcaaaaggaggagctagctaaggcaatatataattgtagtccagtgtgttacaggatggtttatataccatatgctttgaggttagggaaaaaaaaaatgctaacagtgtggaaggctttataaaggaagatggtgtgttatcaaaggataatattttacctgagtcatttgttgctaggtgcacaagggtatctcagacctagggattagcttgtatagagtcattcagtcagtaagcttattttgttgcaatttctgtcataaggatagggctaccatggtgaggaacaaatgatagattatggttgagtaagggaaaacagatatataaaataaatatgtgcagtatgtaatggtaagtactgtgaaagaaaaaaataagtaaacctgtactaagtaaggtaggaatccataaagggatttggtcagttctcagagtggtgggggattgggagaaaagcttagaaaaggcttcatggaggagcaagtgctcagtagaagactacagatagacaaggatgcagttagaataaatgcaaatgatttgatacacttggagttcagaatgggttggaggatgatggcaggaaaaaaatgaagttaggaaggtttgtggaagccatattttacttgtcatgctaaggatttcagactttatctgtggagagaggaaacattgaggaattacaaatgaatgacttatagcattatatctttttgcgacagtactatagaaggttgattggaagaggcaggaagattaactagtagagaagcccaagtgagagatggcagaggacttgagccaacacagtagtggaatggagagaaggatgaatataatgttaaggatatggttaatgattgaagaggaagtggctagagtaacactcagatttccagattaggtttattgggttgtttatgtcatcatcataacaggaaatacaggagagaagaacaaactttagagagacataataggttaaatcttgagcaggttcggtattaaagtgcctaaagatattcaaggacagtttgatgtgagtctgggacacaaacaagaggtctaaactagagataggccgggtgtggtggctcatacctgtaattccagcactttgggagaccgaggcgggcagattacctgagatcaggagttctcaagaccagcctggccaacatagcgaaatcctgtctctactaaaaatacaaaattaattgggcataatggcgcacgcctgtagtcccagctaactcgggaggctgaggcaggagaatagcttgaacccatgagacagaggttacagtgagccgagatcgcaccactgcgctccagcctagacaacagagtgagactctgtctcaaaaataaataaataagtaaaaataaactagagataagtatttgtttaaaagccataggaatagaagaaatcacccagagagggcatacagactaaaaagaggggagatttgaaaacagaatccaagcaaacagcaacactgaaagcttggtcaaaggagaaagagcctacaagggtatctgaagtgtggttagaaaagtaaggaaaaaccttcagaaagtatttgaagctccacaagataaaataactttagttattaaagtctgaaagagaggtcttttggatttggctattagtgattttaaaacatttcttgtgggacatcttgggtgttagtggtgggttgaagactaaatacgatatgaagaaatacaggtagtgtagactattctgagtgtaggatcttggctttgataggaataagaaggggcagtaccaagaagagaaggcaagaatgagtgaggatttattttttgaaaataagagaacctcgagtatatttatagaccataagggaagaaagttggtagagaatgggaaagtaaagacataaggatgaaagagatagtgattggagtggggtcctggaccaaagcaggaatcacagatggcaggaagtattaatcttgaagaaatgaggtagtacttctctgatacgtatgagagggaaggatgtgagagtgaattccgagagagagagttgtttttagatgtggagctgaaaattaaaggagcttattcttggtagcctcagttttccctgaaagttgaaagagtggaagaatgtcaagaaaagagcctagaggccgggcacagtggctcatgcctgtaatcccagcactttgggaggccaaggcgggtggatcatgaggtcaggagttcaagaccagcctggccaagatggtgaaaccacatctctactaaaaatacaaaaaattagccaggcgcggtggcaggcgcctgtggtcccagctactcaggaggctgaggaaggagaatcatttgaacccgaagggtggaggttgcagtgagctgagattgtgccactgcactccagcctgggtgacagagtgaaactccatctcaaaaaaaaaaaaaaaaagaaaagaaaagagcctagaaagaggaatgtaggctccaatcagattataactctctactgtggaagaaatggtcatagaagcaaatatagtcagccttctgtatccgtgggttccacatccatggattcaaccagccacaaactgaaaatattttagaaaaaaaaaaaaatggttgtgtctatactgaacatatatagacattttttccttgtcattatatcctaaacaatacagtataactatttacatagcatttatgttgtattaggtactgtaagtaagctagagatgatttaaaatatatgagaagatgtgtataggtaatgcaaatactatgccatttaatatcagggacttgagcatctgtagattttggtatccatagggggtcctggaagcaattccccattaatactgagggatgactaatcttgtatcattaagtagtatgggtcagcaatatttattcaaaagtattagttaagtacctcctatgggaacatcgtccacttgtatatctgctgcagtgcctagtatgctgcaactgctatgtaagtactcactgaattgaattatttgtttaaccacaaaaaacaaagtgtgcctgagttcgaatcctatccccaccacttatcagttgtgtgatctggaacaacttacttaacttctctgctttcatttcctcatatgtaagatggaaaataataatactatcagaattgatgggagtattaaaccagtaatatttataaagcatgtagaatagagctctgtacataataagtattatataaacaatcttattgttaatagtgtagttctttggatatttggatattaagattttttaaattcaagtttgccccagtgattgcgaatctttttgtatatgtaattgcagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagttagtccttgggagattttctcatattcctttatctttcttccttttgcctgctgttgaggagtctgctaataaaattaatctcgctaaaaagtgtttaacatgaaaagcaaatagtctttcagtatctgttcttgcaaattagccttaactaaaaatcatgtaagtagtttggtaatttgctgttataaattgattagagtagcagttctatagccaatctgataggtttagacattataggtaatattccatcccttctatgtatgaccaagagcttaccatttaatctagtgcccgaaaaaggctttacaaagttcatggtctgttgaggaactttgtccctttgagccttgacttttattagaaatattctatatgaggctgggcacggtagctcgtgcctgtaatcccagcactttgggaggctgaggcaggcagattgctcgtgctcaggagttctagaccagcctgagcaaaatggtgaaactccatctctacaaaaaatacaaaaattagcccggtgtggtagtcccagctactccggagactgaggtgggaggatcacttgaacatgggaggttgaggctgcagtgagctgaaatgacgcactgcactctagcctgggtgacagagtgagaccctgtctcaaaaaaaaaaagaaatattctatatgcttcatattgaatctctgtgaagttatctctattgggaagtactgataccaacctacagcttgttggattttatagatgttatttagtttcttggtgtctactctttccaacctaaacagttggaacaagtttttaatatgacatactggtgattcacagctttctcatagtaagatttatgatctccttgacttttttttcctctctacaggtgacagttaacaccaacatggttgatttaaatgactacttacagcacatattaaagtcaaccaatatgaaatgcctgactccagaaaaggtaaaatttgactaggaaattcagaaatctgatggaatggtagagtaggttcctggccttcctgtatttcctctagcacatttttgttattcaatatgcagtaccattctaggctatctaaaagatgttatcccatagaatgttggaatctgcttacctctttctattggactataccatcctactttttcctagtgcagtgacccaactgaatagtcagattaattttttttttattttcttttcaatcttctcccccattcagctagaggcacattctaaagtagtttatgctgcacatggtggttcattcctgtgatcctagcactttgagaggctgaggcgggcagatcacttgaggtcaggagtttgagaccagcctggccaatatggcgaaaccccatctctactaaaaatacaaaaattacccaggtgtggtggcacgtgcctgtaatcccagctacttgggaggttgaggcaggagaatcacctgaaccccagggggtggaggttgcagtgagccgagatcacaccactgcattccagcgtgggtgacagagtgaaactctgtctcaaaaagataaataaaatcgtttatttgtaatactggattagaaaatgtccatgagctcttccgtgggctctgattgttggttaaaatatatgtgctcaaatacagaatcgttgttatactgtgactttttgctatgtttgtgtatgtatgaaaaaaacgagaaagaaagaaaaatgaagctggagctctaaggaacttttttctttatgtaaaatttctataatgttataatattcattttataaataaaataatgtctgctaccaaacaagtaggttttaatttatatattagtttattcagcatatactgagtccaacaaaagtagtctcttccttcatggcgcttaaggtctgatatgggaggcagtcaagttaagtaaacagaatatataaatacaaatcggattaagaactatttatttaacatcagatttattgaggtataatacacagtaaaattcacactttttacatgtatagttgagttttgacaaactcataagattatgtaaccaccaccctgtatgtaagtactgttttaagtgataaataaccaatggggctgggcgtggtggctcacacctgcagtcccagcattttgggaggccgaggcgggtggatcacttgaggtcaggagttcaagaccagcctggccaacatggtgaaaccctgtctctactaaaattacaaaaattagccaggtgtggtggcgaatgcctgtaatcccagctacttgggaggctgaggcaggagaatcgcctgaacctgggaggaaggttgcagtgagccgagatcacgccactgcactccagctccaagctggacaacagagtgagactctgtctcaaaaaaaaaaaaaaaaagtcacctatgctgtttggtttttgcctctatgtaggtatctggtaaagtaatgaatttatcacaaattttttccaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccaggtaacagttcctttttttttgagagtatctctggactgacaaaggggggaggaatttatgactttattatttctatatgtagtatctttttagcattagatgcatatacacatacaataataatatactctgaatagaagtataacttttctcattaaaatttctcaccttttgggcccctcattctgggatatttgcctaaaaccagattgattcctatggggtgtttgtgaaatgggttctctagaattttttgaaagccaaggtgtaaatctagtgactaattagctgggtgttgtagcgcacacccggtaatcccagctactcgggaggctgaggcaggagaattgcttgaacccgggaggtggaggttgcagtgagctgagattgtgccatttcactccaacctgggtgacagaatgagacttcgtctcaaaaaaaaaaaaaaaaaaaaaaaaatctggtgacggcttgaaaaatctagcactgaaaggtaattaccagtaaagtttggtaagtctgtttggtatgtccttgattttattgttgataatggtgtcattgaattgaattggggcttaataatatggaataacctactgattgtacatagtttaaataattataaatatcttaatttttctttacagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaagaaaaaaaaagcctagattacagggcatttgagattccagaacactgagatcttagaacaaagccagggcttatcaaatgggaaagatatactggaagtgcagagaagggatgtcgattcaagggtagagatttgcaatgagagcgaaggagctggtgcaactttggattagatcatcatttcccaaactctgttctacggaacattagcttccttagatgtcattagatattctgagtgaaaaagtaattccatagtcaagtaagttggggaaaagcttcaaactgtcctgcactggagattcacaatgtacattagcataccagagattctgagaggaaagcagattagtttggtttaacccagtatatcctaaccttactttaccagggaatcctttttccatgacctattgacaatatatgggacaggaaaagtgacttagcctgttaatgatattagtgttgtaatcacagttaaccagtatcacatttcatatctgaaggaattatgcctgtgtacatcctagaatatatctcggttgatactcttagaaagttgcctgcctgacatattcaggccatttttgttggaatcagattgcctcacattgccattttcttaaattcataaataaggagaacaaa

SEQ ID NO: 15000 - DNA, 46311 bp, Human
aaaggcattcaaaattatataattacatcttagagtaaaacagcccaaacaaagtgtattttacaacagatcaggaagagttaatgaggttaatattaaggtccttatacccattcaaaaagctttgtacttaagaatatggaaaaatatatgcactgccaatgacaattgtaggttcagatctaactaaagtaatatgtaaaacattacattttcttgccttttcatatttagaacttaatgacttggggtcatgagaaacctcaaagttattctgtaacagaatgaacctctggggcaaatgaagtctgtacggtttaagtcctacaccatgatggccctaaactgagctttcttactgtaaatctagtttttataccttttttggcctcatttcttgctgacagattgtcactttttggtaagttaagtgggcttggaaaccagataactgcatttgtaaaacttccatgttaaaaacgaatacacagaaaaggaacaaactgttgtacacacacccgggattgatctcaggggaattatgctcagtaaaaaaatccaatctcaaaagattacattgtataattccatttatataacattgagatgataaaaatcatagagaattattagtggttgccacaggttagtgtgggaggtggctatggctatcaaaggacagcatgagaatccttgtgatagaactgttctgtctcgactgtgttggtgattacacacatataagcatgataaaattgtctacaagtgaatataaaaacgagtacatgtaaaactagtgaagtctgaacaaggctgggtgaattatgtctgtcaatttcctgaaattgatattgtactataactatgcaagatgttaccattgggagaaactaggtaaagagtatatgggatctctgtattcatgtcactctaccattaagattaaatattaaaaaaaatgaatgcacagaatcagagaggcactcttaaagtgctgtcaacacatggcctttgaatacaattttgggtgctcaaagaatttgtagattgcttgatggttctaaaaagagaaagctcaaaagagctagatcctacataaatgaggtactattggtgttccatcttcctgagatgaacctgttaactagggcagttgccgtcagatctgtttttattcgcagtattttgcttaagctttaagatattttgttattaataattggccataaaacccttttgtgggcagagggaggtgtaggggcggggcgtgctatggaacttcaaatgggcaaaaccgaaagtactatggctgattgcagctgtaacaggtctttggagatacgtaaaatcctttaaaacagtgactgtctccctttatgcataaaaattttttctaatctactgggtgctcagaaaggatcacggaaagaggccattattaaataaaaagcagaaattataccaatgtgactttggattttcaaataactccagccctacctgcagagaggcagattcaaactactagcgatgttaagaactgaaatggattttaatctagtgataattaataaaataactgaattaccttcccaatagtattagttactttcccagtttattagggtgtggacaagaaaaaggattactgggtttccactttctagtccagagctctttttcacgggaacagagccctgtaaaagtttccctctctccaagcactttctccccttgactgttcctgaagaaggaacgatttccagttagcgtttaaattagcatagtgcttaactcagagcttggcttgcagggaaaactagaaaatacgtggtttcattgctctgcggcctaatcaaaccctggacaagagaagaggaagaaaataggatatacttgcagcgcgcaagcgctgcacaaagaaagcatgtcctctctgagtcgccgtaggtgctaggtggctgtggcttcggtcgttaccccacccccttccacgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccgggtgggggtacgggtgggggtgcgggtgggggtgggggcggagggctaggaagctccgggtcggacgctccatcccgtcctttgtattggccgggggtcttttccctcccaagacccctaggcgtaccctttcaggcctagggctgctttgctggaggaaggggaggaggaagcgggtggggcgaggtgggggtgcagcgcgttgattaagggacccgcggacatagagtcggaacccaccaaggaccgcgataaagcgctttagggttttggcagagtattcaggcacaaggtctcttaacttgagcatgcagattgtgtgttgtgtaaaaaccatacggtccataacattgtggggtgtggctggggggactgtcactgttctgtgggccttcattcggctatacagcattctcaaacactggaccgggatgcgatgagggagtgatagataatataccttatgccagagctgataatgtggtttttactagaatttatttttatgggaacacgatatagattgacctgccctttctaatactttaaaaggtcactataggtacttgtttgtgggtttttttttttttaatttgtaatgatatgtctgtgtttatttttctagattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctaggtaaacttcgatattattttgagaatgaaatgaaaaaagaaaaaacaaaaataaaaaactcatatttcatattcctttataattagaaatgcttaatttttgtctaaagtttttctaggatctcttcgatagaccttttattaaaaatgcgaacttctttaaatattggttgtttgaaatagaacatctcagtttatcttagtaaacctaaagaaattgtaatagtttagatattcctcaaaatgtcataatttttgtagacttcaatatattaatgtggctgattattttctctaggcaacaggttgaggatgtgtattggaatatcttaattccatcgtgcacttaacttcatgttacttagcttgtaaaaccaaaagaactttgttctttggattacccacccaaacaattaggtgaacactggaataaacatgtattttccagaaaagtttaccttttcattttttatgcatttttgcaaataagaaaacaactatatttctgaactttttgtaatgtttaatttttgtgggtacacagtagatgtatatatttatggggtacatgaaatgctttgatacaggcatgcaatacataattatcacatggaaaaatggagtatccatcccttcaagcatttgtcttctgtgtgacaatccagttacactttcagttatttttaaatgtccaattaaattattattgactgtagttaccctgtgtgctatcaaatatcgggtctaactcattttttctgtacccattaaccatctccacttccctaccactacccttcccacctctgataaccatccttttactctgtctccgtgagtttgttttgatttttagcttccacaaataagtgagaacatgtgaagtttgtctttctatgcctgacttatttcatgtaacataatgacctccagttccatccatatttttgcaaatgacaagatctcattctttttttatggctgaatagtactccattgtgtatatgtaccacattttctttatacatttatctgttggtggacacttaggttgctttcaagttttgactgttgtaaacagtgctgcaacaaacataggagtccagatatctctttgatgtactcatttcctttcttttggatatatacccagtagtcggattgctgaatcgtatggtacccctgtttttagttttttgaggaccctccaaactgttctccatagtgggtatactagtttacattcccaccaacagtgtacgagggttcccttttctccacatcctctccagcatttgtttttgcttgtcttttggataaaagccattttaactggggtgagatgatatctcattgtagttttgatatgcatttctctgatgatcagtgatgttgagcaccttttcatatgcctgtttgccaattgtatgtctttgtgaaatgtctgttcaaatcttttgcccatttttaaatcagattatgagttttttttttttcctgtagagttgtttgagctccttacatatctggttattaatcccttgtgagataggtagttagcacatattttctcccattctgtgggttgtctcatcacgtatgtcgattgtttcctttgctgtgcggaagctttttaacttgatgtgatcccatttgtccgtttttgctttggttgcctgtgcctgtggggtattattcaagaaatttttggccagaccagcgtcctggagatttttcccaatattttcttgtagtagtttcatagtttaaagtcttagatttaagcctttaatccattttgattttatttttgtgtaagttgagagatgggggacaagtttcattcttctgcacatagttttccaagcaccatttattgaagggactgtcttttctccaatgtatgttcttggcacctttgtcaaaatgagttcactgtaggtgtatggatttgtttcttggttctgttattttccatgggtctttatgtctgtttttatgccagtaccatgctgttttggttactgtagctatgtaggataatttgatgtcaagtaatgtgattccttcagttttgttctttttgcttaggatagctttggctattctgggtcttttgtggttccatataaattttaggatttttttttttttctgtgaagaatgtcattggtattttgatgggaattgcattgactctagattgctttgggtggtatggacattttaacaatactgattcttctaatccatgatcatggaatatctttccatttgttgatgttctcttcaatttctttcatcagtatttatagttttcattgtagaaatctttcatttatttggttaaattaattcctaggtatctaattttatctgtgggtattgtaaatgggattagattacttcttcaatttctttttcagattgttcactgttggcatatagaaatgctactgatttttgtatgttgattttgtgtcctggaactttactaaatttatcatatttctgaattttaaaaatgtataccgtgtctcctttttgtgagtgattctgtcaagaaaaaaaaaatttataattaatatgctttccaaagtaatgattcttgtttaattgaactgctaaaaataaatacaacttaaactgataaatattgtttaaacagagcagagtgaaaattatgcttcaaatatagaaaggatcttttagaagatagtttgcagtttgaaaagaaacttaatattttacttgcctattcccacttcttaatcagcagtaatggaatacctcctgattctaggttacttaatactaggtttctattgaggtctatttttagagaagggaaaagaaacccagttttatgatatttaaaatgataccattatatacataagccacatatatttcccttttttcatgttcatgtaggatagttgaatgcaaaatagtgaatacattcattagtgtttttcctcataatttaaaaattttcattgttagatcctcaggatacctaaggttatagctaggaaggtaaagaataaaatctgcccttagttggaacaatgccctagtcttaattgaagctgccttagctaccttcctccaaccaataaataaatacatactctccagtttaatgtatatttttgccattaagaagagttgagactgggcatggtggctcatgcctgtaatcccagcactttgggaagctgaggcaggtggatcacttgacttcaggagttcgagaccagcgtggccaacatggcgaaaccccatctctagtaaaaatacaaaaattttaagtggctattaaatgaagagttctgtgggccagatgaaccaccgcatctgaccctcagaactctgtttcatagccgcttagctctaatcattagaaatgtatttctcatatttaggcccaaatctggttcccggtaactactacccattagttgtagttcttttcttcataatggccctaaggttattgaagacttgtaatcattctttgttctccccttcccaagataattcatttattttgatgatctaaacagttgtagtacagtgtgctactacatacttctctgcctttgagttttggatccagaagatttttagtactataaattcttcagtatgcaatgataatggtgtgaaattttagatagttttgcgtaaaatactttatgttgcagagtttttaggctaaataacagtaaactagcattttatctttaatgtgtcatccttaattctaaataatgactactaatctagaacatttgaattacctcccagttttccagatgatatcttaagaaagattctaaagttttacagcctgcctgcagaactatgatgagattttagaaataatccactactttagttttcagcctttttgagtatgacgtttctctttctaatgttaaaaaagttacatatttatcctcccataatagtagttttaactttgttaaaatgcacacaaatagctaaaagctgttttgaattcaaaatcaattaatagtatgtatttacattttgaaaaatagctatatgtgttttgaaacacgtttacttggtatgactgtagattcatggagcctgcattaactcaattggttaggaaccagaaatctaatccagcgccttcatattatatataaagagtctgatttccagagataaatgacttgagcaaagacagattatttggtggagaaccaggtggagaaccttgtcacttgggtttgtacttttattaccattgctgatactgaagtaagaaggtacattttattttgttaattgcttttaaatttatgtgatgaattttcttttgaaataattgtgcttttttttttaaaaatttttgattcagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggtaaaccaaatcataattatttctgaatattgctttgaatttaaatgtaaaattggtagaatgggctgtgttttaattgttaaaattgagtctttgataagatgtaagttgtagagatttggaattgtaaaagagttatttttaaaagttttattgtcacttttcagacattttctatgcattttatgtgtatatattaattaaaaaacagtgacacacatataagacattgatgagataggtaaaaattgcttcagtcaacaagaatatgatggaaattgtcggtaatctaggttttttctcaaacgtattttttttccattggaaagttttgcattaaaattttctttttgtaaaaagctgaaactcagcatttcatattttaatttttatatcaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctataggtaaataaagatactgctttggcttcattctgtgagtactgtttagtcttttagactagtggttccaaagtggttgcttgcagactgaatatagcttgaagatatattttgtatggccagcactgtattttttattatgaacattgaaaagtcaaaagatctggcagcgctgttcctagcttccacaagacaacattctgctgaacttgtataacagtaaccccctttaaataagttatatactttacagtttatgacagtgcttgtcattctcaaccgtattactccaagccactttatatgttcacttgcttagcctctataggcttttaactttggtccttgttttagaattcgttttgtggaatgtcggtctttttactgtcagaagctttgaggaaggaactttttaaatgagaagggctacagttataactgagtccaattcttagaaagctgaagattttgaatttttatttgtttttgttttgttttgagatggagttccactctcgttgcccaggctggagcacagtggcgcgatcttggctcacaacaacctccacctcccggattcaagtgattctcctgcctcagcctcccaagtagctgggattacaggcacccaccaccacgcccagccaatttttgtatttttagtagatatggggtttcaccatgttggccaggctggtctcgaactcctgacctcaagtgttccactcgccttggcctcccaaagtgctgggattgtaggtgcaggctgccacgcccggctgagattttggatttttaaaccaatttaaggaaccagttagatgaagctagaatgctcagtttttacagtcacaggtatcaatttattaaggactacaatgtaatttttataagcatctttgtactttagtagatttgttggttaagatataatttcatagttatcttactgttagattttatccattaaggaaagtggtattctggttaataatgtagatgagccaggcgtggtggctcatgcctgtaatcccagcactttgggaggccgaggcgggccgataacctgaggtcgggagttcgagaccagcctgaccaacatggagaaaccccgtctctactaaaaatacaaaattagctgggcgtggtggcacatgcctgtagtcctagctactcaggaggctgaagcagaagaattgctcgaacctgggaggcagaggttgcgatgaaccgagatcgcgctattgcactctagcctgggcaacaaaaccaaaactccatctcaaaaaataataataaaaataataataataataataatgtagggtgagttcctttaatgttaccatacagactacacaaatttcagaatttaaactatagtgcacatagaaaaattaggccatttataggacaattggaaatgtgaacactatgtcttgatattaggaaattattaattttgtgaggtgtgatgatgaataattagttttgcaagtaaagagtccttgattttagagaaacctaccaatatatttacagaagaaaggatacattgcctgtgatttgcttcaaaataatatggcaagaggtaaatttggcaaggatatagatgaaacaaaactagctatgaattataattgttgaagcaaggtgatggattttattaagctagtgttcactcttctctgtactaatatttctaaatttccaaaagaagaggcaagtcagtaagcaaatagtacacaactaataaaattcaagggactatgtttttcctcttaatgtaattcttaatatattgatatgcttaaaatgtatgcacaacagttattagagacattggttaacagatggtgtgttgaataaatcagctttttctgtattgaactagaaaacgtataatttgataatttaatagatgaaggtataactttgtgtttccttctaccagttcctttttttttttttttttgagacagagtttcactcttgtcgcccaggctcgagtgcaatggcacgatctcagcttactgcagcctccacctcccaggttcaagcaattctcctgcctcagcctcccaagtagctaggattacaggcatgcgctaccacgcctggctaattttgtatttttagtagagatggagtttctccatgttggtcaggctcatctcaaactcccaccctcaggtgatccgcccacctgggcctctcaaagtgctgggattacaggtgtgagccactgcgcccggctccttctcccagttctaattgatttgaagtttcaaaaagcaggccgggcgtggtggttcatgtctgtaatcccagcactttgggaagccgaggtgggtggatcactcgaggtcaggaatatgagacaagcctggccaacgtggcaaaatgctgtctctactaaaaaaataacaaaaattagcctggcatggtggcacgtgcctgtagtcccagatactcaggaggctgaggcaggagaatcactcgacctagaaggcggaggttgcagtaagccgagatcactccactgcactctagccttgtctgggcacggtggctcacacctgtaatcccagcactttggaggccaaggtgggcaaatcatgaggtcaggagttcaagaccagcctggccaacatggtgaaaccccatccctactaaaaatacaaaaaattagctgggcatagtggtgggcacctataatcgcagctactcgggaggctgaggcaggagaattgcttgaaccctggaagtggaggcagcagtgagctgagatcgcaccactgcactccagcccaggcaacagagtgagactctgtctccaaaaaaaaaaaaaagcaaaagtatgttgtaaagtttgattaaatttaattttggtattgtccagagagttactaaaatagtaaagtaggcttttattaaatatggatgttacctgttttatttaaagaaattttgaacatcttatacctgatgctcctgaactgatacatgattttctggtgaatgagaaggatgcaagttgcaaaaggaatgcatttatgatgctaattcatgcagatcaggtgaggtactttttaaaaaatactcttattactgtatttaagtgacaattaaaagtattacatagacttaatcatgtttttagtcagtaattttgtttatagttcatgtggtttgtgtattttgaaatttttaagcttgtagaaaaatacatttttttcttaacccttctctaaaatattgcatatgtatacattcttttttcaattaaacattgaagaggcattttagagcagccaccctacagtttttaaaaattaaaattattatgactgttctttcctatgatggtatagatctaaaattgtttagtagagaaaaatagtagctttgcatagatacatccttagccatgcctgtggaaatagggtggccttcagtgtagaggtgtatccttttaggttcttcaactttcatacacgggtgccaactccacatcctgctctgctggtggttaaagtacatggatctacttttggttagcaattactctgtacaccttgatgccatctaatcttgaaattttctagccagtatttatcaccaaaatatgggaaataatatgcatgaagtctgaaaaatatggaggccttccagtcctctgaaatctagacactgtgacttttttcccccagatcttcctttaatggattgtcccccagttatttaaaattgtggtaacatacacataacaaaaaaatttaccctcttaaccatttttaagtgttcaatgattttaaatacatttataatgtagaaccatcactatcttccatcctcataactttttttgtcttgcaaaactgaaactctgtacccattaaaaaatagctccttattaccacttcctcccagtccctggcagccaccattctacttgctgtctctgtgattttgactaagtattccggataagtggaatcatacagtatttgtccttttgtgactggcttattttacttagcctaatgtcttcaaggttcatttatgttgcggcatgtgttggaatttctttcctttttaaggctaaataataccccattgtaaatatatgctacattgtgtttacctgttcatccattggtggacacttgggttgcttcaatcttttagctattaggaataatgctattgtgaacgtagatgtacacgtatctgtttgagactttgctttctgttattttgggtatacacccagaagtggatttactgaatatacagcaattctgtttttaattattttaggaagtgccatactgttttgcacagcagctctaccattttacattctcactagtagtgcacaagggttccattttctccacatccatgccaacacttgttgctattgtttttttgatagtagcaatgttaataggcacgtgaagtggtattcaatattgtcattttgtcttcctaaacaagattatgagaaagctgcgtatatgagcagtgttttgtcctcttgtgtaattggttttactgaccaatgcttttggcattatgctgttaacctacattgaggggcgtaatcagaaatagtccaataaaatttattgatacttttactggagagatgttttcagcattgtagttctgtatattacagtgtccaatatatgaggacacataggagatttttcttttaggtctcagtaataggaataactatacacctaagcagctggttttgattgtatggataccctgaatcccataacacatagtgttttccctctttggtttagctgctagaaaatcagatcccaggtttgtggctcatttccagaaaatatatttaactttatgtcttatattttatatgttaattttattcttgatttttttcccagttaatttctctttgccctgatctcctcatttgttttatattgagttgtaatgtgtgtattttttaagatgcattaagtccttctattgaatgaggtggagaatgataaatatattcttattttttttaggatcgagctttggattacttaagtacttgcattgatcaagttcaaacatttggagacattctgcagctggttattgttgaactgatttataaggtaagaatgataatctatgatgagtaaaataaactcagcagtttaagacagggttaaatactttctttctgggataattattgctaggataatatattttaatagtataaatattttatagcatagcctattaaagcctttgtttcttttacttttggtttattgtattttccaagtagaatacttgcttatatcctttctaaacctccataaagattttgataaaaattcatggcttgagccagtgtagctgcacataaatcattgtgaacttcccagtcactgaatagattataattaggctttaaaataaaattcaagattttcttgagcatacatcagactaaaatcaaacaaaaaagccttaaatactttttatgttccctgtttgtaaaagagaatagaaaaactttaaatgcattaatatgacattgtaggccattgacaggaaatctaaaaccagctaagaattttggatttttaaatcaaatactatattggcaacactttactatgatatatcctttgaaagagttggttacatcttaatgttctgataaaaggtacaagaagatccaactttgctattgataccattagaggccaacaaaacataggtccagatggctttattaaatatgatagtatggtcaaaacaccggtagacattactaactgattatagctgtcttgcttctgtaagaaaggggctcctcttaacacaaggtaccagtagtttggaatgggaatttaagatgaaaccaagacttactgtacagtttttttttgttttttttttgttgttttttgttttttttgggcagagtctcactctattgcccaggctggagtgcagtggtgcgatcgcggctcactgctgcctctacctcctgggctcaagcgattctcctgcctcagcctcctgagtagctgggattacaggtgcacgccaccgtatccagctaatttttgtatttttagtagagacggggtttcaccatgttggccaggctggtcccaaactcctgacctcgtgatctgcccaccttggcctcccaaagtgctgagattacaggcgtgagccaccatgtccagcctatagttctttttaattcatgtgtatagtttaggataccactgaggttctcaaaattagcggttccctgctatctaatgacttaagtagggtccatgttatagtaaaaggaaataacttttaagtcatgtccatgtaatagagttttgactatatatattttaggaaaatctactacaaatactgacttcaaaagagaaaaaataagggatatttactatacaagtaaaggtatcaggatacatttagaatgggatagaaatttttagttttctctccaatgttgaatatagtctcaaataataagtagtagtacttgggaaaaatgtgttatctttcttgcttgaaaaactggtattttccttttattagctattgagatttatatcatccgtcatgtttccctttggcatccagaataaacatttaggaccaaatttaatatcctgtgacagtacccatattagtgtactgggttaatgtgtccttacttttgttactttacattttctttttctctttcacttgtgtatagcatacacattttaagtcatcagaaaaccttttacgaaacagtaaaaatataaattatgatgggatgaataaataagtgcacagctgtaaaaattattttgttcacaccatcctatctagtaaagccatttcttatctatgtttttgttggcctctaacttgcttctttctgaaattactgatgttgtgtcatagtgtctcatcccattttgtctgatattttcatgtcctcataagactgttcttagctttcatattgagaaaactagcatcccataagctgacattcatgaaaaaactccatttgaaaacaagcgttcctgaaatcggttgaaatgttaatgttttcttctccaggtctgtcatgctaatccatcagaaagagctcgttttattcgctgcatctataacttattacagtcatccagccctgctgtaaaatatgaagctgctgggacattagtgacactctctagtgcaccaactgcaatcaaggtactgtgtatttcttttggggccagattagatgatagattttctgtcttagcactcatgatttagtgacatttcaattcactatgtggttacatggcacagagagaataactacaaacttataaaattatttgatgccttacattgttcagccttccttcttttcttccttcctgctttcatacacacatatatagatacagacagagaatgacagtacagttaacctctgacaacacaggttcgaactgcgcaggtccacttatacatggactttttttctacctctgctactcctgagacagcaagactaatccctcttcctcttcctcctcctcctcctcagcctactcagtgtaaagaggttggggatgaagacctttatgatgatctacttcctcttaatgagtagtaaatattttccttatgcttttcttaacattttcttttttctagcttactttataagaatacattatataatacatttaacatacaaaatatgggttgttttgttttgttttgagacaaggtattgctttgtcacccaggctggagtgaggcaatcttggctcactgcatcctccacctcctgggtttaagcaattctcctgcctcagcttcccgagtagctgggattacaggtgcccaccgctatgcccagctaattttttgtatttttagtagagatggagtttcaccatgttggccaggctggtcttgaactcctgacctcaagtgatccgctaacctcggcttcccaaaatgctgggattacaggcgtaagccaccgcgcctggccacaaaacatgttttaatcaactgtgtcattggtaaggcttctggccaacagtaggttattagtagttaagtttttggggagtcaaaagttacgtgcgtggctgggcacagaggctaacacctaaaatcccagcattttgggaggccaagctgggaggattgcttaaaaccaggagtttgagaccagcctgggcaacaaagagagactctatctgtacagaaccttttttttttaattagctggtgctaggtgtggtggtgcatgcctggagtcccagtactttgggaggccaaggtgggatgatcgtttgaggccaggagttcgaggttgcagtgagctatcgtggtgccactgtactccagccaaggcaacagagaaagacaaaaaataatatgaattagctgggcatggtggtgtgtgcttatagtcccagctattctgaaggctgaggcatgaggatagcttgagcccaggagttcaagactgcagttagctatcattactccagcctaggtgaaacagtgagaccctgtctctaagaaaataaaaattaaaagaaaaatgttacatgtagattttaagttttagtgagtgttttcaataatagagtatttacctttctccctttctctaatttattctatcaagactatatcatcagcccctaatctattcagagaatgagctgttctaaaagccaaattgtttaaattggagaatttactgctttacccaaaacttgaactttttttaatttttgattttgaaataattttaaacttacagaaaaattgcatagtacaaagttcttttctgttgttgtttttttgttttgtttttgttttttgagacggagtctcactccgtcgctcaggttggaagatactggtgggatcttggctcactgcaacctccgcctcccagattcaagtgattctcctgcctcagcctcctgagtagctgggactacaggcgcatgccaccacacccagctaatttttgtattttcggtagagacagggtttcaccatgttggccagaatggtctcgatctcctgaccttgtgatccacccgcctcgacctcccaaagtgctgggattataggcatgagccaccatgcccgatgaggacaacattcttatatatttttcacccagcctttctcatatgttcacattttctataatcatataattgtcaaaactacaaaattaacatcagaacaatattattaaccaaactacaggctttattcatatttcatcagttttcccactgatgtcctttttttgttcaggatctaacctaggatcccatattgtatgcagtggtcatatcgtagtctcctccaatctgtgctagttcttagtcacttattatttttcatgaccttgacgcatttgaagaatactggctggtttgtttgtaaaatatcccgtaacttgggtttgtctgatgttttctcagattgaggttgtacatttttggaaagaataccacagaagtgatgtgtccttcttagtgtatcttaccaaggagtacatgatgtctgtatgtcttattactgatgatgttaaccttgatcagtgaaggtgctgtctgccagatcttccagttttatgatttcttctagtgtaatcagtacatgttgtagggggagatactttgaaactatgcaaatatgttgttcctcaaattcacacctacttattttagcatccatcagtggattttcttacaattattgctttggtattctaatggtggttttctatttctctcattcagtatttatttattggaattcttatgcaaggaagggctgttctttctcttccctccctcccttcttttccttccttctttctttgtatcagtatggacattttattctatcattctaaaatactttacacattttttgtcttattaatagttattataaatactaaaatattttaacaactctgggtgatctttatattcttgttgtttgtgtactgcaatgcagatgagttagactttgcctctaaactgaaatatgcttaatcgatgtacttcttgggattcttttcctgcatttttctggcttgttccttagttttaacccttaaattttggctgttagtaagtatgtctacctatagcagctttttttcatccttttaatttgtaatgcctctaatcttctgtaagtttgaaaaataacaagggactagaggaacccattcctcagaacaaaatgtataatatataaactctagtacagggattaattaatgagtgtattttggcttcatgggagtgtgtgtgtgtgtgtgtgtgtgtgtgtgtggtgtgcgcgcgcatgcttattttcaaattttatgatagatgaataacttcttaaaatgtatttctttttttatataggctgctgctcagtgttacattgatttaattattaaggagagcgacaacaatgtaaaactcatagttttggatcgcttgatagaattaaaagagcatcctgctcatgaacgagtactacaggtaagtgttatctgaaaaagagagatcctaaataaaatgtttttcaaatttaggtcattctcaagctttgcccatcttggttaacctaaatgcttggaaactgagcagtttatattttgatcagctaaagtgttaactattgagtcatcatagccttttggggtattatctttaccacaaaaaatatttctaaaatggctggacgcggtggctcacgcctgtaatcccagcactttgggaggcagaggcgggcacatcatctgaggtcaggagtttgagaccagcctggccaacatggtaaaaccctgtctatactaaaaataacaaaaattagctgggtgtggtgaagtgcgcctgtaatcccaactacttgggaggctgaggcaggagaatcacttgaacccaggaggcagaggttgcagtgagctgagatcgtgccactgcactccagcctgggcaacagagtgagactctgtctcaaaaaaaaaaaatgtttttctaaagtgaatcagtattatatttttttatcttttcggtttgtactgtattgactattcttagcgacagtgacatactcattttaatttgaatataatttacatttcgtggaaaattattataccaattgagaataaaaggtgatctgattctagaaaattatcaccatatttgtttaatccatgagaataataatggttataaaaataaaaccccatggcaggtaaatgcagtgctgatcttggatcagaacaacagcaacaacaaatttctatgaaggacattattgggacagattgagaaatatgaatatggtgtgtatattagttaatagtattgatcagtgttaaattctctgataattataatgtggttatataagaaattatccttacccttgagagagatacactaaaattatcagcagtaaagagcaaatgtgggccaggtgtggtggctcatgcctaaaatcgcagcactttgggaggctgaggcaggtggatcacctgaggtcaggagttcgagaccaccctgacaaatatggtgaaaccctccctgtctccattaaaatacaaaaattagctggacatggtggtgtgcaactgtagtcccagctactcaggaggctgagacaggagaattgcttgaacccaggaggcagaggttgcagtgagccaagatcttgccactgcactccagcctgggtgacagagcaagactccatctcaaaaaaaagaaaagagcaaatgtgggaagatattaactggtgaatgtaggtgaaggatatacaggagttcactcttagaacttttttatcagtttcgaattgtttttaagtgtgcatcttttaaatgttacattttcctatggagtcaaataatatcacatttaacgaaattgttaataatttatgaatgttatctaataccaagtctatatgtagattttcccagttatcccaaaagccctttttgtttagtttgcccattttgtgaccatgtatcgtatttggtggttatgccctttcagtctcttaattttggacagtatcttttttttatgacactgatttgttgaagagaccagaccagtaatactataaaatgcccctctttctggatgtgtatggctactttcttacgttgtttagcttgttctttgacttctgttactttctataaactgtaagttggagctttagctttagcttgacagagtcaaagtaaacattatcagtttgaatgtgtcatgtgctattatttcatattgcagtgtatcaggagacccaaactatctagttcttccaccactagtggttttgttattgattaaagaattaaagtgatgatagataaaccccaccattctgcagtgaagatttttttcctgtgaccagaaagattggtgttaattcttgattttttcttcttttttaggatctggttatggatatcctaagagtattgagcacaccagacttagaagtacgaaagaaaactctgcagttagcactggatcttgtctcttctagaaatgttgaagaggtaaaaggaaactctgacagcactttgtagctatcaggcccaaatatgatgtaactctcacttatttttacttcattctataagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtggtatgtaattctgatgactttaattttgaaattatctaaaagaattttttaaaaaatatagttatttgacaaactccagaaatctcagctgcctagaaccattaaatctcatggtgagaagtgatctttatatctacctctacctttaaactcagaagggtgaggactgacttctttcacttatatattcatcaaaaaaacaaaaacagtgaccaaaaaaaagctttgcatattattttaattgatgatacagttacctaaagtaaaattatgctgtgtatatatattattcagtaaggcaaataggtatttattttaaatagctttagctcttaaaggaatcagttataggaaaaattcacatatgtagaatattttgctgtcactgtcagataagtgaggtatgttattataatttgatttttgcctttgagctcttgagttctctctaaaatgattttagttacaatttaggaggatcgaattcatttatttatttggagttttggatctctagcttatcttttatagtgaattttaaaataaattttgctgcacataaaatggaaaagccattgtgactttgtttacataatagtacttgtctctcaatttacattttgttgtgtatttgaaaattattaagaattacaagggtcaggcatggcacttcatgtctgtaattcgagcactttgggagggctaggcaagaggattacttgaggccagggattcaagaccagccagggcaatatagggagaccctgtctctacaaaaaaattaatattagctaggcatagtgtcatgcctgaagtcctagctcctggggaggctgaggctgccagaggatcacttgagcccaagagttcaaggctgcagtgagctatgattgtgccactattctctagcctgggcagcaaagcaagaccctgtctcttagaaaacaaaaaaagaattacattcttttaatttatttcttgtcctagataattttcttttcgaaaattattagttccattttcttttttttttttttcttttagttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagtaggtttaaaatacatttaaatgtaaggtcaagtaagcattttatcagtttttatctttaaagggtcagttgatagaaaatagaatggagaggacaatcaagccaaaataagacaagtttgtacaacaagcatctcgctaactccactctcatttagtctataataaatggcccaaaataatttttttaggagtgatttagctcagggtctctattctgattttctctaaaacattgtgaatcttaaagtaactaaagagcatatttttaaatggcatcactttttggctattactattatttatatcttcctttcacatttaatgaagagaaagattgaaaatgcaacctaaatctgtctttcccttcagagagcctttgctaatgagaaaggactgttgcatctaaattttgcttcatttaaagcatctgatggatagtctctaacagacttgaaatatgtctcaggaaggaagggacaagtacaaaattgtttttatgatatgaaaatatattaatatttatggaagtgagcagagcaggatttgcttcctttgtgagaagaaaatcatattaaggatttgctttttttttttttttttttttttttgtgagagggctttccggcaaaaaccagaaagcctgctaaacaaattttaaaagagctatgacattaagaatttgtttttgacagccataatctcttagagctttggtttctataattaagtttttctgaataaatttaattaaaatcttaggggaaagatgactaaggactttattcagtttaacattttaaactaaagaattgttggctgggtatggtggctcacacttgtattcccagcactttgggaggccaaggcaggagaattgctggatgtcaggagttggagaccagcctgggcaacatggtgagactttgtctctatttatttttttaatctaaatgaatgaatgaatggttgctttctttactattatttttttactgatcccttgtacttcttctgtatccattgttcagttcaacaccttgcctcttcagtgactgaaaataaaaagtgaattactttttacattaaaataatacattccctgattttttgtttttgtttttgttttgtttttactttatttatttatttttttaagagagatgagggccttgctttgttgcccaggctggtctcgaactcctggactaaagcaatcctcccacctcatcctccccagatgctgagattacaggtgtgagccacagtgtctggccataaaataatacatttcttagagtagtaagagattaagccaaatttgccttcactgtgtcctaaatggacactttactgggaaacattttggtattttatttttactgctaggtttaccagttttagaatgttcctaataataagaacagttattttacttttaatctttgtgatttctggagagaactgaaacctaggttttgttagattctttctgaaatatttatctaaaatactttagaactgcagaatcttgttggtttttgttttttgtttttttgttattgagacagaagcttgctctgtcacccaggctggagtgcagtggcgctatctcagggcattgcaacctccgcctcctggattcaggcagttctttttttttttttttttttgagatggagtcttgctctgtctcacaggctagagtgcagtggcgcgatctcggctcactgcaaccgccgcctctcatgttcaagcgattctccagcctcagcctcccaagtatctggactacaggtgcgtgccactgcatccagcaaattttttttgtattttcagtagagacgaggtttcaccatgtttgtgaggctggtcttgaactcccaacctcaggtgatccgcccgcctcagcctctcaaagtgctgggattacaggcgtgagccactgtgcccggcctcaaggagctcttatgcctcagtttcctcaatagctgggattacagatgtgcatcaccatgcctggctgatttttgtatttttagtagagatggggtttcaccatgttgcccaggctggttttgagctcctgggctcaagtgatccgctggcctcagcctccgaatgtgctaggattacaggcgtgagccaccgtgcctggcccttgtttttttttttttttttttttttttttgagacggagtctcgctctgtcacccagcctggagtgcagtggcgcgatcttggctcactgcaagctccgcttcccgagaatgggttcccgccattctcctgcctcagcctcccgggtagctgggactacaggcgcccgccaccatgcccggctaatttttttgtatttttagtagagacgtgatttcaccatgttagccaggatggtctcgattctcctgacctcgtgatccgcccgcctcggcctcccaaagtgctgggattacaggcgtgagtgcctggcccttgtttttatttgagcttaaattaacaaagaaagatctctgcttcaagatttgtctgccaagttcatgtttcagatcttgtattgtgctaggatttaccgaggagcattatggatcctgggagaatactgtagtaccaaggaagacattcagagtgtgatgactgagatccgcaggtcccttggagaggtatgttttactttagtaaatgttagtttatatggtaatttttcctttaggaaaatctgactttttatagtgatttgcttacattatttacacttctgagttagattttgtttgaacaaaatgttctgtgtttattaaaaaaaaaaaaaaaaaaagaagcagtagcttgtaaaattctgctttagcctgtattctgaaggaagaatgccttagagtaagtctgacttcagaatatttatgcactaaaactgacagtattcttcatcctaacaaccttatggtagaatagaaagaacagtggactaattatcaggagacctgacaattagttctagtcattgttgtgtcgacagttagctggaggaccttgaatataagttcctcaacctaacttgacatcagtgtttttcacctataaaataaattaaaataggtaatgattaaatactcttagtgctcttacattaggtaatggactggtattgagtaataaatacataatagccattcagttaatttaaaagttagttgatgaggttattatgtacaaataagtcggatttatttcattttagaaggatgagtactgttttggttaacatttcaaggaaaggaatgaagaagaggaatacgacttaatgaccatctgctttgtgttagacactgtccaatgcatttttctattaggtaaaatgtgtagaaagaattaagatttccacttagcagattaagaaactgaggtccaaagtagtaagtggcagagtgagaattcaaaccctggaatatccatctctgaagcccctattctacctactacattatcctgggaaggaaataaattgaaagcagagttcccagttccaaaaatcccattagggtaatgccttttttagagaaacaatcaaatatttaaagataattttgcttgctgttgatactattactaaaatgatgtttccaattgacttttagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacaggtaatttatggcacatataccctgccagctgtactacttttattattactcttgtatgtaaaacagtcaaatgatttctttcctcttgcttttgcaaccaaaatgaaaatctttgccatttaaggtacttgagaagcggaggatgtttaagttcttccccctaggaattgtattgatggttttaattctctgtcccttccagtgtttttatggaaataactgttctgtttaaactcaaattatttttactcagaaaatgctaagtgggggtaactgaagatatttgagttttgttgtttattagcatctgaaaacattttgaagatttttcaatttctaaatgatggaataaaattgtgcatttttctattaagtaaattttaatggtgaagatggtgaaatctttgcctaaaattttactgaatacccactaagtgctaggcattgtgctaagtagtttgtctcatatagtcttgacaataagcctttgagatagaatatattatctccattttatggaagaagaatttgaggcttacccagtaaataaacaggtaagctggaattcggaggtacttcattagctgcaattacgtatgcccctaattaaatattgtatctttccatattctgatggcttttgtgtcattcaaagataagttttcctttttttttttttttttttttttgacacagagtcttgctctgtcggccacgctagagtgcagtggcgcgatcatggctcactgcaacctgtctcctgggctcaagcagttctcctgcctcaatctcctgagtagctgggattacaggtttgtgccaccatgcccagctaatttttgtatttttagtagagacggggtttcaccatgttggccaggctgtcctcgaactcctgacctcaggtaatccgcccgccttggcctcccaaagtgctgggattacaggtgtgagccactgcacctggccaaagataagttttaaagtcatgtattatttttctttttccttctttcttctgggagctaaggagttagttagctaaggtatccttatcactgaaggatggtaataagagtgtttaataggcctatatcattcatttatacagaagctgcatgctgcttagcaagttggtgggtttgattttccttggttgctttgcagacctcccttgagaggattccttctggatggagatttctttgttgctgcctcccttgccacaactctgaccaagattgcattgcgctatgtagctttggttcaggagaagaaaaagcaaaatgtaagttcatttattttacatttaaccaacaattaaacattgagtgcctactatatgcattgaacagtgagggactcaaaaattaatgctaagtttctgtcatgaaagagtttatgatttaatagcagaagtggacacagtaatatattactctaaaattgataaagtatcttcctcttctgtttgggctttaaaaaaatgaaaattgacaaagtaatacaataacaatgtcatgtgattattccagtggaagagaaaggatttatgaagtcacctcagtttgctgggattagttcaggaccagtgaaggaaatgtccttctctccagcatctgcatccattcggtcattgtctgttttatcccagaatgtctcttaagttattctcatctgtagttcatgcctgctttgtagcttctgaccgttctaaccaaacacccatttacaatggtatgcagttggtcctccatattcacagcttctgcacctgcagattcaaccaactatggattgaaaatatcttttttaaaaaatgataaacagtaaaaaataatagaaagttgaaaacaatacagtgtaacaattatttacatagcatttacaggcatacttcattttattgtactttgcacatattgcttttttttttttttttaaacaaatgaaggtttgtgggaaccctgagttgagcaagtctgttagcatcatttttccaaataagcatatgctcacttcatatctctgtgttacattttggtaattctcacaatatttcaaactttttcattattattacatctgttatggtgatctgttatcagtgatctttaatgttactatcatagttgttttgggatgccaggaaccattcccatataaaatagtaaacgtaatcaataattgttgtgtgtgttccgactgctccaccaactggctgttaccccgtctctttcctccttgggcctccctattctattccctgagataccacaatattgaaattaggccggttaataatcctacagtggcttctaagtgaagggaagagtcacatgtctttcactttaaatcaaaagtgagaaataattaaacttagtaaggaatgcatgtcaaaagctgagctaagccaaaagctaggctgcttttgccaagtaggtagccaagttatgcatgcaaaggaaatgctcttaaaggaaattaaaagtgctactccagtaaacacatgaatgataagaaagtgaaacatttggcaggcgtggtgactcacaccagcactttgggaggcccgagacaggcggatcacgaggtcaggagttcgagaccagcctggccaacatggtgaaaccctgtctctactaaaaatacaaaaattacccaggtgtggtggcaggcgcctgtactcccagctacttgggaggctgaggcaggagaattgtttgaacatgggaggcagaggttgcagtgagctgacatcacaccactgcactccagcctgggagacagaacaagactccgtctcgaggaaaaaaaagaagaagaaagaaagcgaaatagctttattgctgatagaaagtttgagtggtctggatagaagataaaaccagccacaagattcccttaagccaaaagcctaatccagactaagaccttaactctcttcaattccatgaaggctgagagaggttaggaagcttcagaagaagagtttgaagctagcagaggttgattcatgaggtttaaggaaataagcccgtcttcataatgtaaaagtttgacatgaagtagcaagtcctaatggagaagctgtggcaagttatctggaagatctagccaagatcattggtgaaggtgaccacactaaacaacagattttcagtgtagactaaacaaccttatattggaagaagatgccatctaggactttggtagctagagagaagtcggtgcctggcttcaaagcttcaaaggataggctgactcttttggtaagggctaatacaaccagtaacttaagttgaagccattgctcatttcccattttgaaaatcctagggctcttaagaattgtgcttaatcaactctgtctgtgctctgtcagtggaacaacaaagcctggatgtcagcacatcctctttacgggatggcttactaagtattttaagctcaccattgagacctactgctcagaaataaaagactccttttaaaatattactgttcattgacaatttagctggtcacccaagagctctgatggagatgtagaaagaaatgaatgttttcatgcctgctaagacaacatccattatgctgccactgatcaagtagtttcaactcttattatttaagaaacagaatccatagaacatttgtggtagtagcgcagagttggttacaatgtcctaccacagcaatttctgacattcaaattgggcctgtagcaatgggactccttttgattccttcagctttcgtattatgttggttatctatacagcaggtttctaaattgaaacactttcactcacatcactcatatttccttcgtttttggagactaacagcttgatctaaaaaaaaatttttttttagacggagtctcactcttcttgcccaggccggagtgccatggcatgatctcagctcactgcaacctccgcctcctgggtttaagcaattctcctggctcagcctcccgagtagctggggctacaggcgcctgccaccacgcctgtctaattttttttgtatttttagtagagactggggtttcaccatgttgaccaggctggtctcgaactgctgacctcaggtgatccgcccacctcggcctcccaaagtgctgggattacaggcatgagccaccgtgcctggccaggttctttttgtttttgttttaattccattataagaaaagccataaatgagagccagataatttacaaggtatattatcccttaattgatttgatttttgagcaataatttattttgtaactcttttgtgggcatttatttattcaggtctggtcacagtataatctttaaagtatgttttttaaaagtctccaacatttttttatctcagagttgaatttgctttcctctcctggttgcatcacttctggaagttgggagtgtttactgatacctgcttaaaagagccagtttcttgtaacataccgagttaataatgtttgcactgtttggtacaagaaggaagtttggttgcttataatctcactggcactccttcatttatgccatttccaacactcttcatttctttgtgtaggactaagtttctggtatcatacatcttttgcctaaagaatttgctttaacttttcttatagtgcagatttgttggcaacagattgttccagtttttgtctggaaaaagcctatttttttgtacactttagaaagttacctttgtgggtataggattctaagtcttctgtttttttttcccagtagtgtaaaagtaaagctccattgtcttctggctttttggtgagaagtctactgtcattcttatctccctgggtggagagagagagagagtgtgtgtgtgtgtgtgtgtgtgtgtgtgtgtgtgtgtatttcttccactggttttagattttctccttttcacttggtttcagtaatttgattaggatatgccttagtgtggttttcttcatgtttgctgtacttgtggttcattgagcttgttgggtttgcaggtttatatctccatcagtttgggaaattttcagtcatttcctcggatttttttttctgtcccctcctctctttcctctccttttggagacagtatccaaacttgggggacatatacttactcttctgctggtttttcccaggcctccagtagtttttcatgcatgtgtgcagatcagtactcagccaaaggcaatttggcaagggcttagagcatatgtgtcaggataatgctacatgagactaaaaaagtaagttgcaatcacttgtggaagactttgaatagcgagctaagtaatacggacttcagtatgaaggctgacattcattaaaggtatttacatagggaatgaaatgattggtgcagtataaagattaagatagcagcatcaggtgatcacgcttagcagcacaataattggacagcctaactttaggtaccttgtgatgcagtacagggtgaaatacaaaacatcacctatctggtattctaatcaaaagtgtgggatattctataaaacaactggcctcagttctttaaaaaagttagtgcgattaaaaacaaaacggcagagaactggtctagattaagagggataaaatgcatgaagctgatcctggatttaaaaaataaaacaaaaacattttaagacaatttagggagatttatttgaattcagagtatagaagctgtattttggaattgttgaatttttcaggtgagaaaatgaaattgtggtttgtaggaaactgttctgactcttaggagatgaatgctgaagcatttatgaggtgaagactttttcacatgtcagccaaaaaaaataagtgtacatatacagaataggtaagcaaatgtggcaaaatgttaacaattggtaaagtatatcattcttttaacttttctgtagttgggattaaaaaggacagcatcagcatatgaagtggttacagagaaggactggagcaagggaaaacagttaaaaagcctctgctgtctctaattgaggattaatgcaggtcttagagagtggcagttaagagtagaaaggaaggagaagaatgcaaaaacagatatggacataaaatccaaagaatttgaaatcttattcaggtgaagtgaaaatttagattgtgagttataatgaagtgacatgattgcaatctgagaatcaagacaatatcagtaaccgatttctttactttcttagtcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaaggtaaggtatatatgatgaggcaacaaaagtgttttgtgtctcttcgtgcagtggctcacgcctgtaatcccagcactttgggaggctgaggcaggaggactccttggggccaggtgtttgagaccagtgtgggctacatagcaagcccctgtctcaacaaaaaaaatgagaaaattagccaggcatggtggtatgtgcctgtcattccagctacttggaaggctgaggatgaaggatcgtttgaatctaagagttcgaggctgcagtgagctgtgatcataccactgcactccgcctgggcaacagagtaacagcctgtctcaggaagaaaaaaaagaaaagaaaagtgctttgtgggttttcttgttgttttgttgatttttcagttttcatatgtgagggctgtctctgtcaaaagcctctaaaaaactatcttttcatattaaagagagactttgttatattctcaacacagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtaacaaaatgtctgatagactctaaattatttaaatcgactccttaaggaagttgttagtgctgctatttttaaaagaaagataactattttgtcaagtcactgtgataggtccattaaacctcagttgaaactcagaagctgatgaagtaccttactactatatgtgatagtactgtaagtccatcagatggtttaactcgatccagttgtgtctggaatcatagaccaataaatagaagttgagggaaggggatccttaaaggttagctgaggtttttaaagggaagctgaacaggcaacagccctggcctcttcccacaccttgacctcaccttctcttattctctgctactttaaacagagcagttctacttttatattcttaatatattgagttccatatagaattttattaggaaaatgattctactctcttaaatatataaatttaagaatcagtgatccctcatctattagactgaatgaacagtcttacattacttttgtttaagataaggtcagtagcagaattggaattactaaaacaatttccctcccttaaaattgggaattgatatcaataatattacatttataaaatttttttagtttttttgaattatagttaaagttgcaaaagatttgccattttaacccatttgtaagtgtacagttctgtggcattaattaaattcatattgttatgcagccatctccaggactgttttcatcttgcaaagctgaaactatgtccattaaacaataactcgtcattcctacttcccctcaacctctacttacccctagccaccattctactttgtgtctctgtgattttgactattttaagtacctcacagaagtggaacaatacagtatttttccttttgtgactggcatatttcactcagtataatgtcttcaagattcattcatgtcatagcatgtatcagaatttcctgccttattaaggctgaataatattacattgtaagtatatgccacattttgtttatccatatatccatccctggatatgtggattgcttctgccttttggttactgtgaagaatgctgctgttaacacagatgtacaaatatctgttcaagtccctgcttttagttcttttgggtatatatctagaagcagaattgctggatcatatgataattgtacttttaattttttgaggaacctccattgtgtttttcatggtagctacactattttacattcttaccagcagtgcacaagagttccaatttctccatatccttgccaacacttgttttgtttttttttgatgatagccatcttaatgggtatgtgaagtggtatctcattgtggttttgatttgcattttcctaatgattagtgatgatgagtgtcttttcacgtgcttattggccacttgtatattttctttggagaaatgtttgttcaagtcctgtgcctatttttaaattgggttgttggtttttttgtttgaattttaggagttattaatattctggatactaacccccttatcagatacatgatttgcaaatattttcttccattctgtgagttgccttttcattctgttgataatatttgatgcataaaagtgtttaattttgatgtttaatctattttttcttttattgcctatgcttttggtgacaatattagctttttaaagtacagtgctttcagtgtgtttaaatttggagtgggagggcatttgtaattttatttttgtggcattacaatcatttcttactatataatctgtttagtgcctcagtttgtggagcaagggctaccacatgatttggattttatttggatcctgagtttcatagatcaagtagtgagtttagatacttactgagggatttaaatgaaagtgtatccaaatttatttagttggcaaaattgggataatgtttaatgtatttgctaaatatatttaacatttttctactactgaacttataagctcaaaaatcaacatgtataataccttatactgagttattgagcttaaaaacaaatagatgtcttaaactctaggacctgttatttcttaatattctggtttcaatttccatttctgcattataaaacaattttattttacctatctcaaaatgacttctaagcaactctgttaataacctaccagacttaatcatttggccagggtatgtttggtgaaattgcatctgtcatttgattatgtctttgtttttgttttgacaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggtgaggaaacttaccattcaggaaagagattgtcacatagtagatctttatgacagattaagggaggtgcacaggtttcagtataaaaattctcttgaaccttttctgacattttgaatcaaggcttagtttttcatttatcatttagtttccttaaactccagttttctgaacctctgtcatactgaatttttatgctcttggcacattcaggtggattcatttaataagcttaatctagcaaatgtcagtatttctagttataatacgagctgtttaagtcgcagattgaccaggtagctcacttagttaatttctaattgcctcattacagaactaagtattttctgaatgcataactgttagataccacatgtgaccaaagtaataaatcatattacatttagcaatatgagatgcattttttttcttagtaaagacacatgggtcagactgcttacttccacatctggttttgaagttggaaaatataaattgtatatgggaacagtgcagtacccccatcagatttcatatggcttatgcaagtgttaaggaacttcaagatatcaaggggaaaacatacttttgccctgttgtcctcagcatagcttgatggctgtataaaaaaccatgtttcttaagcatttacaagtctttatgcagattgttttatctttcttcataatgaagtatatagtttaagacttaagctttttgagaagtttgcattcattcattgaaataaaatgaccccaatctctacaaaaaatcaagaaaattagccaggtgtggtgggccactcctgtagtcccagcgactcaggaggctgaggtaggaggatcgcttgagcctggaagatcagggctgtagtgagctatgatcatgcagttgcactccagcctaggtaacaaagcaagaccctatctcaaaataaataaatggtaggctcaaagtatcctcccttcccacaaattaaatatggaattattctgagatgcctattaccttttaaaagaaaatatgcctattgatggtgaataataaggatggttaagtggtttctttattttgtcctcattatatttgattcatactcttctcatattcgtcatattccttattttcctagaaactattaagctgcatacatttaaggttttatggttagtgtgtgtgtgtgtgtgtgtgtgtgtgtgtgtgtgtgttatttttaaccatatccaaactctttctttcaggggatctgaaacttgtggaaaagccgtctcctttgactcttgctcctcatgacttcgcaaatattaaagctaacgtcaaagtagcatcaacagaaaatggaataatttttggtaatataggtaaggtgctgttttatggcatgtaatgtttgaatacttttactgaagaatttctatagtgagtagctggggacattgtatgaggagaggatctaaatccatttattcataatttatgagatactctctatggtaccacgcattgaactatgttctggatgtacagaaatgaaccagatagagtcactgtcctctagaaactgtcaggcaaaaggaggagctagctaaggcaatatataattgtagtccagtgtgttacaggatggtttatataccatatgctttgaggttagggaaaaaaaaaatgctaacagtgtggaaggctttataaaggaagatggtgtgttatcaaaggataatattttacctgagtcatttgttgctaggtgcacaagggtatctcagacctagggattagcttgtatagagtcattcagtcagtaagcttattttgttgcaatttctgtcataaggatagggctaccatggtgaggaacaaatgatagattatggttgagtaagggaaaacagatatataaaataaatatgtgcagtatgtaatggtaagtactgtgaaagaaaaaaataagtaaacctgtactaagtaaggtaggaatccataaagggatttggtcagttctcagagtggtgggggattgggagaaaagcttagaaaaggcttcatggaggagcaagtgctcagtagaagactacagatagacaaggatgcagttagaataaatgcaaatgatttgatacacttggagttcagaatgggttggaggatgatggcaggaaaaaaatgaagttaggaaggtttgtggaagccatattttacttgtcatgctaaggatttcagactttatctgtggagagaggaaacattgaggaattacaaatgaatgacttatagcattatatctttttgcgacagtactatagaaggttgattggaagaggcaggaagattaactagtagagaagcccaagtgagagatggcagaggacttgagccaacacagtagtggaatggagagaaggatgaatataatgttaaggatatggttaatgattgaagaggaagtggctagagtaacactcagatttccagattaggtttattgggttgtttatgtcatcatcataacaggaaatacaggagagaagaacaaactttagagagacataataggttaaatcttgagcaggttcggtattaaagtgcctaaagatattcaaggacagtttgatgtgagtctgggacacaaacaagaggtctaaactagagataggccgggtgtggtggctcatacctgtaattccagcactttgggagaccgaggcgggcagattacctgagatcaggagttctcaagaccagcctggccaacatagcgaaatcctgtctctactaaaaatacaaaattaattgggcataatggcgcacgcctgtagtcccagctaactcgggaggctgaggcaggagaatagcttgaacccatgagacagaggttacagtgagccgagatcgcaccactgcgctccagcctagacaacagagtgagactctgtctcaaaaataaataaataagtaaaaataaactagagataagtatttgtttaaaagccataggaatagaagaaatcacccagagagggcatacagactaaaaagaggggagatttgaaaacagaatccaagcaaacagcaacactgaaagcttggtcaaaggagaaagagcctacaagggtatctgaagtgtggttagaaaagtaaggaaaaaccttcagaaagtatttgaagctccacaagataaaataactttagttattaaagtctgaaagagaggtcttttggatttggctattagtgattttaaaacatttcttgtgggacatcttgggtgttagtggtgggttgaagactaaatacgatatgaagaaatacaggtagtgtagactattctgagtgtaggatcttggctttgataggaataagaaggggcagtaccaagaagagaaggcaagaatgagtgaggatttattttttgaaaataagagaacctcgagtatatttatagaccataagggaagaaagttggtagagaatgggaaagtaaagacataaggatgaaagagatagtgattggagtggggtcctggaccaaagcaggaatcacagatggcaggaagtattaatcttgaagaaatgaggtagtacttctctgatacgtatgagagggaaggatgtgagagtgaattccgagagagagagttgtttttagatgtggagctgaaaattaaaggagcttattcttggtagcctcagttttccctgaaagttgaaagagtggaagaatgtcaagaaaagagcctagaggccgggcacagtggctcatgcctgtaatcccagcactttgggaggccaaggcgggtggatcatgaggtcaggagttcaagaccagcctggccaagatggtgaaaccacatctctactaaaaatacaaaaaattagccaggcgcggtggcaggcgcctgtggtcccagctactcaggaggctgaggaaggagaatcatttgaacccgaagggtggaggttgcagtgagctgagattgtgccactgcactccagcctgggtgacagagtgaaactccatctcaaaaaaaaaaaaaaaaagaaaagaaaagagcctagaaagaggaatgtaggctccaatcagattataactctctactgtggaagaaatggtcatagaagcaaatatagtcagccttctgtatccgtgggttccacatccatggattcaaccagccacaaactgaaaatattttagaaaaaaaaaaaaatggttgtgtctatactgaacatatatagacattttttccttgtcattatatcctaaacaatacagtataactatttacatagcatttatgttgtattaggtactgtaagtaagctagagatgatttaaaatatatgagaagatgtgtataggtaatgcaaatactatgccatttaatatcagggacttgagcatctgtagattttggtatccatagggggtcctggaagcaattccccattaatactgagggatgactaatcttgtatcattaagtagtatgggtcagcaatatttattcaaaagtattagttaagtacctcctatgggaacatcgtccacttgtatatctgctgcagtgcctagtatgctgcaactgctatgtaagtactcactgaattgaattatttgtttaaccacaaaaaacaaagtgtgcctgagttcgaatcctatccccaccacttatcagttgtgtgatctggaacaacttacttaacttctctgctttcatttcctcatatgtaagatggaaaataataatactatcagaattgatgggagtattaaaccagtaatatttataaagcatgtagaatagagctctgtacataataagtattatataaacaatcttattgttaatagtgtagttctttggatatttggatattaagattttttaaattcaagtttgccccagtgattgcgaatctttttgtatatgtaattgcagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagttagtccttgggagattttctcatattcctttatctttcttccttttgcctgctgttgaggagtctgctaataaaattaatctcgctaaaaagtgtttaacatgaaaagcaaatagtctttcagtatctgttcttgcaaattagccttaactaaaaatcatgtaagtagtttggtaatttgctgttataaattgattagagtagcagttctatagccaatctgataggtttagacattataggtaatattccatcccttctatgtatgaccaagagcttaccatttaatctagtgcccgaaaaaggctttacaaagttcatggtctgttgaggaactttgtccctttgagccttgacttttattagaaatattctatatgaggctgggcacggtagctcgtgcctgtaatcccagcactttgggaggctgaggcaggcagattgctcgtgctcaggagttctagaccagcctgagcaaaatggtgaaactccatctctacaaaaaatacaaaaattagcccggtgtggtagtcccagctactccggagactgaggtgggaggatcacttgaacatgggaggttgaggctgcagtgagctgaaatgacgcactgcactctagcctgggtgacagagtgagaccctgtctcaaaaaaaaaaagaaatattctatatgcttcatattgaatctctgtgaagttatctctattgggaagtactgataccaacctacagcttgttggattttatagatgttatttagtttcttggtgtctactctttccaacctaaacagttggaacaagtttttaatatgacatactggtgattcacagctttctcatagtaagatttatgatctccttgacttttttttcctctctacaggtgacagttaacaccaacatggttgatttaaatgactacttacagcacatattaaagtcaaccaatatgaaatgcctgactccagaaaaggtaaaatttgactaggaaattcagaaatctgatggaatggtagagtaggttcctggccttcctgtatttcctctagcacatttttgttattcaatatgcagtaccattctaggctatctaaaagatgttatcccatagaatgttggaatctgcttacctctttctattggactataccatcctactttttcctagtgcagtgacccaactgaatagtcagattaattttttttttattttcttttcaatcttctcccccattcagctagaggcacattctaaagtagtttatgctgcacatggtggttcattcctgtgatcctagcactttgagaggctgaggcgggcagatcacttgaggtcaggagtttgagaccagcctggccaatatggcgaaaccccatctctactaaaaatacaaaaattacccaggtgtggtggcacgtgcctgtaatcccagctacttgggaggttgaggcaggagaatcacctgaaccccagggggtggaggttgcagtgagccgagatcacaccactgcattccagcgtgggtgacagagtgaaactctgtctcaaaaagataaataaaatcgtttatttgtaatactggattagaaaatgtccatgagctcttccgtgggctctgattgttggttaaaatatatgtgctcaaatacagaatcgttgttatactgtgactttttgctatgtttgtgtatgtatgaaaaaaacgagaaagaaagaaaaatgaagctggagctctaaggaacttttttctttatgtaaaatttctataatgttataatattcattttataaataaaataatgtctgctaccaaacaagtaggttttaatttatatattagtttattcagcatatactgagtccaacaaaagtagtctcttccttcatggcgcttaaggtctgatatgggaggcagtcaagttaagtaaacagaatatataaatacaaatcggattaagaactatttatttaacatcagatttattgaggtataatacacagtaaaattcacactttttacatgtatagttgagttttgacaaactcataagattatgtaaccaccaccctgtatgtaagtactgttttaagtgataaataaccaatggggctgggcgtggtggctcacacctgcagtcccagcattttgggaggccgaggcgggtggatcacttgaggtcaggagttcaagaccagcctggccaacatggtgaaaccctgtctctactaaaattacaaaaattagccaggtgtggtggcgaatgcctgtaatcccagctacttgggaggctgaggcaggagaatcgcctgaacctgggaggaaggttgcagtgagccgagatcacgccactgcactccagctccaagctggacaacagagtgagactctgtctcaaaaaaaaaaaaaaaaagtcacctatgctgtttggtttttgcctctatgtaggtatctggtaaagtaatgaatttatcacaaattttttccaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccaggtaacagttcctttttttttgagagtatctctggactgacaaaggggggaggaatttatgactttattatttctatatgtagtatctttttagcattagatgcatatacacatacaataataatatactctgaatagaagtataacttttctcattaaaatttctcaccttttgggcccctcattctgggatatttgcctaaaaccagattgattcctatggggtgtttgtgaaatgggttctctagaattttttgaaagccaaggtgtaaatctagtgactaattagctgggtgttgtagcgcacacccggtaatcccagctactcgggaggctgaggcaggagaattgcttgaacccgggaggtggaggttgcagtgagctgagattgtgccatttcactccaacctgggtgacagaatgagacttcgtctcaaaaaaaaaaaaaaaaaaaaaaaaatctggtgacggcttgaaaaatctagcactgaaaggtaattaccagtaaagtttggtaagtctgtttggtatgtccttgattttattgttgataatggtgtcattgaattgaattggggcttaataatatggaataacctactgattgtacatagtttaaataattataaatatcttaatttttctttacagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaagaaaaaaaaagcctagattacagggcatttgagattccagaacactgagatcttagaacaaagccagggcttatcaaatgggaaagatatactggaagtgcagagaagggatgtcgattcaagggtagagatttgcaatgagagcgaaggagctggtgcaactttggattagatcatcatttcccaaactctgttctacggaacattagcttccttagatgtcattagatattctgagtgaaaaagtaattccatagtcaagtaagttggggaaaagcttcaaactgtcctgcactggagattcacaatgtacattagcataccagagattctgagaggaaagcagattagtttggtttaacccagtatatcctaaccttactttaccagggaatcctttttccatgacctattgacaatatatgggacaggaaaagtgacttagcctgttaatgatattagtgttgtaatcacagttaaccagtatcacatttcatatctgaaggaattatgcctgtgtacatcctagaatatatctcggttgatactcttagaaagttgcctgcctgacatattcaggccatttttgttggaatcagattgcctcacattgccattttcttaaattcataaataaggagaacaaa

SEQ ID NO: 15001 - DNA, 15133 bp, Human
  misc_feature (1)...(15133): n = A,T,C or G
gtggcgggagcctgtaacctgggaggcggagattgcagtgagccgagaattgcgccactgcactccagccttggcaacagagtaagactccgtcttaaataaataaataaataaataaaccagtgtcgggcagttctttatagcagtatgaactgcctgacactgggttatttatttacagcagtatgaaaacggacttattaatacagtattcttgaatgggtgtgtgtttgtgtgtggtattttttgactcctctgagggcctcagcaaacagcctctctgaaaacaggcaggtacagaaatttgcagacaatttcaggtggtcctagaaccacaaattaagatcccctaccccaaattaagagccctattttaaacagtgtatctttctagaatattttctatgattcaatttacccaaagctttctatgagcaacttcacggttgtgtattggatacttcaacaagggctcagaatttgaaatcattttaggttttaaaaaagttgcaaaaacagacgacaaagtatgcctgaggaaaaagaaaaaaaagttgcaaaatatcatagtatggctttaccctggaagaagaaaacaaagttgcaaaaataggatagtgcttccctagattcttcatctaatagaatctccaaaagttcacatcttacatagtataattattaaaactattgatacaatactactaatatgaattaataggccttattcaaatttcgtcagttgtcccattcatgtcctttttatttttcttttttgagacggagtctcagtcttgacccccaagctggagtgcagtggtgcgatctcagctgtctgcaacctccgcctcccgggttcaagcgattctcctgcctcagcctccgagtagctgggattacaagtgtgcaccaccatgcccggctaatttttgtatttttagtaaagacggggtttcgccatgttggccaggctggtctcgaactcctgacctcaggtgatctgcccgcctcggcctcccaaagtgctgggattacaggagtgaaccaccgcacccggccccatgtcctttttctataccaggagccaattccggatttcacattacattcctgctctgtcacccaggctggcctccaagtcctgggctgagcgatcctcccgcctcagcctcctgcgtagctgggactacaggcgcgcgccaccactcctggctgccgcttctttaaaatggtgaaaccccgtctctactaaaaatagaaaaaattagccgggtctgctggnnnnnnnnnnnnnnnnnnnntgggcaagaagagcgaaactccgtcaaaaaaatatatatatatattttaatctatgccctgtacttgagggatttgtgctctcgggcaaattaccgaacgtctctgagtcacttttccgtctaatagacgtgatgcgatgaagaaccaataaaaaacacactttgaatggcttcggaaacttcgaagggaagtgaatacatttttcttttctttctttctttttttttgagacagtctcgctctgtcgcccaggctggggtgcagtggcgcgatctcggcccacttcaacttctgcctcctgggtttaagcgattctcctgcctcagcctcccgagtagcttggattacaggcgtcggccaccaggcccggctaatttctgtatttttagtagagacgggttttcaacgtgttggccaggctggtcttgaactcatgaccttaagtgatccgcccgcctcggcctcctaaagtgctggcattacaggcgtgagccaccgcgcccggcctgtgaatacatttttcttattgcttgacgctgggtcatacaattcacttttttgttgtgcagattaaaaccaaaacaaagcaattaggagagcgttgttgtcgaggtgttttgttccaaggtaggacccgtagcttctcccctgcccctcagctgggagtagcggcttctgattggacaatgcgcgtccgccacgacgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcaggtaactgcattggggtccaccgggaagcggcagcagctgcggactacgggagggagtggggttggcgagcttgggtaaaactgccccttcttcgctctgtctcgacccccaagttctccgcgtcttcctcgtcccctttcctcctctggccccacctcccccgggcccttccagccttcccccaaaagctccacacacccctctgcttcccgtccgggggccccgcctcctctgctcgcgtctccagggggcccgccctcgtctcctccccgcagcggtccctcctttaggagcgcaactccttccctcccctccgccgctgctgtgtcccccgcttggcccattcctgggccttaagtttggttttgttccttcttggcacctccacctgtctctccatgatccctgtctcctttgcatctgactgctggagtcctccgattctcccgttgacccaggctgcgagtttagcaaattgtgcagcggcattgtgctgggctttggggatagaggtagtgactagaggtccctacgttcaagaactccttgcccggtgggagagagtcactttgtaaatggagtatgataggcccggtgataagtctttaaggcagccgcattcctgctgaattctcaagcaggcctctgggggctaagctgcatcttttcatcagaatgcccttggctacttctgatgcagaagcctggtcctttatatttttagtttttatttttttttgaaacagagtctcgctctgtctcccaggctggagtgcagtggcgtgatcttggctcactgcaacctccgcctcctggattcaagagattctcgtgcctcagcctcctgagtagctgggaaaacagacacccgccaccacacctggctaatttttgtttgtttgtttgtttgcttttactagtagagacaagagtttcgccatgttagccaggctggtctcgaatacctggtctcaagtgatcctccctcctcggcctccctaagtgctgggattacctgcgcgagcccggccatcatagtcctttaaacccttgggagttattaaaatctttgtatgggcccttcttttaaactgtcagaataggtagcgtttcagagaccatccatccaagccctcagggtgttgtctgggaagttgaaggctggtgacagagagtgattgcctagacaaatagtgactcagcattgtactcttgatgcctctttttggggtttttcctgaggatacttaaacaatttttcaattaggcagcagtcttagctggtgggaaaactaaaagcacagataaaaccactagtcagtagattcctccaagccagtgcaggtggcttgtacacttaactcagactagagtaatttatacctcaggctcttggagtcaggaatccctggggtctggtcccagctccgtcattcgctgttaagcttggtgaagactcttcctttatctgagcttcagttttaccttctgttaaagagtgtgataagccctaacacacagggtaacggtagggatttgttaagattttggttatgaaaataatcactttagtgtcctggaaattgtaggatctcagcacaggcgagccccctatgcttcagattcatgtctgtctggctcaaatcagcaaagaacctgatatgctttctttttccagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggtactgagaaaccctgggctctgggaacaggcttaaaaaatgtacattaaatacatattaattaaatacatattaataaattaattctcctgatcacttttaactctggtcccactttcagaggtaacctagtcttttcattatgtgtgcttctagccttttagtgcacaatacaaatgtatgtgcatagcagcatggtaatgaacacagactggcctggatttgaatcctgcatctcgtattaacagtttgatatctcataaatcacaagtatgagtatatgggtagtgcaaattcctaaaaatggcatatttacacttgtacattttaatattgtcaaattgctgtcagttgagttgaggtggcagtagtttatagtttaatcagcaatctgtgtttctccgtacacttgacctcctactgtgttatgaaactccttgatctttgctattgtagtaattcattgtaggtttatttccgcccccaccaccttttttttgttttgttttgtttttttgttttttaagacaagttctcaccttgttgctcaggctggagtgccttggtgccataatggctcactgcagcctcaacttcctgagctcaaatgatccttctgcctcagcttccatgaggttcctctcttaaaaagctgggaccacgtgtagctgggaccacaggcgcttgccaccgtgcccagctaatttatttctttattttttgtagagatggggtctcactttgttgcccaggctggcctcacactgctggcctcaagcgatcatctgcctcagcgtcccataggcatgaaccaatgcactgggcccatatttatttttaagagggaacctaaacttcttttcataattttaagagagatttttatatcctttgctcatttaaaaaattaggtgttttttttcttcttggggagctataaaggaaattaatctgtgatatgagtggtaaatatttctttcagtttgttgttgtcttttgactttatattcttttgttcttttcctggatgaaaaattttatttttatgtacttaaaagtattttatagtttcttaattttgcattttacttaaaaggcgtttcttcaccctactttataaagggcctcactttgctgtataaaaaggttctcctggctgagcacagtggctcacgcctgtaatcctagcactttgggaggttgaggcgggtggactgcctgagctcaggagttcgagaccagcctgggcaacacagtgaaatcccgtctctactaaaatacaaaaagttagccaggtgtgggggcatgcggctgtaggcccaactactcgggaggctgaggaaggagaattgcttgaaccccggaggcagaggttgcagtgagccaagatcatgccactgtactccagcctgggcaacagagtgagactctgtctccaaaaaaaaaaaaagattctcctatacttttcattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtatttggtgaggctagaccctcttcaattaacttttgctttattttttccaaaggaaatttaggagccggacacatatgtgtgttcatgtattttcattgggaatgcattaaatatatagattaatttagggatcattggcacttttgtgatgttgagtatgtctgttcaggaacatggtattgcttttccatttattcaagtctttcaagtattttttgggagcattttaaagttgtcttcatatagatttgtatattttttttctgtgaaaccaatagactccaaagctttagtggcttatggcaacaaaggtttatttctcattcacgttacatgcagcctgtaggtcaatggcagccctgcttatgtttcgtatgttctttcatctaggagctaggctgaaagaataacagcctcagtttggctgtgtccctctatttaggacacaccgttttcatggcgaagcatagagagcaagagaggagctgttggaaacatggaatggctcatacacggcatactttttgttttgctcagacatggcatacttcatatttgctcacaatcccattggccagcaagtcgcatagtcaagcccagcctcaatgggctggggatatatgtactcatcccacaggaggtaccacaagtcacatagcaaggtgcaaggacatataagtccttcggcagcacagggcttgacgggttaagggtagctggaataacagaacaggttgtattacaatcttgttataaaaaaattgttataaaaaattcagaggccaggtgcggtggctcatgcccatcatcccatagcactttgggaggccgaggcgggcggatcacctgaggtcaggagttggagaccatcctggccaacatggtgaaaccctgtctctactaaaaatacaaatattagctgggcatggtggcgcatgcctgtagtcccagctgctcgggaagctgaggcagggggattgcttgaacctgggaggtggaggttgcagtgagccgagatcgcgccattgcaccccagcctgggccacagagcaagactcaatctcaaaaaaaaaaaaaaaaattcagataatatagaagtacagaaagaaaaaagtaaaagatctctctcaccagttgcttagatcctactacctggagacaaccactgttaacagcttacatatcctgcaagctcttattctataaacacacaagtgtatatacaaacatgtatgcatatctatgtacataaattatgtatatacatacaggtcttttttaatagaaactagaggattgtaccgtgatattctaaattttgcttttgtaataacctcatatatttggaatatctttaatggcaggaaacacagagctgctttactctaagagttgctttattttcctttgagtaggtagatgataattttttaaactcatctcctaatgttgggcattagcttggcccttgttgcagggtacatcattgtgtataggccactctgccctgtggcagagtacacagagtccctatgataattgtgcagtagatggagcaagcttcaggcagatgtgaactcctacctacagatgtcagctggtccataattccctgcccattctccttggtcacatccgtgttcaccctactcaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaaggtaattagcagtactcaggcttttcttagagtctgctgtggctgctagagctgggtgagtgattcaagaggtggaggatgcttgatttgacctccaagaagttgtgcagtgcaggagaaatcatagagccctgtcaaaactcaaacccacccagctttggatctcagttctgctactagtgactgtgggagagtctcttcccttctgaatctggtgtttcaatggttaaatgatgtatcctccccgtgcagggctgtgttgttaatatgcccatcacagtgtctggcccattgaaagtgctcagtaaattttagtttcccttcttttattgaggttttatcttgggccagaaataaccctcttagggtggtggtattatccccttcttacagataatggaagcaatgcttagagggcattagaggcttgttcagggcaatgcaactggtaaattctagtaggcgctagggttctaacccaaatactcctgtttcttccatgatgttgctatttcatctgaagcctattcatgagaatttattctaaggaggcattataataagcaaacagatactctggaagatatttggaagtaggcacctgatggcctttttttttttttttttaatagagacagggtctatgttgcccaggctggtctcggaactcctgaggtcaagggaccctcccaccatagcctcccaaagtgctaggattacaggcgtgagccgtggtgcccggcccgtgatggcctcttatcctatcagtattaaaagggattcactgtttctctggatgccctctgagtgtggacgaatgtctgtgagtgcctgagatcatttagttatggcccaaagctaaaataccacacaggatcagggagcagataagaggattaagctgggaatcattcaccttgaccaggaggctgattttaggacattacacttagccaaagacttcaataggtcagaagaagccactctggtagactgagttgaagtggagggctgcaagatgggaggaaaattggcaataagtaaaatagtgaactcagaatgttgctggttatgataaagtaacaacgtgttctgatctagtgtgatctcccactccctgttccctaatctatgcaacattaggcagagttaggttttatgagaggagcgaggatgtcttgctgcaccggggcaggggtaagatgctttcgtagcttaagctgtctcttgggcattgtgcctgctgctcacagctgcttcctgatactgaggtgagaggccagaatgaggcaacatcatatcatcacatggatcagtcttgtgagaggctgttcccgtcctgctgatttatctgcaatagaacagaattggaaactgtctggcagaattagggaagtgattaagcaaagtgacacattatatataatttcataaaaatatttggaaacatgaggaaatacttataatcgtgctaagtctcgaaagcaggttatggcttaattggtacacccacagctgctgctataaaagcaaaactattttagtatgactggtaataaaaataatttttagagtccatatgactctgtgtgtgtgtgtgtgtttggggatggtgtggggcaggggttatgagagttttttctaaaattctgtaatgtcttgttatctttcaaaaaaaaagtagataaaatattgtcaagactgacaaaaagaaataagctcatgaagtgagattatatgatgctgcctatttggattgagaggaaatgtgatattgtagttaaaaacatgggtttttaaaatctagtttgagtactggtcttatgcttactgggtgaacttgttcaaataatgtcaagttttggaacctcatttataaagtggggctattaaaagtcccttcccgatggagttatggaattcagtgagatataatgcatgtaaagtacttagcatggtgccttatatattatcagcatgtagtacatgttaactgttttatttctttttatttttttggagacagggtatcaccctgtctcccaggctggagtgcactggtgtgatcttggctaactgcaacctctgcctcccaggttcaagtgattcttgttgtgcctcagcctccagtgtagctgggaccacaggtgcacaccaccatgccctgctaacttttttttttttttttttttttaaggagagatgaggctttgccatgttggccaggctggtcttgaactcctgacctcaagtgatccgctcgtctcagcctcccaaagtgctaggattacaggcgtgagccaccgcgcccggcccatattaactgttatcacgagtgttcagttttcatatttatgctcacttgctggtccgcctgcagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataatatttcatcatttggatatataataatttatttaaccagtctctttatttttatttatttattttgtttgttttctttgagatggagtctcgctctgtcacccaggctggagtacaatagcgtgatctcggctcactgcaacctccacctcctgggttcaagcagttctcctgcctcagcctcctgagtagctgggactacaggcacatgccatcacgcctggctaatttttgtatttttactagagacggggtttcaccatgttggccagactggtctcaagctcctgacctcaggtaatctgcccgcctcggcctcctaaagtgccgggattacaggcgtgagcacgctgcacggcctaaccaatctctttatattggttatttagattctcagtgttttgctgaacacttaatgcctttgtgttttgggctatattttgaattattctcatagatttctagaagaggaattactgggcaaatagggacacttaaaaatagcttttacaaaccatcttctgttctcattgaaaatgagaatatattatgcacttacagggaacttgactttgcttttcaagaacagaagttctaaaatacagtagggctgggtgtggtggttcatgcctgtaattccagcactttgggaggctgaggcagacatagtgaggcctcatctctacaaaaaatagaaaaaattagctgggcacggtgttgtacctctagtcccagctacttgggaggcttagtcaggaggatctcttgagcctgggaggtcaaggctgcagtgaaccatgattgcactccaacctgggcgacagagaccctgtctcaaaaaaaaaaaaaaaaaaaaaaattaaaaaaaagagtagacatgtaatggtaatggagaaatcctagacttttttttttggagatggtgtctcactctgttgcccaggctggagtacagtggcacaatctcaggttactgcaacctccgcctcctggattcaaacgattctcctgcctcagcctcctgagtagctgggattacaggtgcctgccaccatgcctggctaatttttgtatttttagtagagatggggtttcaccatgttagccaggctggtctcgaactcctgacctcaggtgatcacctgcctcggcctcccaaagtgctgggattacaggcatgagccatcgcatcgggccgagaatgttagatctcttaactttggtgtcgtggaagcagcatgggctttagagtcaggcagatctgggttcaaatcctgtctggcagtctagtggtgtagcttctttctggtaagaaacctacctttcctgatgctcagtttcctcatctgtaaaatgggaacaaaaataacctgttttgtggagttgttctgtgacggtggttctcatgtgtggtagctggggcagcaccagcagcagtggcggcctcagcatcacctgggaacttgtcagaaatgcaaattctcgggcttcaccctagacctcctgaatcaggaattctgggaatgactaggcaaactattttcatgagccctgtaggtgattctgaagcttgttcaagtttgagagtcactgacctatggattaaggtgagtgagtgcacctgtgacagaacaagtgctcactgctcttggtttccttattaaaagagggagggagttgaaatggggtagctctcagattgcctctctcctgttttattttgtgattctcccttttagccatggaattgggggaaggaaagaggaaccatttgtctatcacaaactgtcccagagtcttccagatttcacgtttggaatgaaagtctcaggaaggcacggactttgttttcttcctcatgtatggcatagagcagcggtccccaacccctgggccacagatcagtatcgttctgtggcctgttaggaaccaggctgcacagcaggaagtgagcggcgggccagcaagctaagcttcatctgtttttacagccgcttcccattgcttccgttactgcctgagccccacctcctgttagatcagcggtggcattagattctcataggagtgcgaaccctattgtgaactgcccacgcgagggatgtaggttgtccgctgcttatgagaatccagcacctgccgatctgtcactgttccccgtcaccctcagatgggaccgtctagttgtaggaaaacaagctcagggctcccactgattctacattttggtgagttgtataattgttatgtattgcaatgtaataataatagaaataaagtgtacgataaatgcaatgcgcttgaatcatcctgaaactccccccacccaaccccagtctgtggaaaaattgttttccaggaaaccgttccctggtgccaaaaaggttggggaccactggcatagagtaagggcttggtctctaggcacagcctgatactacctttggaagcaagatgctgaatccctccatgcctcagtttcctcatctgtgaaatgctgatagtaacatgagtcaattaatataaagtacctggaacacacagaagtgtttttattggtctagtgcccacactgtgcttggcacttggcaaaagatgaataaacatttaagaatgaacacattgactcattgaatggcacatcttttcaaagtaggaagtagtaactgttcaaaggtgtagaaaccaagacttagcagagttaagtgacatttcaacttatacagctagtgggcagggcaggattaaaatcaggtttgtgaagttccaacatttgtactattttcctgatgtcatattcttgatggagaaagcaaactgatcaagtgacaataaaatagaaa

SEQ ID NO: 15002 - DNA, 12707 bp, Human
  misc_feature (1)...(12707): n = A,T,C or G
caatataaaggcaaagttattgaaggcaaagtgtccacaccaacccagattaacacatagataggaggtctcaaaggtgtgcatggtcagttgggggcagcaacacttcttcaactgggttctgtcctctggcctttttcccatgagatgatctcaatggactgaccttgactcaggcagacccctactaagcacccaaaagggaggccagggccctgggcagtctctccagcatgcctctcagcctgtgcaagaccatctaggcttctcagtgtgggtccaccttttgcccgtttcattagatattttttcacacttgtatatttaatatttctctctcgtctatattcttatcctcagtttaaaatatacttgaaacactgccatcctaaattggctgcctctcaatcctgctgtttccctggctatttccttaaatgtctcctttccttcccagaaaacttcctgaaagaaaagctggcacttgctgctttcagttcagactggccattctctcacaccagatttctagtttctgtgcccaccccaccctcagtcccactgacgttgctctactagggttgctaaagactccaggtcatcaaatccaagagttacttttcgatcttcttctgtttggctgttcacctttgttttggtgaaagaaagaatgcatgtctacacagagcatttacaggggagcagcgtcatgtgaattctaataatggaagatttctccaaggagaaatcaactcttgggcacagaatcagggataagaagttcaacctcacctatccacttgccagctggacactaggacttgacctaattaagggagttgacagtttttttggtgttttgttttgtctttacaagcagatgttatcaccccattataccaagaaggaaattgaggctcagaaaaaacttgtagattgccccaagttacacagtgggttatggtcagagctccctccatcacatagtgataatagctatgacttaataactactgtatatcaggcatgtgctaagagctttacaaggcaatacctcatataatcctctcctaaagtacagactagtttatacaccttattacaactccacttgaatgtgtaatggacatctcaaaggtgacacattcagaaatgaaatcaggatcttttccccaaaacctgctctacctacagcttttgctatctcaattgatggtgacttcatcctactaatcgctcagtacaaaaaaaaaaaaaaaaattgcagtcctccttgactcctctctttcacacctcatatacaatttctcaggaaaccctattgaaactaccttcaaaatatatccataatcttcccacttctcagaacttctactgctaccagcctggtcccagccaccatcatctctcacttagattacctagtggcctcccagcaggtctccctgcttttccctctctcgcctccctctcctcacctcccctcaccctccagtctcttctcaaagcagcaggagaaatccagctaagttctccttctcgcccattgcagcctcgagcttctgggctcaaacgatccttccgcctcggtctcccgaagtgctgagattacaggcgtgagccaccgcgcctggccttaaaatcctttttaaaggcactttgacatccattatctcatttaagtctaaaacacgaatttcgacctccgcgctgctttctggttccacctggcggcagctgcacaaagtgtttctcttcgaacgccgtcccaagtttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtgagtggtcagagaaagttaacattcttttcttcctcccacttctcatttatctcactcccctaactcattaattctttaattcctggtgtcctaccgtcctttcctcccatccccaatgacctcttaatactatatactgcatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtattacaggaatgtaggtgacaggaggtagagcaggaaatgaagctagcagagggcagagccctaagaagtattaaataattacaaatgtaaagtgctgtgaagggaattacctggatccctgagaagacaaaatgaaagtctaacctcatttgaagctctttggggaagctcctgagcatttcagctaacactgaataggaattaaaaatcactctggaatgagtgagttgagagataggaaataaagttgacaggacatggtgtgatcagaagtgagggattagaagaaaatatcagggatgacttctacatctttggttaagtgtgaaagaagaaagggaaggtaggggttgactaaaggtctggagtgcaaaagagatgtgggcaagtatgtcaggttaggaattatgtcattggaatatagaaggtaattgaacccataaaattggatgagatcacctaaagcaggggttggcaaactttctataaaggtccagacggtaaatattttaggctttgtgtgcagtctctatcacaactacttaattctgcctttgtagcaagaaagcagccataaaaaaattggcgtgtaaactttattcacaaaaaacatttctagatcagggcctggcctagaaaaggaacattgaataaaaagacaagagaacagagacaaaaccctaaaaacctaaaaagtcaggaagaagtagccaacaagattagaaaggtaggaagaaaactagaaggaaagttttaagatgggaagtaagtggtcaagtctgttcaacgctgatgagaggtcaaataagataaaggatatatgtgcatttggtttagggacatagtttcagtgaagggagcagaaaccatagtgagttggaattagataaacactggtagttatagacaacactgtggtttctggtggagagggaaacttttaaatcctggggtaggaggttccaatagattagaagagaatggaaaactcaacgtagtggtcttaggtcaagaaacaaatgtagtgggaataaataaataaataaataaataaataaataaataaataaaaaaaagaaatacagcctgggcaccatggctcacacttgtaatcccagcactttgggaggctgaggcaggcagatcacttgaggtcagtagttcaagaccagcctggccaacatggtgaaaccccgtctctagtaaaaatacaaaaattagctgggcgtggtgatgcgcacctgtagtctcagctactcgggaagctgaggcaggagaatcacttgaaccctggaggcagaggttgcagtgagccgagattgcaccactgcactctagcctgggcgacagcaagatttcgtctcagaaaaaaaaaaaagaaaaaaagaaatatggaagtaaaggtatcagaactagaacaaaagtttgtggtaaaagactgacttctaaggttcgcagatagatttctggatgatgataaggttaagactgaccatgggaccagatggctaaagggaggtacagatgaagctcctgacgtctcagtgtctgaaacttggccactatattagcagtctatgtaaccattaaaatattccaggtagctctgcagattaaattacagggagaaagtgtagaggctgaaaaaaaaggccgtagagtgaaggtctggaataggctagtagtggagagtaacaggcaaaaggagaccttgtaaaggaagaataaaccctatttggtgatgattagagggagaagttggcgatcacaccacagtttcagttccctggagaattctggtcccatcgatgcaccggactaaacttggagctaatgagttcagttaggtgttcattgacattgaagagatcatcaaaagcatttcaaaagtagtcagaggttgttgggagccctaggattatataacacatggacgattctctctttcacaggaactgtcgacaaacactcagtggaggtcaccaattgcttttcagtgccgcacaatgagtcagaagatgaagtgagtgggaatccaagctgtccctctgcagtttttagctgttcatttgctcggctcccctcacggtccctcccacactcataactagagctcctgtagccaaggagcttcttcccatttgtacgtacttcctgggcctcttctgtttattgggggtggcctcttgtcctttttaaccaatttttctttggacttctggcttcttagcttgctttcctgccttccctcttaggtggctgttgacatggaatttgctaagaatatgtatgaactgcataaaaaagtttctccaaatgagctcatcctgggctggtaagttggggaggtgggggctggggttaatggaaggtctcttcgtgattgccggtgtcttttgctactggactggatcttatactcttccttttggaggcaagagtattgcaagtgtattactgactgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggcatgatgacacacacctatagtcctagctattcaggaggctgaggctagaggatcacttgaggccaggaatttgaagttgcagtgagctatgatcatgccttgccactgcattccagcctgagtgacagagtgcgaccctgtctctaaaaaacaaaaggaaagtgtgttacctgtaggaactgtgaattcagtgggttttgctggtggttctgatcctgtggggccaggatatttcgaattaccttgtaagtgacttggaatttttcatcagcactaagtcagcctttgattttatttgacatagttttcggtgtgtgtattgctcttggcagttggtgtcactaggtgtcctaccgtagaagtgtccggtaccctgaagacacccatgccactgttgtgtttgatattgacgccacatatagacaggagtccaccactgtgttccatttcacaggtacgctacgggccatgacatcacagagcactctgtgctgatccacgagtactacagccgagaggcccccaaccccatccacctcactgtggacacaagtctccagaacggccgcatgagcatcaaagcctacgtcaggtgaccacagtcttgggctacaagggcataaaaccatgcccagatgccatccctcccccaccccaagcaaggttaattccttccatgtgtaacttgctgtgtccttaggaagcctgttcctctctctcaacagttattctaaaggtttcactctgaaacaaaatctgttcctgtaatttctaccgctgatcctagttgtactccagtttctactcattgcccttttaagtatttgagcaagctgtcaagtcatcttttgtaggacctaactattccatagttcctacagccaatcatcacatggtattcttgtcatgatccttcaccacattcattacttttctgaattacccattagtttgtcattatctctagaactcagcacagcgctcagggtaatacagattataaggatgactgtccttattttgaacacatttattaacccaggattgagtgcagttttaatgacaatgacattacagtgaacacgttgagcttgcaggtggttaaaatgccagttatgggggatgttgggaaaggccctggtggcatgctgaggaagcagctgtggtagttggaaagaccatggtcaaagggaaggcagctgttagtgcatctgtcaggctgttgattttgtgctggttctgtgtctgacactgacatagccagttaactcttacacagtacacagtaagacaaagatggtggatgccaagtctttatgagccagttggcataccactaagcactagccattgcctgacttcttaaccttcccaggtatttcagactcctcaagatccagtatatatatatataggatccagtatatacaatatatatatataagatccaactatatatatgtatatatatgtagatagagaaagatatatatagttgacatagtaaagtatagatccaggtatataattgacatagtaaaaagaatacctttagtgagatgacttatagcacccaatgtaatttggtgggcaggagttggtttcctttttcaatgctgatgaagggcgtagtccccgaaaagatttgtctctgtctcctttccatggtaggcagctgtctagacagccagctctacggggtaattgagtcctgtcctctcgtcactgacactgcaccgtgtgtgaagtaatcctctaaagggaccaggccaaatgcaaaggccccccttacagatcaagggtttggtatgtgggaaaagctaaggggagaaagtaacttttgctcccatgagacctctggggttcatttggtcccaccctttctatcagaaccttgagagccatattcctgctgtatctgctttctcagcccagaatagacatggaaaccctctcccaaggccatctgtttactttggcttctccttccgcagcactttaatgggagtccctgggaggaccatgggagtgatgttcacgcctctgacagtgaaatacgcgtactacgacactgaacgcatcggaggtgagtaacctttccatacactcgcgagaggccataggcattttcagggaagggggctgctagtctgcaacatggacggaggccttgggtggtttgaaaagggactattgatctaaggtttgtgaagactagaagtcacagtcatctcttgtataaatgggatttaaggagttatttgagaaactggtaaaggtgggaaatgatcagcaccagaggccacataccattcacatgagatcaaaaccggtgatgagcataccaggtaaaaggagttgagcctctattaggaggaagaaaagctgataagggcacagcaggaagtgtgactgagcagactgagtctaaggggagttgggaaacagagttagtaggacgttaagaccatctctttcctggtgggatgactgaattctctctcttactgcccaccactgccgctgccaccctgccaaccaacttccatagttgacctgatcatgaagacctgctttagccccaacagagtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcatgtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttccctcatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggccttgtaggctagagtacttgcctgtgtaacttcagacatccatttcctctggtatcctggagttccacctcgccactgtgtgtcttagaaataagtcattattcaagaactcaggaaattatacgttggagtgaaaaggtgagtgaaggcaatggggaatcaaaaaggcctggatcctagttctgaggtatgtgtagccttaggaaagataaattataagagtcataagatatggatcataaacatacatagtccattagggtattatgaggattccatgaattaataaatgtcaggttaatcaacacttgtggagaatatcacctagcatgtagtaagcacagataagtggtagatactatgatgcctaaaggtgaatagtttgaaagtaataagcaacatgaaccccagcctggaactcagttctgagatatgtacctcaggaaatataagttatgggagtcataaagtgtggatagtaatgatagataatttcttacaggtagggaaatgtaaacagatcttatcggcaaaatgataatgacaggccaaattgttaaaggtaggttaaaagtagacagcatggtgggaaggttaatcagagtcaaaatgtttcagtgttcttacatttttgggagtagccagttaatatcaacttagtctttttaagtatgcatgataaaattccgaggttaattgctagaagtatatataatctctaaatgaatagtgatgagagatggtgggataatagggaagaaacaaaattttaaatttgagaaataagcatagaaaaggtggataaaacaaaagatggcaaaacaagtccaaatagatcagtaattacaataaatgtataagtattaaactagcccaaggaaaaattgaatattaaaacaaaccccaatcatatgctgtttacaggagacacatctaaaacaaggacataaagttgtcctgcagctgtgagtaacaatataggtgaatgttaataataatgttgaatgaaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactgaattagagagta

SEQ ID NO: 15003 - DNA, 9622 bp, Human
tactctgtaaacactcacggaggcccccttgaggatcagatggggccaggtcctgtctcatggaaccctggtagaggtggtagagttgggcaccaacagggacatgcattgtcattctgctgtgatacccgtgtactgagttacatgctcagcatcctcgaatcctgacaacagccttcaggaagggcttgacatctccattttacaggagtaaactgaggtgggggacgctgaggggagcatagaggaggctacctcccccagactggggcatcagagaaggcttcccagaggaggtggcattggagttgggcattgcaggatgagtaggagcctgctgggtagaatagaggtgggtggcaggggttgctgggggtgccccctgctgagtgctctggccagtgcccaggcagcatgcagagctccaagtggccctgcccacttcgccccaccagctcgccgtgggcggttctgacggcagctccaggaagggaggcaggcgagtgcctcccatttatggccatttctgttccagaaccgattagtagagaattgcagctgtaatctgtgcccgtgatggtgggccataaagagggatgggatgtgcacagcgctcccaaggtggcgcccgcagacatggcccggggacgccgggaatgaaaaatggttttaattccctcccagcagcaataatttgattcttcataaatttttccatcaaagtgttgttgagctgagttcccacagagcaggacacgtgacagggtgggggagtgtcgggaggagcggtcagcagacacagcagaggaggggccgtgctgcccagccctcctgctagtgctgaccagggcccggagaccacctctcccggccctcgtttgtctgcagagatgatgggagatgggagatggaatcacgttgtcatgtggaagctggattaggcccagcctgggagttgcctccagcatttactacccatgcgaccctgagcaagcaactctgcctcttagcacctcaatttcctcatctctaaaatggggttaatgttcattcttttcttgcagggttgttgcaaggattaaatgcgtctctgcatataagatgcttagagcagggctggcactctatacgtgctcagtgaatatctgttcgtgatggagatgcgtaagctgagacggagggatgggaaggtgttagccaagccaaaggacagagaaagatgggtcgaaagatggctgccatgatagtgctctggagaaactgcaggctgttctttggggctgcagcctggggaagcagagggtagaaagggaagaggcgggatcatgaagggccttgagtgccagcctcaggagctcggatggtctcctaagggcactagggagccatggaagagtctggagcagggaagcagcttgatccgatttgtattttagaaagatccccctggctcctgtgtgtgtgacggttcctgtgtgggctggggtttgaaggattgaaggggccaggagcccagagaggggaccaggcagttgctcgggcaggagaggaggggcccaggctgggcagtgggttgggcagggctgggaattgcttggatgtgttggtgagggaggatcagaggagaggcagaccagggagctgaggtagaaaggatcctttccagccaggggctgacctggcccccaaggaaagtttgagtggaccctccacactgccctcttgtggccaccgtgtctctgagctggaagggccctgagctgccacgcccgggacaggtgactctaggcaggatgccagcacccaccccagggccactgggggcctgtaggcagaagaatagggctgcagggcccttctgctgtctgacctggtgcccaaggagggcctctccctcccacctgggcctgagggtcagggtggcaagagggagaggccctcggcaggagtggcctctgggagggacttctgagcaccgccaacacgcccgctttgtgcatccgcaggctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccggtgaggcctggcctgagctgggggcaggcctcagggacgggggttgctggggtgtcctggaggggagtcccggctggagaagccacctcctgcttccaggacctgagctgcacacagatggtacatgcatatccagatgcacacgcgcactgacgtgtccacctgtgtgcacatgatacgaacatgcatccccccaggcacactacccctgagacctacgcatccatacatataaacatatgtgtgatcacatgtgtgcacacaagcacataaaatgcatgcaggaatacccctaccctgagtatggatacatgtacatgtatgtggagatatgtgttcacatacccgggaattcaaaagccacacccaggtccacacacacaagtgtacacacttaagcatacatacacatacacacatgacacagcacacttgtgcactaaacaccggtccacatggctgcacatatatgtttgtccacatgctcacatgtactgtggattgtgcttgtgtgcacacacacacctcttgttctctggcccaccccccttaccctctctgccttgatggccccccaccaacccgcagcccagctccacaggggtcttcaccagcacccagtccacaggctggggatgcctgagaggcagggagatgatgtgccttccccttctcagccccctggagccttcagcagtgagaagcaaacagcctcgagccagcctctgtttcccagccgaagggagggggctgggccctctgtgctggagggaaagaccccatttcccagggtgaaggaccctccctcctctgctctagcccccaaaaggacgaggccaatttgaaggcctcctggcagacagggcaagcccagccaggagtgagccttaaggagggaaagcccaggaggtggctttggtccttgttcttcctgggaacagtggggaaggactggagcaggaggcatggagaggaggtgtcccggtctgccaggccccatgggtaacctggagccctccggcaacaggatctgccacatgggaagggttttccatggccagggcctgcgtggaggcagtgagcccaccaccatctgtccctacccatccctgggcagggcactgctgcagccagctccatggcttccagctgcctggactcctgaggaagagcagaggctggccagccccagcagagggggtctcagtgggaggagatcacccgcctcatactccaagaacaggattgaagaaaggagaccagcctggggggcagcgggaggcccagtggtggctggggaggcttggccatccatctggggctgctggcatttctgagacccaaacctggggcggggaagtgccatgtgtgcatggtgggtgtggctgtagcactgggagaatgcacatgcttccgcacgctgtgtgtgtctgtccagatgcatgcatgcctgtacgttcctgcccgtgagcatgggcccatgtgtgtgaatacgcctgtgagttgcacgcgtgagggcctttgtgagcccacgtgtatgtggcagcaggtgagtgtgcatcttacgagtgtgtgcgtgcatacgctgtggtcagaagcactcttgtgtgaatatctgtggtgtgtgtctttgcttgcacactttcgtgtatgtccacacagccatgtgcacaaccgtgcgtgcacctgtctgcctgttccccgagtgggcctgccttcctgaaagtgtgtgcagccacatgtacgtgtgtgcatgcctgtgctgtggttgtccgaggcgcacctgtgtgagttcctgtgcaggtgtgccctgcggcccaggatgagggagtgaggcgtgtgtgccggggaagggactcgcagggtacagcaggcaggagaccagggcccagatgaggtagggcctgtgggccacgggagggaaggagatcttatcctgggccactggggagccacggcaggtgtcaacagaggggacaggctcccatcgggcagcaggttgccgaaggggacaaggctgaggcctgggctgcccccgccccttcatcacaggccgggttgtgtcccccacagtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtccaagccttgccgaaaggtgaggggcggccggggggcggggctcaggctgatgcccgcacacccactgcctttctggagaccaccccctgctcctgctgggggtagggacatccctccatcctccatctctccgcacatcccatcatacccctaaacccaccatctccccgttgctgcccctggagggcctgacctgttcccctctctctgagccaggtccgagagacactggcagctgagacgggcctcagtgtgcgcgtggtccaggtctggtttcagaaccaaagagcaaaggtaagaggccaccccccatccccactggccccgggtagggtgggactagagggggcagccagaagactacggtccagggggcgtggggctggctgtgcctgggggcgaggggcagcaccggcctgaactgcgctctccctgcagatgaagaagctggcgcggcggcaccagcagcagcaggagcagcagaactcccagcggctgggccagggtgagccggggccggggcagggcctgggccagggtgagctggggccggggccaggggtgggcctaggccagggtgagctggggcagaggctggggctgggtgagcctgggccagggctgggaccggggctgcacctgtcccagggctagggacaaaggggcccgggatgtttcttttaacaaaacttctcaaaagccttccaccaaggccatcagatcccagggaacttctgctttaaaaccactgagacagagaaatagagaagccatggggactaggggacccagggaggagagatggcagagtggctgcctggagggttggcagaatttctgcaatcagaacagcaacagtctactcacactcactgcgtgcagacacgggtctcagccttcagcacaccccatctcaccctgtcctcataaatcactgcaagggggggtattgccatgtcccatttcacagatgaggaaactgagggactgcctgggatccctcagccagtaaggcaaagctggacctcagccccaagcctggagctcaagcctgtacctttaacaggatgacactaccccactgccggaattctgcagacaaagcttgtcagggcgtgaagggcctggggagtcgggagggactagctgcaggggcatgagtcaggccccctcatcactgggctttaccaaaaatcgtgtttccacatcagaatcttgagccagggctggtctcctgggccttcaaagccatgagggaggagcagggagctccctgggactgctgaagcaggcgggggacagagctgcctgcgccctggtgagagggaggcttctgggcaggtgccagggcaccaatgggcagataccagggcactgggggccaggccagtgtcccaggctggacttggcttctaatgacacagccttagtgcctgctgcttcctcgcttccccctctgcccctcctggggctgcagtcactgcctctggtctcccagccatgtcctgggctatgtctcacccctcagtgttcctagctgcttcctggacacagcctccctgagaaggtcccacagtccccccagctcatcccaacccatgccgtatgctccatcctgcccacacgcacatggcatgccctgctcctccccacccttctctgcaaatggcaccaccatccgccctgtccgagccaggaaccaggagtcacctctgaccttccccatcccacactgctgatccactgaggtgccaagttggggagtgaagtcttctcatgtctctcgcaccctcctaggagctgtctctcccacagccaccttgacagagaccccacccttcctctggcttcctcacccactggccccagcctcggtctcctcctccagcctttctcaccctcgtctaccaaaccctccagcggctcccagcggcctcggggacccccacccagctcggcaccccagggctccccatgacctgtggtccctctcagctggtctcccccacaccgacctctctccctgcctcttggccccacgtgctgcaccctcacttacccggcggtctgtctcctccatgcctttgccgcccctcagcctggcttgcctcccctgctctggcctgttgagcccctgctagttctttaagtcacatcagggcgggggccctttcctccaggaagtcttcccggggcctttttggcctgggtctgggaccttggtgctcccagatgcagcgcagaatcactattgcctgtgtggggtctgccgcctccctggatcccctggaggggcggggtggtgggaggaaagaagatgaggaggggaggactctggcttttggtaagctgagcctggaggaggagctggagtgtgcacctggggaaggggctggggagtcagtgtctggacagcttcagccagagtggggtgcctggggagtcccaaggagatcagaaggggaggctgctggggtgtagctgggagggcgtggaccaggccagggggtgaaggctcactgtgcccccagaggtcctgtccagccgcatggagggcatgatggcttcctacacgccgctggccccaccacagcagcagatcgtggccatggaacagagcccctacggcagcagcgaccccttccagcagggcctcacgccgccccaaatgccaggtgaccacatgaacccctatggtaagccgccctacccccacccgcccgccccagcacagcccctgccccctgccaggccaggcaggcctggggccaggacagccacctgctgccctagggctcaggcagcatggccagcacagccctcctgcccctgctgacaggaagggccccagtccttcttggccggcactagtcagcaggccatcctgtctctccctggcctccagtcacacagcctacagggcaaacagggggcccccaggagccccagcctgtaccccggtcctgacaccccttctgccccccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggc

SEQ ID NO: 15004 - DNA, 60276 bp, Human
  misc_feature (1)...(60276): n = A,T,C or G
aagggccagggcagggttgaaggtccccctggccgatggaggggtccaggcagaatggggctcattcagaagctggccagtcctccctcaccttggtctctgcctctgggcaaccactcaccctgctgttggtggcaggacggtgggggtggggggcggggtgctgctggcagtttgggcccctgttttcttctcaggagcgctgtgacctcactgtccctcatgtcactggtgcatgtgagttaggaagggtctgtcccctaggctggaaccatttctgcggcaaggagtaaaggtcccagcagcctgtgaccctgggactgtgacctcagttcagctcaggctggagctaaagcagagggtttgagccagagcttcagacactggattctagctccgctctgccactcacatgctgtgtggccttgggaaagatacaccgtcattctgtgcagcaggtttctgcccataccattgagataacaatcacaggtacttcatacagggtagtcgtgaaggtgaaaacagaatgcttgctctttccagggcgaccctaccaatgagaaaacaggctgcagtggggagtgaccgccccaaggacacacaactgctgcaagggtgtcattgtgtaggtgttcctcacttgcctcctgctagtgtgggaggcccagagactccacgagacccccagctgctcctgtgagagggctgaggggggccagctgtgataccgcctcccatctagaaggggcctcaagccacccatgtacacccagccccacgtggctcaccaggggcccctttgccatcaagggccacatcccaggtttaagtgtcagagaactaaggggcttaagagagaatcgagctgtggctttgtttgtgaattggtttgatccttttttccttctagaaggactcacagctactgttgcttgccatgggcttgagggggtggtgggggctgactggcagaggggctgagagtggatggtgattaaaaggagcactgactccagggtagcggctgggcaaggcttggggctcccacctcccccaggttcagagccggctgaggaccgggagtcctcccttctggggtcagtgctcactatggagcaactgccttggatggggtcccaggacttgctcttttactggggctgtggttgcagtgatcagggctttggagccggcagaccaagctgggaaactcctgaggtagagaagctgttgaaggcgggcctggggtcacaactcccagctgctttttacaagcaagagacttctctctgaacctcaaccttccctcctgtctagtgggttcgcagccagacagtcttttactcactgcttactgggtgccctctggagtctgggcaggtgccaggctctgagaagacaggccagcaatcagccctggcctaagggatgaaagccgggccttcccgcgccggctcacctcggttttctcatccttactcggctaccagaggctatggttggggagggagggggctctgggggctgcagaaggcccaggctgccggcaccggatagaagtgagcacgaagctccctgcgccagtggaacttttatcccggctcccaccgcgaagcgtttaaattgcttccccagggccaggaggcaagtctctcgaaggacggctgcggccaccctccgcccctgagttacatgggtcgcagccactgccgccctccttggcgcctccagcccgcgggccagggccaggaaccgcgagccgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccggtaaggagccctcggcccctctcgctgcccactccctagccgagagcacccgcttcccgggcccagcggaggaggcgtagaagacgcccgccccggggcccgcggaggcagagggcggaccccgatcgccactcgccggggactgggaccgaggcaggagggaaggggctcccgatgctcaaacgcctggcaccggattccaggtttctggagcgtgggggacgcggcgggggcgcgagtccccgggtccgaagagcggctcgggttatttgttccctgcgcagccgggtcctttctggactccttgtcggatccggcttcctctgtgtcgtgaagcccccacatggagacctggggagtccggagcgtgtgggggggctcccgattctctctccctctctcggactcgccgtctgtctccacctctatttctctgcgtaaaaccaggagtccagcccctctggggcttggacgtatcgctttccccgcagcctcagtttaccctggacagatgggcatggtggccctggctcccttccctgcagggggcggcagccacctggccctccccggtggggctggcggcctcgcggcggggtttcctgctggcctgggctgggctctgtgggaggggcagtgccaggaatattttctattcgggctgctgttgcctttggcccctgggcggctgcgccctccagggaggcagggtcattgtgaaagagaggaaactcctctcccaggcggccagggctgttcctgaggagggctggcctggcctcagtattcttctctgagaagtggagagtccactcccgagcagccgagtcaggctgcaggtctcagggcaggaacagacctgttctctccccaggggtagatcaagacctaggggacttgggctttgatcctcccgctcccagcaagcacaaacccagtgatggggagagctggtgaggccttggctcagcctccagattcccaagcttccttttcattttcttttctttctaaaaatttatcagagatgtggactcgtcatgttgcccaggctggcctcgagctcctgggctcaagcgaccctcctccctcgggcctcctaaactgctaggattacaggctcgagccacccaaagtgcctggcccccaagcttcagtctgttagagctggctggggctgagggctcaggaaacatttgcagatactgtgcggctgctaagggctctgtagactgttgggtgctgggcctgggtccaattgcacaataactgtgcctggggttaggttctgatgagagggagggagaagcagccacacggactgggaagcttggctaggagcaggaactggaggagtctccattccaaactccctctccctcccagaccccttaggcccaaggcctagggcggggaagtttgggggtgggggcgggaccctgtcctggcggggccatctgtgcaccatgctgagaagtaattctggttctgctctgtgggggtggatcaagtgaatgaatagtgactcctgcctgctgagcgcctggccggtgcgggggcagacacgtcgtgagagggaaggggaggccccactctcagcacagtctccattcctgagtgcttgggaagcaggcccagggccgcaggagccttggggtggagccaggcccaaaacagcctgctgcacaagcgcttccccctcccaacccgggcccatctcatctttggcctgctgggaggccagccaggtcaaccagatgcctcatctgagcactgactacacagtccctgaagtcagtggcttgcctgtgggcaccaggcacccatgtggaaagaggtaacttcgctggaattcagagtctaaggctctgatttctgatgtagctttgggcaaagttgatcttccagggcgtggctccctccccagacttggggtcgaccaggcacccataggcactttgatatgagtggaacgaatgaatgaatgtgcccttcgtccatcaccaaagacaaaccgagctcagctgagttagaatgtcagcgaggggttgcaggggaatcttccacggggcagtaggcctgagctatagcacacaggctctccagagaaatagtgggcaggttggccatgactcactggggggctggttttctggaaggtgtgtagagtgaaggggagatctgaggtctcctaggagccagggagtggaaggcctagtgcagggaagagcaagtggcctgcagtcaggctgggtttgaagccgctagcttgtgacctcggctggccgcttagcctctgcctcctcctttgtaaataggtggtaatggcagtctccaccttgagaggatgcacctgtgactgtgaacatagtagccgctcttgttgtcattccagctctgacgttttcaagtagcacgagttttccttagtgtcaagtgagcgcccaggctggcctgtttgctggaagctggacagatggctgtggctggggccacagagaatgccatcccaatgaaagccaggtggctctggtaccttgacgcgaggccaccttccctcctcccaggtgtctcttccggggaaggagggctggagggcagtgggcatttgccagggagctggagaaacctgccgtggccctttctgggggatgtggtgggggtggagctgggactaggggaggctgaattcagccaggatctgcctgccaggcgcagctcccaggaagaaagcccaatgtctgggagggtcagaacccagagggctgtcaggttgtacagatgaggaaattgaggcttagcaagccaggaacttggctgaggtcagccatagcagcggtgcacagagcttagtgggcacatacatgcttggtgcccagctctgggctccttcccccagcatctcacccaatccttacagtcgccctgtggggagcaggctgtttgcacccctattttgcagctgagcagttatgctagagagctgaagccactcaaacccatgtctggtggacttgacctctgtcctgtgcctggagtgagcgctcactggattgcagctgtggttccttctctccctgtcacttcctcccccgacatcaaaccctcagtttcatttagtttttgcctcgggctgcaaatgcagcttagggacctgcggaggctgagggaggggggtgccccacccgctgctgggagggcaggagcaacgctgctgtctgattgcatcattttcccaagcccatctgcccagctcatttctctgcatgcatacactggccccaacacccacacacgtgtgcatgcacacaggcacacatgtgcaagcccaaacacatcacacacatgcatgcacacacattgtgtactctcaggtacgcacccctgggtgcacacaggtgtgtgcgcgcgcacacacacacacacacacacactgtctcaggtacacacgccaggtccatgcattgcttcacactgcccagccccagaggctgaaggcctcagagcccacacctgcccagctacaacctggcaggcaggaggggctcactggtttcttttggtttatttaagacagagtttcactctgtcacccaggctggagtgtggtggcacgatcttggctcactgcaacctttacctcccaggttcaagcgattctcgtgcctcagcctcccaagtagctgggactacaggtgtgtgccgccacactcagctaatttttgtatttttagtagagacggggttttgccacgttggccaggctggtctggaactcctgacctcaagtgatccacccacctcggccgtccaaagtgctgggattacaggcatgaaccactgtgctcggccatgagagcatgtgtaggactccacagcttcagggcaccccagccctctttttgcggtgaggagctgacctccagagagtggaactagtagcattgttctaagtgcctgccacaggcatctgggagatggtccctgtttccatggagctcgtagtgggggagagggcagttagaatacagcatgatggccggatgtagtggcccatgcctggaatcccagcactttgagaggctgaggcaggcagatcgcttgagtccaggagttcgagtccagcctgggcaatgtagtgaaaccccatctctacaaaaaatacaaaaattaggcaggtgtggtggcatgtgcctgtagtcccagctacttgggggtggtggcactgagctgggatgggaggatcccttgagcccaagaggtggaggctgtggtgagctgagattgcatcactgcactccagcctaggtgacagaatgagaccctgtctgaaaaaaaaaaaaaaaaaaaaaggatacagctctgatgggcaggaggcatggcgggtcactgaggcgatgcaggtgatccagctgtttctgtggagctgcccctccgtgtttctgtggagctgcctctcttggctccaggtgcctctgggaggaggcaggagcaggggtgactctcagagctgggtgaatcttgggccagcatcatcagatcacacttgcccaggacttcccttccttgagtctccagtggtggtcttgtacctatgagcagggggttaaggagccgagctgatctgagttggagtcctggctctgctgcctaccagtcaaacgagatgcagggcaagttcctcagcccaagcctcagttttcctgactctaaaatgaagagaaccccagatggaagggcttagcctaagacggacatgtctattcccttgattgtggtgttgatgtcacgggcgcatccgcacgccgaaacttgctaaattggacacaaaaaaatatgcgattatttttgtagttgatgaatgtgctgattgggtattctcgtgtgtgtgtgaggtgccaccctcaaactttgttatgatgttggcacattacccatctgatatttaaaaaatgcaatttatgatatgtcaagtagacctcaatagagctgttttaaaacatacaacagaatttcccgcaacccaaccacaccacccgcgccatcacacgcaaacaggggtaggcttccacacatttcctgaatgccttctggagcagggggcaggaggcaggaggcaggacaggtggctctggggctcctggacctcctctgctcagtgaggctgctcacaggagattgggcggctggaaagtaaggtttagggcctctgggatggcccaggctacctgcaggcagctgagtagctctgcttttgcagagtggttcactgcactgtgaaaacagattccagacgccgggaactcacgcctccaatcccaggtactgcccaccttaagtcctccctgcctgccttcctccctccttccctccatcctgcatggccaattgcctggctgcagttgccatggataccacctgctggctccagggttagggctggctgagtcaccagcaactcaggggcagggggttgaatgcccagtagggacgttgtgggcaccgaccagaaccatcttctctgccccagctgcatggtccatgaggtgtttccccttctaagtccaaagggcagcacaggcctgtgagccccggctgactggcaggtgggaccgtgcagcatgcacgggactgaattctcatgtgacggagctccaaagtccacctggctacacggccaggctctgcagcagaggacgggaggcctgggaaaggcacttcctctccccgagcttccaggcacacagagagtgctcaggatagcgatgcctgcatcactgcaatggtgatggccgggtgacccttctgggctccacttccccagtagtgtctaataaagaccctgggtgactctgaccttgtgacgttggtcagactccagtggaaacgttcccaggcagaacaaacatgccctgtacatttgggaaatgcgggatgctggggccaggtgtccacggaggctggaaccaggaggcctgggcccacatctgcccctgctgcttgttgatccgatgaccctgggcaggtgacctcgtctccctaaccctggtttcctgttcagcaaattggacacagtgaagacgcccaagcccagggccacaggaggcatgtgggggaggggggtgcagggcgagcccaagggcagcccaggattcagggagagccctcggggaagaagcatggctgcaaagatcaggagacaggaggccttggcgccttcgggaggcttcattgtgacggagggtggggcaggatgggagaccgcaggcacttcccggctgcagagggcctggctgcagagagccctcgtgcccatctgtccccccgggaagggccgctggttgcagaggtcttaggcctctgcctgtctatcgccttccctccctgggcctcagtttctctacctccacactgggggaagttggtctctgagcccctccaaactgggcattggcagagttgaattcagaggcgctcacatttggagacacgatgtctaaaattccagccagtgaaggttccatggggttgcaggtaggagagggactggggctgggcccctgccccacagcatccttctccacctgcaggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgaggtcagggtccccgggggtggcaggcactgaaggtgaacatcctgttcccgaccttcagtggcagcttgcccaggagacaaggctgtccaaggccaaggtcggggctgggctgtctgcaggggctggcggggggcactggctgtctcagggtcactcaggttgttcctcgactcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcagcctgtctgctcaccgtcactcattcaaacctggcctcttctctcgaagcctgtcttgaactggaactaggaaaatagcttctcgttgtactgcctcactttctccatctgcaaattggccatccttgagatgccttccagagccaggtgatggaggcgcggggagggcacagaagtgaacttggcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactcaactcaaaccaacttacgcaaaaaggaaagggaaaagacaattcttggctcacacaactgagaagtccaggggtaggatggcttcaggcagggctggatccaggtgcttctaagatctatctccaactctacttggcttcattcttggcctctccacagggcaggcaaggctcatggtcaccctcatagcccacctttcccaaaaaggagggcttacccccagtagggcccatggggacccaccacgcattagtccctatggctgcatcatggggtgcgaggcttgggccatgagcctactccttcagtgggcgggatttcttcctctccatccctgtggaatggggtccacccaggaaagaaggttctgtttccagaggaagtgagcctgggtctctggacagacaaaacttagctcttgccaaaagtggcttgtttgccggcatattggcatgtctaactgcgcccaatgcccttgtcattcaggttggggaaagtgaggcccaggggaagaaatactttgctcacagtcacctggtgggtgagagcacagctttgaggggctgcaaagagcccagggtgtatccatctcactgtaggtagcacagcggggcaatcagagctggagctgagcgtatagacccctgggctaccacctgggggatttaaaagctgaatgtgattcagataagcacctgcagctgggctttggcaagattccagggtctggtgagccgaatgaagggagtgagggctgaggccaggatctgggcagcaggccagagtccaggcagcaggaaacatggcagtgtctagacaggggctgtcagaccccgaggtcagggcactggccacagggacggagctggaagttcctgagcacgggcttctctgcctcccgcctctcagctgcctcaggatggccaaggcatggcctttgactagggaggagagctggaggctaggaaggccctgacaagctaatctttgcactggctgagaaagagttttctggaaaagacagatgagtttcaggagaaccctagaccttccagcaatgacagcagatggttgtctcccagcagcctgtgtggccagggccaggctcagccaatgctccaacccatggaagccaccagccatcaccacgctacaatccagctcccaatctcacctcctggaagaatctcacctctccaggccttgggctttgtcctttttccttcttactgtgacttggccatggaatggaagctgtctctgtagcagggggtgggaggctgctgcatgcggatggtgtgaactcagggctccccccaggggctgacggagcctctccgcttctgcttctcaggccaacattggccagaaggaagacttcgaggaagccaggaagaaggcactgaagcttggggccaaaaaggtaccaggcgggaggcagggatttgggctgggagtggggcggtgatgtggagggcagtggtggatgctcctgccccagggatcccatcccttccagtgtgtcttcttgcttctaagagtatgagatcatcctgctctcaggtgtgtgaaccctcttgtttttctgcctcccccacgccctcttccacccacccaccttcccatccaggtggagtgtctcttccccacccacataccttcccttctcttttatctctctgtccatctatgcacccactcaccctcttttatctctgtttatctactcgtccacatatccatccatcattcatccctccattagctatccatcgatccatccatccatccattcagccatccatccatccatcacccacccatccattcacccatcatccatccatccatccatccatcacccacccatccattcacccatcatccatccatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatccattcacccatccatcccttcattatccatccatccatccacatatccatctgtcattaatccctccactgtctatccatccattcatccagacagccagccattcatctatccatcccccatccatccatccatgcttcatccattcaccgtttttctatccatccattcatccatccatccatctgtcatccatcatccatccttctgtccatcatccccctacctgtccttccctcttttatctctctgtctacccattcttccattcattcaacagaatcagagaactccaattgagtctggtgccttgattgtgaatctaggcatgtggcaggcagacccctgtcccatacagggcatttatgatgaacagtgtcatcaggacccctgctcacatgtgctcactccccatggagaagcccttgccacttgtgccccttcatttgggagagtgagcaggggacatagcagggatgatgtgcaaggccaccagcccacctgcagggtcagagctgatcccctctgtggggtgcttctgcagggttgccagggtaattagcatgttaaaatgaacacgggagggagtggatgccccagtcccaagtcacctactggccacaggcctggaactagaatgtccctccttggttctgtgcctcccgagtgctggagagcagaggggttgtctgagcagtagtccaggaaggggagaaagagccctgagtgttgaagattcgagtgcgctttcagcagcgcaggagcaggctttgtgcacggcttcagcttttgtcctttattctagatgagcagttctcaaaccttgtggtcttgggaatcctctacactctaatttacgtggcgtttttaatgtttattttcttgcatataacattaggatgggccaggcacagtggctcacgcctgtaatcccagcactttggcaggctgaggcaggcagatcacctgaggtcaggagttcaagaccagcctggccaacatggtgaaaccctgtctctactaaaaatacaaaaattagctgggcgcgatggtgggtgcctgtaatcccagatgctcgggaggctgaggcaggagagtcgcttgaacccaggaggcggaggttgcagtaagctgaaatcacaccattgcactccatcctgggcaacaacagcaaaactctgtaaaaaaaaccaaccaaccaaccaaacaaacacaaaaacacatttatcctaatgttttttatatatccttagtcccaattgctttcttttctatgcctttttatttcattttttaaaaggatttttttcaaaataattatagacacaggaagttgcaaaagcagtaccaagaatttctcgactcttaaaaattattgaaggccttggctgggtgcggtggctcacgcttgtaatcctagcactttgggaggctgaagtgggcagatctcttgaggtcaggagtttgagaccagcctggccaaccagcctagtttctttagtagagaaaccccacatgcctgtagtcccagccactcgggaggctgaggcaggagaatcacttgaacccggaaggcagaggttacagtgagccaagattgcacctctgcactccagtctggatgacagagagtccatctcaaaaaaaaaaaaattactgaaggccttagagagcttttgtggattacatctgttgatatttatcacattagaaataaaagctgaaatgttttaaatgaacagttcatgttaacataagtaacattacacttatgaaaaataactattttctcaaacaaaaaattttagttaagaatcttattggcttccatttttgcaaatctctgtaatgtctggcttgacagaaaacagatggactcttgtagcagttttctgcattcacttgttttttcgtttgtttgtttgtttttcttttttagcctcccagggcttcctcgctatgtgatgccttgttttattgaagtttatgaagaaaactgggcaacacagtgagatcccatctctacaaaaaataaaaaacttagccgggcgtggtagcacatgcccgtagtcccagctactcaagaggctgaggtgggaggattgcttgaacccaggaggctgaggctgcagtgagctaggatcacaccactgcactccagtctggatgacagagaaagaccctgtctcaaaaaaacaaaaaaaaagttttcactcagtgtctccctgaaaagtcattgggaacccctgggggtctacatttcaagaaccattcctctggatcggggtttctcagtcttggccttgttcccgtgtggctggccgtcctgtgcacgggaggattttagcagtatccccatagcctttacccactagatgccagaattccaccccccacctggtagttgtggcaaccaaaaatatctccagatacttccaaatgcctcccctactcccacccccaacagggacaaaaccgtctctggttgggaactactgctgtgagatcttaggtgacaactaagtttcatcttgttggggctgatttagaagccacatccagtttcacagaacggtgcatcaggattgattagcaggctggccgcggtggcttgtgcctgtaatcccagcactttgggaggccgaggcagctggatcacctgaggtcaggggttcaagaccaacctggccaacatggtgaaaccccgtctctaccaaaaatacaaaaattagcaagccatggtggcatgcgcctgtaatcccagctactcaagaggctgaggcaggggagttgcttgaacctgggagacggaggttgcagtgagttgagactgagccactgcactccaacctgggcaacagagcaagacttcgactcaaaaaaaaaaaaaaaaagagagctattgattagcaatgtctgccatgagtgcaggagggagagtaacagtgcagtgtgctgggattgatgaatgatgtctactacagatgcagaagaagaagcaccaggtacagcgggggtggccccgtataggtctcagctagctgaggcccctggggctctgtatgccagatggcccctgtccttgcctacttcttccttctgggctcctcttcccgtaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcacccctcgagcggtttcctggtgtgcctccggggcagacttggtgcaaggcagctacatggctttgtttagaccccaatgagaggggtaacagctcgcccctgcgctctgtgcactgtggcacctgaacgcccattctgagtcctcacctccaccttctgctgtgggagcgatgtcaccccatttggcagacttgctgctgaggcctggggacattgtccaaggtcgcattggccaaggtcactgcgtgagtcccccaggggacacgcaggaaagtgttgaaaaccctgagttggcagagtagggttcaaaggcagctctgctgctggcttgccgtgtgtcctcagccagggcccttctccccttcctgaacctcagtttcttcatttgcaagatggggctcatgccatgtcttagtttcccagggcgagggtaacaaaatgtctcaaactggtggcttagaacacagaactgttctgcctcatggttctggaggcctgaggtccatagtgagggcatgggcagggccacgcagcctctgaaggtgccaggaagcctccggctcaggcctctctccagcttccagtggcctctggtgtcccttagcgtgtggctgcgtcactcctgtccttccgtcctccatcttcccaagctgtcttcttcctgtatctctgcattgtcttccctctgcttgtctgtttaccttccccttgctacaggaacccgtcttggattagggcccttcaatgacctcatcttaacttggttactttttgtgtgtgtgtgtgggggagagggacaaagtctcactctgacgcccaggctggagtgcagtggctcgatcttggctcactgcaacctctgcctcccagattgaagcaattctcctgcctcagcctcctgagtagctgggattacaggtgtgtaccccaccacacccggctaattttttgtatttttagtagagacggggtttcgccatgttgggcaggctggtcttgaactcctgacctcaaatgatccaccagccttggcctcccaaagcactgggattacaggcgtgggccaccatgcccagccttaacttggttatttctgttaagaccacatgaggccacattcggagggactggggttaggacttgaacccattattttgtggaaacacaaatcaacccatcccgtaccccttccctccgggccgtgtgtcccagtgcagactgcggggtccccgtggggtgcaagacaggaagccccctgcctgctgctcttcggaaggcagtccttgagaaaccagattcctgacaatgttggcaactgtcagccgatgtttttataaagacccaagtcatgagctctcagtcagcggacagtatgccaagagcctggtacaggaattgactgtttaccaaccccacagtcagaaggctcggaaactccccagtgacggggagctcactacctcgcctgcccgggctggtcagggtgctgatggtgggaagtcctggctcactgtgggaggtcctggctcactgtggtgcagggacacacacagctaagatgatgatggaggagacgcggttgatttgagggtggcctgggagacagccacccaccaggatggcacctgtcatgtctttgaaagtccaagtgttcatttcttcaccggagcactggttcagcaagcttgcactgggtatctgctgggagttgggtgcttgctggcattggcacagtgctaacttcttgggctcattgcgtaccttcagagagcccatttcctggcaagagaagagaaaatggatgtgtgatgaggaatgggagtggggccaggggtctgtgccagggaactgtgggagcagcaggcaggggctgaggatgagtctagaggagtgaataatggcatggaagagtgtgagaggcagagggaacagcctgtggaaaggcttagagccaagaggccctgaaggacagtctgtctggggctgtggagcaggagctattgctgtgagggaggcaatagggccaggactgggctgaggccatgctgggaggtttggcttcatcctgagggcaactgattagtgggtggaaggaggtctcaggttggatggaggtggccagtgactaccccagcgagatgctggggaagagacaggggagagcttctcacagactgcggccttggtttttactgtcactccagctgtggatgatgggatggtaggaaaccaggcaaggaggtttgggcgggcctgagctgttgggcaggaccgtgtgtatgctgccatctgtgcaaaggtggtggcagaggaggagaacccagaggatcaggactgggcgacacagcgagactctgtcccaaacaaaaaaaaaagctcccgacccatctgccttaatggaaagagctggatcgtgagcttcctatcccagaaggcatacaagccgagggcaggggatcagaattctgggaggggtcctgccctcaggtctttccaacggtaccattaaggttcagtagggcggcattcaggtctggtggagtgcatgggtgggtgggtgagtatgggtgggtcggctctggctcaggcagttcccgggtccatgcggagacccccaccccggaccagcccacatttagcctgcaacagcctcccgcagccgtgtgcgcccctcctccatgtggccaccagagggcgccagaggcttgggtttgaggccttgggggccaacaaaggcgggaggaggtggcggcaccaccggggtcctctgttccccatcctggacctgcagggcgtggttctgaggagaacgcccccgcaagctagtgctatggccgctcgggacttgggggcgtccctgcattcacactcagaagacccaacagggacggactccggggatgccagggagtaggtgctacctggcacagccacctctttcctggggttgacaggcaaggcgtacttctgcgcctcagtgtccctttatgacagtacccaggaaacccccaacagcctctggagacaatttccgagaactgggggtgtgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacaacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttttggaagaggggcctggaaatatgattctgagactctggccggggagcgagagttttgtaaatggcaccatctgtatgggtgccccagggcagatgggagaccccaggccccccagtcccagtgggaccgtgtttacatgcatgtttacacacgtgtgcacaaatatcagcatgcggacactcgtgtgtgagacactacatcctccttctccccggaaagctgccaggagctgccctggtgctggggtcttggggttcagagggggaaggattagactggcctccttggctcttgcctgagacgagggcagagtttgaaccaaggaagcgtttgtttggcctcttcgagggtctctggctcctgaacagatgggtgtccgcatggcagcatctggatgggcagacagcagcccagccgtgcctggctggtgaggcacaagccgtctttgtgttggggaaacatgaagctgtgggggaaaatagctgggccatgcaacgtcggaccatgccttaccatctaaaatgaggctgtcttttagttgctccaggaacggggccggctgggggtcagcaggcaaatgtggccgcccccacctcagtgtcctcatccgtaagatgggactaatagaacctgcctcctggggctgctcaaaggattcagtgagttaattatgcatggagctcagctgggaagcctgagtgtgaaccgttaggatgagcgagtttgctgtgtggccctgggcaagtggctgcacctctctgagcttcactttcctcacccataaaatatggctaaaaatccccctggccctgggggcctctctgagtgacagcacatagtaggcgctcactaaaggggctgcatggagggtgagtgaggccagcccaaggcctgtgccgcacacacagctcccagctctgcagagaggctgaaccctggattctgtgccacctgacgagagtctggaaaatagcatgtaattcccaccgctgcctggctgcgcccatgcagttttcacagtaggcaaaaggtccctctgtcatttccacagcgcttaagtctccctctgggctgccgagcccacggggaagcaggagacgtgcgcggccattttctctctggggacagagctgggctggcggatgcctgcgctgaccccggcctcctcctcctcggcatcagtgtggacggtggtcccggctatgtcgggggtaacgttcacagctcagtggggtgttgaggtgtctccatttgcccacagaggatgcaggcgaggcaacctgcccgagggggtggctgtggtgctggggacctgggcttgggtcccgggcctgccctggctgtgtgtccttggactggttcctttcccttcctgggcctcagtttccctctctgtgcagagaagagctgaggagcaaaaggccctcagtggtcacctagttccacctcctccctgacaccagccattgaagagatgcggaaactgaggctcagagaggtgacagggttcccaaatgtatgggtatgggggagtccaagcaccctggtgccccagccctgaagtgagcttgatttggggcagggcagggtcagcaatgtgggggccttgaggaagagactatagtgcgagctctggggctgcaggagcagggcctggccccccaggtcttgccagtggctgggcctccagctccagggggtcagatgtgtcctgcacccacccacgtgacatgtgtgccctctcctatactctgccatgtccccagacgtgcacatctccctcctgccacatgcccacacatacacgacctacactgcatgacctcacatgtgtacacgctctgcccagctctgtctccgccacgggctgtccttgtcctcacgtcctcccccagactccagaacccccatcctgtggctcctgacagccctctgttctgcattgcaggggaacgatcaggtccggtttgagctcagctgctactcactggccccccagataaaggtaggatgtggctcctccccttagcagggagcactagcatctgcagcacctgatggggaggagggcacagggttctgggagattccacaggacaggcacagaatctcctccgtggcaggggtgcccatcgggtggacagcctgctggggaggctcccttcgctggggccagctccaggggacacactttcttccccgccattcattcttcccggagaggctgtccaggtgctggggcacgggatagaaagtccctgccactcttcagccacatccctggcatcccaggtgtgggcaggcatggctctggcaccccaggtgcgggcagggatggctctggcaccccaggtgcgggtggggatggctctgaaacgtggttgctggtgtctgggatgctcagagccctccgagccccagtcagagcccccagctatgcctggctcctccccaggccacctgtgcctggtccccagcatctcttgagcctttcctggggtgggaatcaccaggatctcagggcctcaaccgccctggcccgtggcatgtcacccaggcaggagggcacctgtgggtattgcccagactgctactaccatccccacccctccagcttgaccttggacctggcctgcgtccatgcatgaatgatggacacgttccttccttcactcgctagctcatccttcatccagtgtctactgagcacccactcagctccaggggtgccgagtgcagggcccagggcagggccgagcagtgggagtttgaggcacactgccgctgcaagctgcccaatttttctagtagccatatatataatatataaatatttttatataatatgtattacatataaatacatatgttttatatatatatatatatatatatattttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttgggctcccaaagtgctgggattacaggcgtgagccactgcacccagctgtagtagccatattaaaaaatagaaaaatgaaacaagtgacatgattttaataacatgttttaccgaaaccgatatatccaaaatgttatcattcctcctataatcaatgtaaaaaaataattattaatgtttacattcttttttcttctgtgttgagtctgcaagacccagaatgtgctgcatgcaggcatgtctcgctagctggctggatttcaggtgctctgaatggccacccgtggcttgtggccacctgtgggcagcacaggccgggactgagctcttttgaggccgctttgggctcaagctctggaagagttgccccctcctaagcccccaaggggctcacaggagtttccattttgttctttctaagaggaatctctttccccgtccctttaaccagctggtagctcttgggatgcgtggcctggaggtgagccgtaatgagctctaatgatctgttttgaccccagacaccaggcagctcagtggctgggacagtagctgcttgttgacttgctgccagcgaggccgcaggacggggccctccctcggttcccacagcagcttgtggggccagggtgtccagtttcgaggtctttgtctgcagaggccaagcccaggcactgagatgggattggggcaggggccaagctgctccaggagctgggagtaggactgtggtcttcccatggctgctctgaggggctgaggaggtggcgggccccttccattgccctgcaccactgtcagctccacggcccagcagccaaatgacatctccacccccacacacacatgcccccgagtcctgctcagaggcaggggcctggtgagctccagggctgagtcgggggctctttttaccagctcaggccgaggggctcaaggggaatgagcttggtccctcagccaggctcagagtcttcccccacttctttcccttccacacccagagaagtgggtggggggcagcctatgcctctctgggcccccgaccacacgtggggccaggccagcagcggcagctctgtggactctccctgggtcacggcagtggccctgtggctgaaggtgctggcaaggaccatgaaccccgtctagttcaaactctcaggtctcatctggggagactgaggcccagggaacagggacccccttctcaccccaacacaccaccattctgccatggagtgcaggctccgtccagccagccccggtgagggagtctgtgtccttcccctccttcatggggctccctctcaccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaaggtatggccgagtctccccaccacccccaacctttccctatagcccccttcccgggcacgtccctgctgggggctgtctgagccagtggcctaggccgggactgaccccatgtgatgggggattgaacttccaccccagctgcctacacacgtggcctctgtcccctgggctgaccccacagaggtgtggtcatctgccagcccgttgccagggcggagccgctctgaggccatttcccagtcccccgagccagaggacacagggctcactctctctcctgctccctgggaggcggagaccagagccctgcttgccacctccgcagtgtgtgtgtcttggtgtgtgtcacttggggggatggctgggggatgtgatggccggccggggggatgtgatcgggagctgttctcccaattccctggatactaattgcccctagcgctttccccgggaacaggtaggcgctccaagggacagtcgcagacaaagccttttatggcaccagccctttttgaagtacaagttgcaataaaacatattagaagttttgcatcaagatccttagccgctccccagggcacctttctttttagcgactcgatggcagcccttgacaaacagcctcaatcaatcaggccggggaaaagcaactcagcgcacacaccagaaaattgctcaggtttttaaatagcagtcgccaaggctggctgtgagctctcgctgcagccaaggtgccgcgtggtaggggaggcggcagggacgcagccctgcccccgccgccagcaacccattaagacctggagtgctgggagggaagaccttctccaccatctgttgttttattattaagaggggagtttacaagagcaagcccatatgttgccaaacaaattgtcaaatagcagagctattaagggagccgggttggtgaggtttctcccctggtctccttgatgatatagaatatgaagcgtgtttcatctttaagaataatgaattggagcccccacccagctctaccctcacgcctcgagtcctggatagagaggggcagggccgacccatacgttgccctttctttccgttaagtccccagacaaaagcagcttctggtttttctagcatagatgagtctcaggagcacactgctgtccttccttctcaggttttgaggagaaggtgctgagctcagcttccatcccaaataaccttttgagccggaaaagtttgccagggaaagatgagcatggccccctcggccacctaccctctcctggagatgggtttcatcagaaatgactgtggggaatctgagcacgttctagaaggaggcagaggcagtgtttctgcacccaggaaatgtcagaatgactgagcagtgatgaggcctcctccaaaattctgagccaggcaggatctgagatggatgacacaaaaatcaatggggctttcaaaaatctctgctttcaagatgcttcggtagccaaggcaaaaaggcgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacatgccctagtacatctggctaatttttgttttttatatatttatttatttatttttttacagacagggtctcaccatgttgcccaggctggtcttgaactcctgaactcaagtaatccaccctccttggcctccccaaagtattgggattgcaggtgtgagccaccacacccagctttggctaatttttaaatttttttttgtagagacagggtcttgctatactgcccagcctggctataattattatttttaaagccagactacaaggtgggagctagaaacaggatggtctcacgttgtctacatgttggagatcgttttgttttttctcctcaattacaatgagagtgtgaggggaggcacctcgggaccgagagaggctgggaaacacaaatctctttggtcttgggagggtcattgtcattggcccctgttgctttcctccccgccctttagcctctccttgctcctggacggaggtccgctgagaagggaggcaaaggttctttcacgccaccgcccaaaaacagaggctccacggagcctggccggctgctcttcttagcacccagctgctgagctgagtgaggagcgaggacggagcccagcaggccaccaggacatctctgctggagagtccagtcttgccttgcacagggtccgggtacccatgcctggccaagggcacagggcgagtgtgtgggctgaagagtcttcaaattctagagtagatcgtgggctgtgttttgtttttttaaatttcagttttcacgtgtaatatggtaactgttgatgagataatctacacaaactaaggctcttaggggcccttagtgattttttctttctcttcttttttttttcttttttgagatagagtctcactctgtcacccaagctggggtgcaatggcactatctcagctcactgcagcctctgcctcccaagttcaagtgatgctcctacctcagtctcccaagtagctgggactacaggcgcctgccaccatgccaggctaatttttgttatctttagtagagataaggttttaccatgttggccagactggtcttgaactcctgacctcaagtgagccactgcacctggccttgtaggctgttttaaaatgagtctcctggctttctagaaaaccccgaaaccagagcatttagcctcattttaatgttaaggtggtgatggggaaacagctgctccctgcaggaggcctctagaatctcaccatcttgggaatgagcctgagtggggtcgatcccatcaggagagagatgggagggtgacccggtgggggctgcctgtggttcccacagggatccagtggggctgaggggctgaaggggctcagaggcagagcatccagtctcgctggctctgaggggctgggtggggccccttcagtgcaccctgtgccctataagcttggggccaggagagcagtgccaggtgtccgagtgcaggaggaggctggagtgcacgagctggattccagtcgggcgtcatcaagggtggtgcgggtccccagggcgacaagcctcatcttcttcctcctcttaaggctgagtcaggtgggccttccatgcgtgacctgcagccctcttagcctgggcctcctgggcagaggtgggtgtcctcctgtaacaacagactgggccatttaggaagcgaaacagagccagagccgagtgccttggagacgggatctgctgggtgttccccttctagggtctgcagagtgatgtgtgtggctgttgcgccaggcccagggaggggtgcccccagaaggtgtgggccatgagctaaaagctctccctgcatcctacctgtcctggggtccacaggaagcactgcctgggctctggtgccaggtgccccggtccacagtgcgagcgggttcacacaagccccagctcgtagggtggtggcggggctggttggctggtgccgggagacctggctgggcatggcacctgcgtgcttgctcagtgcttcaggggtccttgagatgtagactcaaagtcttctggaaggaacctccaaggtcagcattgcagacacacggtcctgcagtttctctggggcatgtccagcaatagggtccccccagggaggtgaccgtgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacacgggattcccatcccggtcactcccaagaacccgtggagcatggatgagaacctcatgcacatcaggtaaatcccaccctccacccatccttggtcctcccgggctcattccaaaggacggccacgcgctgccccaggacgtcctggtgaccctcacaccagtggtccctgccctcggggagctgagaggcctcaggcaggacagaggtcgaagcgcccggctcatgcactgccctcattgcagttctgctgagtgttgttggggagatagatcatggggacccggcctcatcaggagtatcaaggagggcttcttagaggaggtggcattcaaggatggagaagaggcccagatgtggcacaggggaagagtgtttaaggcagaggcagaggcccccccaaccacgtgcagagccccggggcagtccccagaagacaggtaaaggccccagctctttcttacaacctgcagctccacgggtgactatggtgggcccagaatgtttcaggcaggttggcagcagatgctctggcagagagtaaaaggcagaccaggctcatgggcacaatggggtgtgtgtgttgggggatggggacatgccatgtccctccccagctgaccctgtctttcctttcccctccgcagctacgaggctggaatcctggagaaccccaaggtaatcccccaaaccccgtctcctcccagctggccacctttggtggtagcagctccatgccgatgctgtctgatgtatttgtagcctaatttgaaatttcacgggggccagccgtggggctggggccgagccctgcctgtgttccccgacccccgcactggcccccctctgcccaccatctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggcggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctggtttggaggcgggaaaagtgtgctttttgaggggatgcagctgggcctgggggaatcaagaagaccagctggaggggagggtgcccggggaggtttggtgaaattggggagcgccagagccccgcccaggatcccccagggcccgggcgtctgtcactctcacgcccgcgtgccgccccctggtcggtgttggctgtaatatcacatggcagccaccatgtctggggagcgggccgggggtggcattgtcctggctcagttcctaggacactggctgggagcatcctcactttatggttgaggaaactgaggcccgggcaccggctgctcagggcgagggaacgggccctggggctggtgccctccagctctgtggctcccctactgcccacggcccctccctgtccaaacctgtcactcaggagagctgccacccttgccccctgggggctgatggcccctgtgtgtggctgctgcctgctggtcacaggtttttctagttcatgctctgctgaccccacaacactcaggccagccaccctaattagccagtcagtcagctccaagggaggcagggaggccgagcctgcagagtggcttccaggcagggcatcctctcaggcccgtgggccccaagcatgctgggcaaccactcccggccattctccaagcagcctatggcctctgcaagcagcctatgggggcagagaggaggcccccccagaatagaggacctcaggattgagaaagcagagcaaggccagagggaaatcaccccctcggaccgtgcaggagggcatccggggcctggagcaggttactgagctacggtgggcaggtcctgcgccctcccaggcctcctgtctcatgagggcattgggtggagaagtcagtactaaagagaatctggattaaggatcctgctacctcacccacacttgggtcccagagacaggaaacccgagtctaaatcccaacttttcttcttattgctgtgcaacctcgagcaagttacccaacctctctgagcctccagtactccttgcccaaagtgggaaaacacagcacctccctcctagggcatctaaagcgcttggcctgtctcagggcaagccctcagtcatgcagctgggggtcccatgctacctcttcatgggaggaagggtccaaggtcctctcagggacccctctcaagaaaggctgggctgggctaagctgggtgtgagtcaggggaaacatcgttcctgctgagaggcccggggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggatgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctctacatcatggtttagttcatgggccatttgcttccaatttctccttctcggggcctgtttcatgctttctttcgccctctccccctagcccccaccccgactctctctctctctttttcttcactctcttccctcccccgcacccccccccccacagatgacattggaagtgagccctcccgctgggagggataaatagatggcattgatacttggcaacaaactatttgtcattagaactgggcttttaggaaggagagtaaaaagaaggcaggcgctcgagccaccgcggaatgcaaagcaaatgtcattttatttctatttagttattttatttaatcggcgctgtcaggtgcctgcccgacagctgcctctgacttccgctgcggtctgcagaaactcgtcctccagtcttcccatcccctctccttccaaatgcacacactgtcagcctccacttcggtctggggctccctcaggaagtgtggcgggagagaaagtgacaagcaacgcattgaaaacagttgacagtcgggcccagcgcaggtggaggtgggagagagctgggcttgggtgggagtggggccctcgtaccggcaccctggttggaggcttgggggagtcccaggcagctggagatggggctgtggagttgtgtggtcaccccaagatccagtccagttcactttacctttttgctgaggatgagccttgggacccgtctgtgcccagggaatgctgcagttggcagggtgggccagccctgatgcctgcctgtggctgtgatgctggctggctctggccacaggcctcaccctgtttctcagcccaggttactacagcagctgggaaccagcataaggtggcggaaagagtccctgtgtttagcttccaaagcatggtttggagaagccacctctcagccttggctttccctgtggtccatagaggcatcaggctgggggtccctcagggcccctcctacctcctggagtctgtcttcagggaaagttctgggttcttgttcctgccccacaaatgggcactgatgcagggatacagctggccctgagtcacatcgtaccttggaggtgggggtggaggatccaccacagtccctgtcttagaaggatcaattgtcctggtttgcccaggactaagaggtttcttgggacaaaggactttcagtgctaaaaccaggagaaatcagggcacttggtcactctaacacagagccacaggcaaatgaccacaggtgagcttccaaggcacttatgtagccccatcccatgcagaataaggaggaggctgggccgagcatgtacccccagagtgaatttcagctgccctttccacctgcagagcatgttcccgtttgtaccaggccttccctgacattttcctgtgtgttttcatgtccaattaaaaaatatatatatactacttaaattgtaagatggccaagggcaggtatcattttccccattttacagatgaggaaactgaggctggaggaagtgaagcttccccaaggccccccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcgatacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctcccaaagtgctaggattacaggtgtgagccactgtgcccagccgtctgcaaggtttttaaagcaaagatgagacagcagttcctggatgtcagcaggtgaacaaggaccccaggcacaggatgcccacaggagggacctgagcagtcaggcccaagaggccccagtccccacagtggcaaatgtccaagccacggcctgggggagctggggcctccgaaggtgggagggaatttcgagagtttcaggcaacacgcagcccctccaccactgcatcagacgagaggcccattttccaacacgcccaagaaaaaatatacataaaggttgatgtgttttcaaatgggtttttgctttgctcttctcttttctccctgtgagtattaaccttggggaccctggggacggctcggcttgccagagcacctgctggggtcacaggcagtcattagctttgcggtcagtgcagaataaaccccaatcccgagccggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcagaaccaagcgcctccaggtctctacacgaagacccaggacccagccaaagcccccaacacccctgacattctcgagatcgagttcaaaaaaggtatgtgcccacctgttgggactcgaagggggttgacttttggggccctggctcctttcccctccctgcctgggaacctaggccctctttacccccgccctgcattcctggaagctagagttcaggcaggggcttcaaggtaacgcacagcccacctccctggacagtacaacccatggaccatggatgcctctaggcttgggaggaacatgccctcggctacccatcactcgggttcatgggcaccaggtctggaatgagagcgctctagtccctgaacagccactcaactttcctgggcctcagtttcctcagctgtatctgaggatgaaagagtgcctgctgttttcctggggtagaatgaggcctgcaagggagcgtccagccctgggccctgaccccggaaggtgctcagtaaacggtgagtgttggcgagctggcctcatggacccctgggaccccacatggaaagccttcgccagtcttcattgagccgctctgggcctcaccctgctgaccccacgttcaaagctgcggccactcttgctcccctcggcagtggaggctgtcctgatcgctccctccttctcactgctgtcaacaagaagcgtttgctgacctggcctgagtgcctgggtgcctgagcttgggagagggcatctcttggcctggaggaaggatggagaagcgaggcatgcccgcctgggctcagagggagggctcagagggcgggctcagagggcctgaaggggtaccttttcaggaggctggagtgatcagggaggcttcctggaggaggtggtgctgggcacaggggcacccaaggaccaggcggggggctggcccattcgtccacaaagtggctgcccacactggagctgggatgagagggagagaggctcgtggagaggcctggcccggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggtgtcggaggctaagtgctttaataatctgcctcttctgggcctttcccaagagcttggccaagccagcgactgtcttccttgctccccttcatctgtcccaacctactggggggccaaagaggaccccaaaggcagccgggcccccaggcctgtttgcaggcacagagcctccctttaggatcatctctgagaagatggtgggagtggccccagcagcacctcctggctccctgcacagggctcccaggagcctggagagccgtgagggtgggaggcgggtggcaggctgcggagggtcctgggcaccaggctctggcagccctgcccgaggaccagggcagctccgcaggctgagctggagaagaaacgtgacctattgtcatgatttggggactgtctggaagaagaaaaaaagaccggaggaaccctcccctggctagtgcccattcactctctagttaatttatttgaagttttaatctaattattaactattttaaaggctaagaggctttctccagcagcagcaccaacaatgtcacctcttctcccgggcaggccccatctaaggccccagcgaaggccgataataggaccggggagggagagaaagggagagaggagaggcggggggtggtgagaggggcttaaggttcattattgggcagacttacatttaatagcaatttacaaccaagttataaaacccctggaaatgggggttaagaatggcgaggctgacagcgccttgagtgaagcccctccaagcggcgcctggctaataaagcctcgaaagccgctattgaggcctgattggcacccgatggctcgctccatggtaatgagccgggcagatgggtgggggattagccgccaactttgaacagcttttctttgtcactgtttcagctctcttgttagccccaatacatttattgctcatttcacaccgctcgagaaagtgccccttgctattcaaagtcaaccccgaacccacccactgcccccccccaaccccttccctcctgccaccccggacccagctcctcggattcagggacgctgccgacacctcgcctgctggagcgggcaccgtgtcacccccatcaatcagatggctgcgtgtgggtctggggtacagggtcggggcgcggggtccgcctgacagacgtggcagggggctgtgtgtgtgtgtgtgtgtgtgtgagcgagtatgtgtgtgcttgagcccagccacacctcggccaggcggcccccgggtgactggtgggacagaaggtgctcccggcgtaagacaatggtggagcgtgaaattcaattagttcagggcctggttccaatttcacagcccctaaatgcaaaaggggcaaagagaatgggagggtgggggagagcgtttttattgcattttctctttcattctggggggctttctcgccccttctctccctgcagcaggcctcaacctgcacagggcttttgaaggagtcatttggagtccatatctgtcacatccatttaaggcgtttcgggaggagggagagggtggggtggcgggtgcagactcctccgctgagccgggcccagaggcccactgccctctcttcccaccctaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggtgcggagcacaggccatgtcccttccccatagccacagagtttcccggaccagggggacccatttggcaggagaggctccgtggtccttagccttggaagataacaaccccaggaggtctcctgcctccaagggatcattaggccggggctctcaggcccttggctggatgggaggccaggatagaaggaaagggagcagtagttagctgtggcgctaggcagggccccaggacacagggaacggaaggaacaatgtgaactcacacctgggcaatccctgctctctctgggcctcagtttccccacctgtccagtgggcacctggactaggtgacccggctcagatgtcctcttgagtcttagatcctgaaatgctgcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcggggcccagcaaacccagagatccctgagaccctgtcccctttggacgctactacccccatgctccgtgggcgaccttgggcacgtcctttcaccacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggctgcacaggcactgggagccggccagggcctaaggacctgtcccagcatcaggcacggctcactggcccttttctccagggatggggctgtgccacagttggggctgtgccgcagttgaggctgagcttcagtgtgacatgcctgccacctcggctggcctctagcctgcctagcctcgtatccgcctgtggctgggcccaggagcagggcagttggtccccaagcaggtgcctctgtcttctcttagtagccaaagcccatgattccctttgtcagccaatcagcatttcatcttgaccacaaccctcctctccaggactcagtttccccattcatacaccaaggggatctcagctccctgagggtctgccagtgtgtgataaagccatgctgtgttctttcttgggggtcctaagagggaaagagcaaggtttcagcagttgcagcccctgaattgggcacctgaatttttatactggtggtggggtcagggcttcccgtttcggtaaatgttcaggtctctttgcttagggttgattggaaaagataccacaaccaaatatcacctggccacggtatagtcacggccccatgtctctcaggctatttttactaagattctaaaatccaaagagagccgatcaccccatgtgggccagaagaaaagggtggtggtccggagggcaggatgcctgcttctggtctcaggtttgccctgccttgcccaacaaccttggacttgtcatctatcgctaggcctcagtttccccaagtgtaatgcggtaggcgctgggagttgcatcactctggctctgacctgtctgcgtttccctggaaaggcatggcagcatggaccggggcggggacgggcttgcctcgaaagacatgggagcgcggaaggggaggcgggctcgcctctttcttgtggctttagctccttgcttgctgttattcaggagaaacaacctaattgaagctctggggaggccttgagaacaatgttactaattagctgctcctttttatccgggcttacctttgtctcttacctatattaacatgtgattagatgcccctttgtcgcagcctgcccttgggagccagcgcggtgtgcaccctccagggagagctgggagggaccttgaggagccacagaccagcaccccatttacagatgcggaagccagggctggggaggggtgggatagagggcttgcttcaagtcccaggcactttagtggcaggaccaggactgccatctgggcccagagtggcatggagtggagggctaacagcttagactggagttggacagatctgggttcaaactcatgtatggtggcaggaactggtacactggaagtgctccataaatagccatcagtcccccgggcatgtggaatggggacagaagcagcccccatcctctgggagctgtcagtgtggcggggggtggggtgggttccagtattgcacctgtcttatcataataagggcctgccacaggcatgcccttgccatgcctgtggcaggcatcaccagtcaatgctggcattatcctgttgactccagaggtatctcagggctgcttgcaggcactaccaaatgatcaggattggcatacgtgatgaaagtgtattgccttccctattggaaagataaggactggcctgaagtcactgtgaaatggcatcctgtggggtggggcgagtcaagcagagttgagcaaaaatgaactgaaggaggtggttagtgatgaaaacctggaatgcactattctgaatgtggaatggtagctgacagcattccacggaggctggacctttttcccagaatgggggcctcatccccgtagaaggtcaaagccatgagatcaacagtctgttccaatccccgtggctccttaccacccacctggggaaagcttcctggagcccagccttcactctgccctggtactttgtgtgtgctgttggaggctctccccaaaagcacagaatttagtcagtgtcgtacagggaagaaaatcgggattctgacggcaagaacttgctgtgtgatcttaggcaagtttctccctctggaactccaattgtcaaggggccagatgaggaggtcgtatcatctccctctgaatgtcctcactcacctattttcttgctttgggttggggagagaagacaaagttgctaggtaattttagggtggtgtcttgtttttatttctctactccaaatatttcatgtgagaaggaaagaggagagacggtaaattagggcactgtggattcccccatgacaaggtttttattaagtgtacagtaatgagagaagctgttaatcgtcaattatattgagggcagaacagaaagatgctattgtccgtatctcggtgtacaaggggaacatgtcatttgtattgattttacaaagctcgtaattgaaattcgttaagggctgatttttttctctggggggcgggggcgggtagggagttgggcagcgccagtgccctgggtctggggtggcctagtcagcggcgctcagggtcagggacagggggctggggaagccgcggctggagtagctttctccgtattgtggctgttcacatgtcattatcacattatctttttaactctggaggggggctaattaagtgaagtaaatgaaatcagtggggaggagaaggggggcaaggcatgccggagggaagctgagggaggccgggaaggagccagcgcatgtccttgtgctcagcctctttctctgtctcctctctggccccagacttctcccgccgctctcccctctccgctctcctcccagccctgcccgtctcacctctgcctgcccccgccttgctcctcctccttgccttcctttcctcctccctctctccctttcctcctccctctctccctttcctcctccttcccctcttccctcccttgcccttccctctttgcacatcctcctccccattccccactctcccctcctgtctcccttcctccttactcctccactttctggcccagaaggaacaagggctgtcacccacttgcccaacgtgcccacccaccatctggaacattccagatggagaatggagggagacctgtgaagcaaaaaggttttcagccccagaggcccacccaggatggggcccgccaggcaccaggagcatagaggatggctagagtcccaccctgaccggcctcccatcaccatggcaactgcttctcaccttggccctggtacctaagaggggagcccttgggctccagccaacccctatgccccacctcttccaaatcacttcttctactttcccaaaggaccagagcctttagtccaggtgccctcacctccagcccaggccccagctgagctggcggatcccactcaattctgcaaaattgctcattccgcctaacctggcagcctcagggacagacgagaagaatttgggccacagtagctgtttggttcccacctctttctgcttggtccactctccccccagccacccctggccacccctagatccttgcccgtctccccactccccgctgcacctttcttggcagtaattatggtgtgattgaagctgctccacagagaactgctgacacctctgtctttttcctgtaaacacggggagatgaaaatagacacttggagctgctgtgtgtgtcactccaaagatgtccgttgtctcttccacggcaacacagaggctcagctgtcatttcctccttctctctgcgcagtggtttgtatgccgactgtcaaaagccccaaattcatagtcttttagcatcaggtttctgtcactgttttttttttccagaagaaacacacagaaatcatctgtaccccctacccctgtggagaggagagggaagagctttaaacgcacacacacacacacacacacacacacacgtgcgcgcgcgcgcgtcggcagcaacctaaaaacaagttttttgatccgtcacaattaacactttcgaagaaaaggagcaggaatattaattgcactggtgtgttttgtggctgcagcctttccccttgcccgtgagccctccggaggctgcctgggagggtggcagccaggaagccggtgctgggggctcaggaagaggagggttctgcctggcctctgcccaccagacattctctgctcccggtggcactggcctcattttcctggggacacctgtgatgggccagtagctggaggaccttggacaagtcacagctcttcctcgagccctgaaccccacctgcgccctcccctctctggactgatgggaggcgatgctgtggcctcgaatgttctcgagacaagactgtcagtaagtagggcacacctggaggacgctctgaacacttacctttgaggtaggtcccaaaggaagttggaatgtcagagcagcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtaatttggactgccctacagttggccgagctgaggacagaaaagcagggaggcgggcctgggtgtctaggagttgaaaatgaggagggctcctgctaccggcctacccaggatggcgccattacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttctggtaataaggtttctaggctgattgaaaatttgctcctcgaactttatcgttatatctgccattttggagacagagatttcctgtttctgcacacactggtctttctggacacactgctgaaccattcccctttctggtggcttttttggcgctgtcatgtttgtgtgcggtcatcatgttttgttttgtttctctttcagacagggtcttgttctgtcaccgaggctgtagtgcagtggtacgatcatgactcactgcagcctcaacctcctgggctccagcaatcctcccacctagcatacaccaccacacccagctaatttaccatttttttgtagagacggggtctccctatattgcctgggttggtcttgaactcctgggctgaaacgatcctcccaccttggcgtagtagctaggaccacgggcacatgccaccacgcccagctaatttttttaattttttggtagagatggggtctcactatattgcccaggctggtcttggactcagctcaagcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctgctctgcagaaaatgatgacagacccatttgaactgttttacaagagtcacggtgaggcctgaggaactcccgagggatttgagggcttggatctctgcataaacttggagagaggccgtttcctaatcagaggtcacaactagattcagacggtggacgtgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctggagctgagatgggagaccccggggccgggcccattccccctccagttggctgggtggtattaggcaagccacccccctccccaggcctcaggttctcatttgtaaaactggtgtgtgggactagatttaaggtgagtccagagtttgcagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcctccccagatccccggtaggcttcagagtcaaaaccaatatccttcatggttttttttttttttaatttaaaactgtggtaaaatacatgtaacataaaatgaaccattttaaaatgcgtaagcgtgccgctcaacggcattaggtcctttcccagggctgtgccactgtgactaccgtccacctccagaacattttctttttgcaaagctgagactctggccccatgaaacactccccattttccctaccccggcccctggcagccaccatttctggctgtatgattttgatgactcgagggacctcgcatgagtggaacatacagtgtttgtttttgtgcctggcctttgtcacttagcgtcacggccttatgttgatgctgtggcatgtgtcaggatttccttcctttttttttttttagacagagtcttgctttgtcacccaggctggagtgcagtggtgtgaaatcagctcactgcaacctctgcctcccaggctccagtgatcctcctgcctcagcctcccaagtagctggggctacaggcatgtaccaccatgcccggctaaatttttttgttatttttagtagagacggggtttcaccatgttggccaggctggtcttgaactcctgacctgaggtgatccacctgcctcggcctcccaaagtgctagaattattacagtcatgagccactgtgcccggcccccttccttcttaaggctgaataatattccatcgtatggatggactgcattttgcttcttcactcatccctcgatggacacctgggttgcttccgcctcttggctattgtgattaatgctgctatgaacatgagtgtacaaatcctttctgggtttttttcaagcagccactgtagaaagatgttagtaaattcccaggataactgagaacctgcccttttagtgatgtaacgtatggtggaagaaaggaagctctcggggtagaatccatggagatgggggagctatggcccctgctccacccagacagcagctgcagggcaggcttgcccaagggccagctctgaagttgatgcgagaggtcgcactcctggggcaagagggggcctgggctgtgtgctgtgggcggtcctgcctcttggtgccccactgtcctccaatgcagtaggaccttcccccagacccagctcagcccaagaccaggcatttctgtctcactcggagatcatctgttccaagcaggttgttttccaaatggagggactgggcctgaggtcacaagaggggacttgagcaatcccttctcccctgaccttccagggttgggcctccacggccaggtgacttacagggcagcagacagcactggtgagggactcgggggcctacattcagttcccagctccacctagagcaagtcccttctcctcttgagctcagtttccccatctgcacggtgcggtcagcctaggtgattgcccaagccctctgccaccccagtggcctctggagagacctggccgcaggggccccatgggctgaaggtggcatgtgtgtacacatgtgtacatgtatgtgcacagctgtccccctcccctggctccctggtggaagggaagaagggatatttggggctctgggctctaccgtagtcgctttaattacaggctttcaacctcgggccggtgggcacgcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattttttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccctcccctccgtatcagcaccttcctcccctgccgcccactgccatcctcatgtgagaccccaaaaggtgcaggccaaagggggttgagggaaagtgcagggcatgagggagcaaggggatgctagaacctgccttgccatggggtgtgtccagggagatgcaccggcttcccaaggtgtccggcagcttccaccccctacagtttgcatgactgcagcaatgccaggcactgggcactgtgcggcgacatgcatcaccccgcatggtcctcacaactttcccaggaggtctgcagctccttgtacacgaggaaactgaggctcagaaggaaagcataaaaccagaagtggcctagctgggtttgacccccaagtcaggctgtctccaggaagaacctggacctactccatgaacttgagggagaggctccctggaccaggaactcagccccagaccccagtaccgcaggagccagatcttgaccatgaaaccactggggtggccacagggcctgagccctgtcacacacccagcccatgtgtggaaggaccggtgggtgacagcacctgaggcgggggtgtccccgttttgcaggtgaggagcccgggtttccatgccttggaatccaggcctcctgactccaaaatccaaccctcatgtggtgtaacagaggtccccaaactacagtccctgggtcaaatccagcccgtcacctgtttttgttcagctcatgagctaagaatagtttttacatttttattttatttatttatttatttatttatttgggacggactttcgctcttgttgcccaggctggagtgcaatggtgcgatcttggctcactgcaacctccgcctccctggttcaagcgattctcctgcctgagcctgctgagtgactgggattacaggcatgcgccaccatgcctggctagtttttgtatttttagtagagatggggtttcaccatgttggccaggctggtctcgaactcctgatctcaggtgatccgcccgtcttggcctcccaaagtgctaggattacaggcatgagccactctgtctggccagtttttacatttttaaatggttgggaggaaaaaaaattttttaatgctatttcatgacaaattatataaaattcaagtgttgccgggcacggtggctcacgccaggtgaggtggctgtttctgcattgtctgtggctcccctggagcggcaaggggaggttgagccatttgagagagaccataggacccaaagagcctaaaatattgactctctggcccttcccacccacctccataacatacacatagccctgatttggggcgttacattaaacagctgccctgagctgtgggaggacaggctgctgcctgaggccgatcctcacatcttcgggggcctggacgtcaggggacctgtgcaaagttagtattagttaatcgaatagctacctgggctaagctctcctcccctcgcctctccccctccactcccagattttgtttccttttaagcctcctaatcactgtaactcatctcaggatttcgagagggctcgatggttattggctggcgttatttctccctgccattgttccttgcagctttgaagccaagtttctgcccccgttcccagggacagacaggtgcttaaataccattgtctcctgcaggctttccagcccggcgggattgcgaccccgaaaggaggattttagttacaaagtgagagagtcattaagacgtggcggaggagagagcacctggccgggctgctccggggcctccacggaggctgatcccaccgtggccgcggccacggctgccacttatcctgccatcttgctgctaggctctgagctgggcacctgatggggtattatctaatattagctgcgcagaggtgaggaaacggaggcccccaggtgaagacactcacccaggctctcctggctggtgatgggcagctttgagccggggacaggccagctgtagcggccaagttcccagttactccaacagattccaggatgctcgtgatcaaggggcacggcggcacagacaggggaaccctgggtgtagggcacagtttggctcctggctgcggtcacgatgcctctacactggactggctgggttgagtccctgctctgacagccagcgacaagccctctacatcccaaactgaggtacaatgattaggagacttaaaaggaaacaaaatctcagagtggaggcgagggagagtaggggcttcttctgggtagttatcactaatattaactttgccctggtccgctgacatgcagggccccacaaacatcaagatcggcctcgggcagcaggctgacccccacagctcagagggcctgtttgatgcgattttccccatgagggatacagacatggtatagaccagggctttgcttgatcatgttacttaacttccctaggcctcagttttcccatctgaagagtgggaataacagttctacctgtctggtgggtgaggactaaaagtatgagtatttgtaaagcacctggaacaatgtctggcagacgagtgcttattccagtgcgtgaaataactgcgagcgcccggcgtggtttcccagtgtggaggcgcggcacttggagtcttgcctctggctgggttaatggtcttgagcagggctgtctcttccttgagcctcagtttcccctcctgtcaaataaagggcaccaggctgagggcacgccagggtctcttcccagtcccgtctagctcctgggtggaaagcccaccattctgctgtaatgcttggcttcctcagagcccttgtggtctcggcacagatagggagactgaggcacagggaagccctcctgccccagcctcactcctagaggccctaggttctgtgaccactgccactctgcatctgtgtgtctgtgtgtggctggctggctccctctcctctcccaccattcccaaatttcctggtctggctgtgtgagcttcaggcagactgtctccaggagtggcaaccagggttagcctggcaggaccccagcttcaggaccctggcagggcccagaggagcatctcatctagggggtatagctcacttcttctcccctcacctccatttcttcagcaataaaatgggtataatgtgcaactcacacagaattgctccagttagaaaggatcgcatgtgtttggctgggcctagcagcacgggggaggggtccctctccagctcagccctaagccccacccacagtgatctgcaggtctggggggtgcagggtctcccccattgcagcttatgccaggctcactggcccccaacccaggctgggtccgctgggaaaagaaatctgagcagaagaaccctgtggggcagaggtagaaaattctgagataaagcccaggccagttgctcccacagagatctctgtcctatctctggctccatctcctgcctgtcttccggcctggaaacttaatgggctaattatcccagctccgtcagaaagatggccaagcccaggacaccagggcatggggggctgggagaacatcagtggccccctccacgagggtctcggggtgtgttggaaaaagccctgggccagagttaggagtgcttcatcagacctgggctcttccaaagtcttgctgtgtggccttggacaggctctttccctctctgggcctctctccctgtgtacagtgagggctggcacagagcatcatgttcaaactgcaaatgcaaaacgctttgcgctctgtgcattccctcactgcatccacacaacctctggttagcaatgttttctcactgtgcaaatgaggaaaccgaggcacagggaggttaatcacttgtccaggtgtggctgggatgcggactcacagggtgggacactggagagcaaggactcaacctctactctccgtgcttggccctcccccgcctctgcaagccccaggaccccatcccagaagcctgtcccctttcccacggaggacctctgcaggtgcccccaggggcctgggcctcccacaatagccgcagcccctgggctgacccagccctttatcagggcaggagatcatgcgccatctggccctgcagctgcccaggtgggctcaccttccaggctccatttcaggaaactctagccttgccctgtccctccccccgccatggcctgcctgcctgcctgcctgcctgccccttggtcccagcctccatcagcagaggctagagagaggccgggggcagactggggtctgagcgctacccctccctggcctttagggctctcggggagaggggagggagcatgtttctcaggcacctcctgcccccacctacacaccaagggatgttctggccatagagaaagctccaagtttatcataggaagcagagttgttacaacttgggccaacacaagtcaaatggaggctccccacttccggcctgtgtgatcctggagaagtttcttaacttctctgagcctcccttcctcacccagaaaggggagaggctaagagagtttctctcagagtgctgtctatgaggattcagggagctagcccagatcaaagcctgagcgcagtgctgcttatctatgcagaaatattctatctgcccaggaaaacagcagcaggtgcagaaaacagctcactgattccaaggggtgggctctggccaggactccagttcacagtagcccctaaggctggtgctgctcagtgctaggggctccacatgaaatattactgtgacatccccactcaacagatggggaaacagaggcacagagaggggaaggctatgcatggccatggtctgaaccaccacccagctgcctgcactggacacccatatcaccaagccccaggcagcatgtgcctctgagtcctgtctgaggtcttctgcctcccccggagattagagcctccattgggccagggatggggtccctttaccactgtgtccccagttgctggcctgtggcacttcctgaatgcctatggcatgaagcagtgggtcacttccctcctcctgacccttagggaaatgacctaggtggtcacctccttacccacaggccctttgcaaggttagagggcagggctatgaaagcatggtcctcaactcagccactggcaagcgcacattgtgccagtctcgcgggaggcagtcatggtctgcatggcggggtaaaccatggggcacccttcctgtgccccaggtctccctgtgtcctcgcggtgcaggaggcctccctagtggtatcctgttttcctccctgtaggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgaggtaggtgccccacacctcattctgacccccacttgggcacagagcctatcttttgactggatcctcaagacatctgtgcctgagcacatgtcaggcaccatgcagagcacagagtgatggtcacagaggatatagacaccactatgctcccgtggaacttacaggctagctgggagaaaggcatggatcaaaccattaccagaatgtagaattagacaaggtggcagcgggctgtgaggaatgcaggatagtctggctgggtataataactgggattggctaggaggggtggtgcatgcctgtaatttcagctactcaggaggccgaggtgggaagattgcttgagcccaggagttcaagaccagcctaggcaacatagaaagaccttgtctcaaaaaaatatatatacacacacacatacatatatatatatatatacacatacatatacacacacacacacacacacacacacacacacacatatatatataaaataattggggttgtgaagaagctcctttgctattcaaacaatagcagaaggagttaacaggtgaatggggggaggggtggaagggcaaaagtggccagggggaaggagctgaagctagatcttaaagggaagggcaagatcagatctgtgcatttagagggtcctcctggctgctctggagaacggatttgagtaggtgggaggtggaagggcacctgtggaaatgcggtagcttggaccatgctgatgattcctggactagatagcagcaggcgaatgtgacacatatctaggaggagggattgaaatgacttggatgtggagggagatggagggtccagaatcaccctggtgtctggggtcgtgagcagctgggtgcagtccctgggttgaggaaatgctcttgaggaaggatcatgcatttggatttaggtgtcatgagtatgggtttcttttgagatagctgggaaaaactaactggaaggccgccggacacttgggtctagagttgaggagaacccaggctgaagaccctggagcatcataggcattttgatgttctctgaagcgctgggccaagagagactgcctaggggaaagtgtggagtgagacaagaagggaactagccaggcaagatggtgcacacctgtaatcccaactctttgggaggccaaggcaggaggatcgcttgaggccaggagttcaagaccagcctgggcaacatagtgagacctcatctctactaaaaataaaaaaattagctaagcgtggtggcatgtgctcgtggtcccaactacttgggaggctgaggtgggagcgtctcttgagtctgtgagatcaagggcgcattgagccatgatcatgccactgcactccagcctgggcaacacagcaaaaccctgtctcaaaaaataaatacataaagtattagccaggtgtggtggcatgcacctgtagtcccagctactcaggaggctgaggcaggaggatcacttgagcccaggagctggaggctgcagtgagccaggattgcaccgctgcactctaaccttagtaacaaagctaggcactgtctctttaaaaaaaaaaaaaaaaaaaaaaaaggaaacacaactggaaccatgagatttctcattgatggaccaggcagaaggtggccaaggaggagcccctggaggggcaggagggccctggtgagccagggcaaaggtggcaggtaacgattggccactcctgtgtccgccccgtggatgagagtgacctgcaccaagggacgaggtgtcacctccagaggtcacctggccaaactagagatggggcaggcccctgtgggacagacagcccccactagacgtgggtcccctaaggcccagcttagctcaggctaaggccagcccctccctcctggaggctggttgggaattaaagtacgagtcttgtttggcagtcaatattatttttttctttcccttctccttgccgtgttgagtttctccccgcttcaatctttctaaacactttataagccataaatacaactgagtcagtttagatcagttggggtaaatgtcaaattatcttctctctttctctctctggctctttcttccctccccctccaaatcaacagcctctaataatctgtccaacccttcattaagccttacagtctcactcagggagattaaatgaataaagtaaaaagggaaaggggaaaaaagagagaaaagcaggagcatttattctcactgtgtctccgaccatttcccttttctttttgatttctacatcgctgacttgaaagcccttgagtgacagcgtcacagggaccagcgaggaagccgtgagaggtagcagagctggaaatgccgcggctcagtaggtagaaagtaacgtaattatagagcaggtcagagccactcgaatgagcaaaaataaaagcacagaggttttctgtagaccgtcaggggaggtaaaaaaaaaaaaagaaaaaaatcattgtaaactctttttccacctccccgctcacttcaaaccacaattttaaaaagaggttttttagttcctgagaaacccctcttggaactcccagcagcctcgtgggacaagtttgtccctggatgtgggccctctttgcaggggctgccagggcagctgggaagttcccaccttggggaacgggatggggagagtttgttgtgacttgtgagagatggaggtgaagggacagatggacacagaggtggggggattctgtgtcctacgttctccctgggctgagtataggggccagtggggctgaggctcggtttctaaaacaaggtctgttgaagggatctgaggaggttggtggtctagtttggtctagctcttcctaagcactgactgcacagaaaggggtggccagcaaaagtctggtatctcctcctcttccagggaatgcaagctcctagtggcttcagtgcctgagccctggaggggccgtggaggtgtagaggagggaggaagggacatcaaggaggtacaggagcatgggagtgactctgcagagagttccacgcacccaccggcttcaaggcctggtgaaggtcagggcccgggtcctgaacaaatcactggggccaggcagatgcagagacctcatttgttcttgtaaaaagtccactgtctacaaagaaccagtcagagggccagcctcagggtctcaaagcagcagatcctcctgcctcccaacaccgacccccgctacccctacctcgagaaccttgagtcagctttgtcccaaggctggaattctgcagacaagggtctgattcagagcaggacatgacaagggaccccatcctctcagaggctcagaggctggccttgtggagtaggaggcatctgagtccacgtgccctaagtgcttagcacaaccataattaatgaaggcaatgggtgattgattgcttcggtctggcccctccctgtggacaccactcttgctcttccttccttggcacctggcccagcatctggcaggcagcaagggcttaataaatgcctgaacaaatgaatgagtgaatgaatactgttagtactagtgggtgctcaccatgtgccaggcaccagctacattatttcatgtggggccaaatgtgacactgagagctaaccaccatcacgcatttcacaagtgcaaggctgaggctccgagtgcaggaatactggcctgggctctctggtggcgggtggcggaaacaggacgcaaaccccagtcagctggctggagtgactgccatggttaggaaggttgggaggagcagctaagggtggagagccccaaagcagaaggctggtgagtctgagaggtggaaactgtagagaggtaaaatctgctctgctgagtacagcagcagtcaacccagcattttccatgacacactggcagtgggtgcccaggtttcaggatggattaggtaaggtctaactggttggacacatgaggggaaaggtgacttggtgggcccatctcgctgtgaatgctggaggcctccctgcagcttgcgaaatgcccttgtgctattgcaattcacaccccaaggcctcctgagccttcaggtcactgcatgccatccacacagtcccaagggcacagctggcttggacgagttacccatttacagacagagtgctctggttggtggaattcatagggctagttctggggtggctgctcctagcctcctgccacattgtgtagcagggaagaggctgctgtgtgctccactagggctctccaacctttgggtgggtgcctggcccagaacagggttccctgagttgtacagaaattcaatggaaagccgacgtgcagggagggtttggacccacacaggggaaatgccctggcatctgggaggtggggctgcttctggccccagcagtcctcccttcaagcagaggccagggccaggctgagctgacaagcttctactctccttgcagcatgaacgtgcagggtgattatgagccaactgatgccaccgggttcatcaacatcaattccctcaggtgagaagctcagggccctgacgggccttcagagcctccaggtgtaaagggtaggctttgagagcccccaggtgtaaagggtaggctttgatgcgaccttgactgctgccctgccctgccctgccctgccctagacaaaccccactttcctgtccatctgcccatagcatcctcagaagcatgctttgatagccgacagtaacagagggtcctaggcattggggtcctaggttcctgtgtcccaccgggtgcctctgatacttgccctcccctcccgctaagccacagggactccactatgagctcctttgcagggcaggttaaacaaggaaatagcatagaggtggagagaagcctttgttttctgtcaccatacctgagctgtaggtctagctggaagccatcctagccacgtggatctccatggcccaggagggtggtgcacgtcatctgaagtcactcagacctttgatcctctgtgagtcaccagtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttacacaaaatttgcaactccccgggaacaggctgagtggttaagtaactttccaagggtcacacagctaggaggtggtggagctgagtccggagggcctgtcctgctgtgggttctccatcaccagctcccttctcatggggattggagtctagaagaagatgcaagtcagtctcctcttgctaacaacatgccctgggcacagagccatcattttctcccagagccagtctcttgtccctggaggcacctcatgccccgagagatgttgaagcccgcccatctgcccagggtcctctcccttcccctccgtcacctccacctcccctgcctcctgcgccctctgtttgtattttatgactctataaacccttttaaatggcccagaacaaacagggcttacatagtggcctcttcatttctcctattgccagttaaacgctttgtcttcaacaatgacaaacaatgttttccccctaagataaattaattacattatcctgattggagggcaggaggggccagggcgggagagggaatagaaaaaaaggcaacttcacacacatcttaacaaacagctgccccagccaccccagctctgcctgaattaattgaacccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatccggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgcacagccctttctctggacatcacttttactcacagcccacagggagcttctatagagggtggccatgagtgaccctaggacacttaccacagctgcatggcctaaagcagcctaaatcatgaaggaggagggagaggcctgagcagagaggagaaaagagcaagcccggaacttggcagcatttctcattgtccacaaaccaggccctaaagcagccatgtttgtagtgtggccctggccccccttggtcatatctgattggaccgtggatggacacctgactcgagctggccaatcagaacccgcaggaattgggcctcggcacgtggccgaagtgaggacatgtaacacaggcactcaccgctgggatgctgtggacctggggcacagagcaggtgtagaaggaaaggagagggaagagatgggaagagagggtcatggtattggcgtccatatttctgtactggtgcttcatgaaagctggtggcatctcttggcctggtttccctgacacctgatatcataacgaattcaggactccagctcagtgagagagtttctgctccttgcaaccaaaagcatcttcactgggaagacttgagtgccgcttgctctgtgctttgccctggttctgaactcagaacctgacctcagggatcgcttcgccactccgctgcctgtgtccatgagggtttctcgcaaaagaagttttacctttaaaacttattttcctctgattattaatgtccgtggtaataataaatgactcaatattagctttgtgccaaacacttcgctacacactttattcacattatctcattgaatcttcaaaaccacacttggaggtggacactttcatctccataatgtagaggtagcaacgaagctgcagataaactgacttgccaaaagccactgagctagcaagtgacagaaccaagaaccaaatcccggcctggctgagtccccaaatcttgtgcgtttgtcttgttgttgttgttaagatggagtctcgctctgtcactcgggctggaatgcagtagcgcaatctcggctcactgcaacttccgcctcccaggttcaagcgattctcctgcctcagccttctgagtagctgggattacagacgcccaccaccacgcctggttaatttttgtatttttggtagagacggagtttcatcatgttggtcaggctggtctcgaactcctgatgtcaggtgattcacccacctccggcctcccagagtgctgggattacaggcgtgagccactgcacctggccattatgtctttaaccatagtgataagctgcatctttaagaaaagaaataactagccaggcacggaggctctcccctttaatcccaaaactttgggaggccgaggcgggtggatcacaaggctacgagttcaagaccagccagtttgagaccagcctggcctcggcctcccagagtgctgggattacaggcaggagccacgacgcccagccacatttggtatattatcagtcatatgtctttttcttttctttttttgttttttggctaaacatcctataatgcacatatattttttcctatgcttacaatatttttgcagttatttaggctaaagtataaatgctttatattttatagttataaatgtatactttatactttaaagtataaactttagc

SEQ ID NO: 15005 - DNA, 27579 bp, Human
atatgttcatccttttttttttttttttgagacggactctcgctgtgtcccccaggctggagagcaatggcatgatctcggctcactgcaacctccgcctcctggcttcaagtgactctcctgcctcagcctctcaagtagctgggattacaggcacccgccacgatcctcccgagtagctgggattataggcacctgccaccatatccggctaatttttgtatttttagtagagatggggattcaccgtgttagccaggctggtcgagaactcctgacctcaggtgatctgcccgcctcggcctcccaaagtgctggggttacaggcgtgagccatcgcgcttggccgtgagtgacttttaaaaaatgaaaagactccatcaaatcctccctgaccccagtttcctctgttgtgagcagtagagaaaggtaagattccaaaattcctatttttccaccatactgggttgaagggatctgtggagccaccctctggtagaggtagaaccttcgaaaagggcatttttaatccacagggactcctcgagctcggctggacctccgtggtgccgtgctgtgagaccatccatcactcaggcactcagcgagcccacatcggcccccaagaaccctgatgaaggtcttcctgccccctagacagacttggggagacggacaccccaaaagcgagagctctttgaggtcaaacaggtgctcaggagcaggggtacaagcaggccatcatcttttagtgctgtgaggaggagtggggggatgagatggggacgcaggaggctgctcggctccagagcctgctccacggtggaaggtggaggagagtccagggtcccacggtcagtccctgcgtggcccaggaaggtttaattcttttaaagaggaacactggacacttcccgatattttcttggtccccagctcaggccgacccaagttcttgccttccgcctagggaagacaggggaggacgacgccatctttggtctcagggcccaggtgcgaaggtcgtttggcaccatctctcctgcctgccagatgtgggcagggcccgtccggttcttcccctttgctctctcggccgtttcccctacacccgcaggccttccacagctttttgaactgaggcccagggcctcgcaggggatctcgaaggagcagcaactgcacggtgctcctcagatccgcgtgcccgaggtcaccggggaacaaagaagttacttatttttccttttagctcagatgaagagagagggcgttgtcttccacagaaagacgctgcgaactccgcccccgtccccctttttcttgcagcccttccgtgcgggtgcagctgtttaaactaaggccccaagtctccagcactttgtggagtgcaggaagaacgcgagcgtacgggagaatctgggccggcggggcgcagcgagccgcatcgcagctggaggacagccggggtgtgtctgtgtgtgtttgcccgtcggttgaaggccccatcgcccccgggtccccgccctgccccagaaagcgttccccaagagagctaggagtcctgcgcacctggagcgcgctccgcgtccacgcccagagggcgctgcacactcgcgcccgaggactgcctgccccccttcagcccctctcccgggctgcgcctccgcactccgggcccgggcagaagggggtgcgcctcggccccaccacccagggagcagccgagctgaaaggccgggaaccgcggcttgcggggaccacagctcccgaaagcgacgttcggccaccggaggagcgggagccaagcaggcaagaaccttaggagcgggccgggggtggggcgttccgaaggggccgggaggggtggctggggggcggggtcctggggggtgtggactggggctggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccggtgagtgcggccggcggccaggcggggaggcggcgggaagccgggactggtcacccgcggatgccggcgggtgcacgtggagggggagggggagcgaagacttcccttcttcccgcgctagcccagcgggtcccgggacggtgagccccgagaccagggctccagccccaatttcctccgctgtcggtgggtgccgcaccggtcccgcgctggggagggtggggggccggggccccgcgctcaattatgtaaaacgtctccacatctgtcggagcccgccagcccacagcggcgcccggggtcgcccgttcccaccctcctcgccccggccaccgcggcggccgggcccccgtcggtgacccggggggatgcagtgaccgcggccacaacgccccccctgcagaccctaattcaaaccagacccgcgggcttgcgccccagcgccgccgagcccgggcgccccgccccttgcgccagggcaagtttgggcgcagcgcggccggcgcgggagcgggaggcggccgcgttggcccggggagccgggccagggctgcgtggggggcgcgggcgagcgtctgcagggccctcgggcttgccgtgggcggctcgaggtgagctgagccggcccggcagcgggaggttccgggaagttggcctcggaacgctggagacccggaggagcccaacttctgggctgctgaagttgagctggccccggagggcgcgttcccgtgccgggcacggccgaggcgcaggcgccttccacgcgaggggacccgggaatggcctcccgctccccggctcggctttgtgctgaagccgcgcggagggaaggcgggtcccttggcccgcccagtgcagctgggagaaaagaggggcagatgtggagctcggggctgtaagaggcctttgggtgggatgcagcatccaccttcagcggggctgacgctccactaaagagggacgtggccgacaaagagcagcctgagggtccccagaaagtggctctcccgccccggccaccggccgctagcccgccttccccaatgggggcgctttgttctcggcccctgtaaccctttcctgggaacagccccgtaacgccggccttgacgggggctgggacctgggccgcagccaggtgtcagcgcgggccgcccggtgcccgagtctgccgcccgagttcgcctccccagcccccgcgcccggtgctggcgtcccggggtccctcctgcgggccggctcggccatccccagggatgcagaggggaggtgcggagccaggggcgcttccccttccggaagtggcggtgtctcgccactacatctggacagttcgacttccccagctctggcaaagggaggcacgtgggcagggaaggggcgggggcggggtgggcactcgggttctccactgctaatgtggcatctggacaagtctcagcagcgctgaccctccgtaagcgttgcctcgtgtagtagctgccagttattgagcgctttggttttttttttctttacagagtctgtctcatgggagatgaggtagggacagtcgtttctgagaccgatgtgtaaagcgccctccctgcttcccaggtgactcgtgcttccagacattttccggtccaggagaggtccctgtgcctattgaactgtgaatgggctggactgtgaggggtatctgggagcacggggagggccatgatttccgagctgggtctcatgcactcctggctttcaggtccaagaagctgctctctagggtggtggtttctgtggaactgagactgtgcttggagtcttcgctccgagtttggagaagagaatggagctgggtgccttacctccctggaccgctgggcatcacctcactgccccattctcgcacatgatggggcctcagcaggggcggctgaagttgggtcctccacctatttccggctggatttaggagggctgctggttcccttgcctgcctggggtaaagcagacattccagagccctgggatcccaccgcacccgttaatgctggggaggcaggtggagtttgggcttccccgtgaactgcctttcctggagttttctgtgggctggggcagatgctgcagtgtgaggcattatttcttgcccagaaacttggacatagggcccaggaggcaggagagtctcaaaaggggaaaggagggagactccctggagctgcagggagggaaggcttcctggaggaggtgcttgagctgagcctgaaagccccacctgagctttggggtcagactctggcttgaagcttaggtgttctttttgctttttctgatcttacaaagattagtttgttttctctttcccagttctgccctcttcctcttacagtgaatgtccatgttaggttaaaggtgggggcatgcactgccttcccaaagctctgatacccctttcctaaaagaaatcaggcagctgggatttgctttaagatgggagaaggtatttgcaagtggcagagatctgaccctctctgaaagttcactctggccccagtgggaagcaggtcagaaaccccctggggaccagggaagcaaggagtgactgaatgggtgaggggaggctgctaggagaggaggttgctcaaaaccactcccaagagactaaaacaggtttgtctaaaaaggtttctctctctctttctctctgtgtgtgtgtgtgtgtgtgtgtttactgtggtcttttgtttctgccatgtaagaaaaatggcttgttctggaatagttatttgctgtttttcattctttctctcttctctttcttgaaaggcataaaatcccttttgccctaattatgggggctagtagagacattttcccacagcctggcagagagggtatgggggggaggcactagctgcctccgctcaggctcagagccttctagaagtgatgtcatccctggcttcagctctacagggagggtggagcggtttaagtctctacctgtggctcatgatgggttccagtaaaacctcattaacacacattggtagggagacagtaagaaaggagagagcctggaaagaattaatgaaaagcttgacttctgcagttttttagaggaatcttttctgttgcagcagaattttggattcctgaaatcccttgggaatgaggtgtcctgtgtattcatattttttcatcaagctaagaatccctattaccctcgagtattcttactctgggcatgactctctgaagtatttatttcccttcctttatcaaccaaaaaatgctaggcatgatttaatctctgcctgccagggtcgtcctcctcatcattgtgctgggttaggacattgtctcctggatttactgtgctctgaagagcactttgcccctctgcctggtgccccaggttgctctgttttgaattctggtctttctcctttttccagagagcagccagaagtgacatttatgtgcctgagtgtagccagcagcttttctgatcagttctaatttgttacttttctccagtggcactaagaaactaatcagatgagttaggcttatttccaagctgagagttttaggctctgggtaagggccttgcctgtgagtgagactgatgatctgtgatatgtggattttgtacccttcatgaacttcagctgggacctgttgcagtctcccctctacctccctgcaccccacctagagtaacaaagaggtgctgccaaggtgaggcctttaggggcctctctcagtggagaaaaatgagtcatctcttgggggaagtgcttgctgacccccatgttccaagttcctcgacctggtttgacttgtaagtgacttgctggtcacaggtagctggactgaccagctgagggccattattctttagccttgactgttactctcagcttcggtcatgcccccaactcttcaccacatgtttgatttggattttagttcctgtttctatataatgtgcatccatactgtgtgacaggccagaaatggctttggattaagtagagccccaggactgagtctcaactctgccactaatttactccataatctggggtgagtcactttccttccaagtcttgttgtcctcatctgtaaagcggacatcatgatacctgttctccctgtcctcattctgtcatttgcgtattcatttcataatggatatgtgaaagtactttgtgatgaaaccgcctgaggaaagttagctgtcgatataattaaggttacctttttttgagtgcctactgttgagtgctcagtacttttctttcattcttatttgaactttacccaaaacctttacaatatatatcattgccccactttgtggatgaggaagctgaggcctagggtggcgggcccctccattggctgagacaggatttgtgtgtgtgtgtgcagtgtgtgtgtgtgtgcgcatgtgtatgggtatggtgtgaatacatcgcaagactgtcaagtctcccctgagaagcctggcatttgggggctggctgaaccctgcaaggctctactgggcatttgctggtccgtcctgaagaccatggatatgagcgttttgggctgagggggctgggccaggctgagctggcctgaacagtgccatcaggcaaacaacactgggttgggttcaactgatggcccctcagggacaggcgagagctcctcacaggaagtaaattgggacctgagagagcagggtgggaaccatgtggactgggtgtggaggggcctgtttggatggcgccctcaggccagaccccaggtggtgcccagcttgcaccatcttttaccttgggcgctggggaaacattcttggaattagcagattcttttgtaagcctgggaggcgggcagcatggcgcgggtggtggccagaacccaggactcctggctctggtgccacagtcacctcctggtcccctccaacaccaggtcctgctgggggtggggacagcccatgaggaactggtcattaggcgattgccgggcttcaactgttgcccgattgccttcttttcaccaaccagttttggaatcttgggttgaaagggcccctgaggccctgagagattcagggagtttgtggaaagagggctttggtgctgggatcctgtaccctgtcacttctctctcagctgttccagcagaggttgggttttggatgggagcatgtattctggaaccttccactgaatgggacatgcgtgccctgacaggctccaggggaaggctgatgtgtgtatgcccctcaccacaaggaggtatgtttggggtgcaggttgtagaggtgaggccgcagaggcaagaccctgggcttggggctacttcagcaactgtcttatccagctgcaggtggtcatggggcccacgccatcgcttcccctggaagagtgagctttacctgtgatgttactgcttttgcccgccctcaggaagctttcatttaggtggagagacagtgtgagaaggtccctggcattcctgagacaggtgcaccgggtcagcttgcctgtggtcagtactgtggggatctcggggaggggtggcctgagcctcccctggcaagtgtcctgctttttggcagggcctgtaagggtgggggcaagcttatggggcaaggggggtgtgccgtgggaaatcttgggtcttggggccattgagtcaggagagcagaacaggcggcggctggacctgctcctgcactcagtcacttgcccagcgacctctcctgctgcgctcggggcttcccgaggctgccactggttcctctccccactgggagcccctcaagggtctctgacctcctggcttttatggcttcgtggctgcctaattttgtgtagaggatgggcctcctctggccgtcagccctgggaaaaactctctgcctagtgattcacctgagggttgcagcaccatgagatgctgtgtgtgtgtgtgtctgtgtgtgtgtgtgtctgcgtgtgtatgtctgtgtgtatatctgtgtgtctccatgtgtctgtgtgtgtgtccatgcatctgtgtgtctttgtccatgtacgtgtgtgtgtccctctatgtgtctgtctctttgtgtttgtgtgcgtccgtgtgtgtgtccgtgtgtacgtgtgtctctgtgtgtgtgtgtgtctgtgtgtttatgtgtctgtgtgtgtctgcgtccgtgtatatttgtatctgtgtgtgtctgtgtccgtgtatatgtgtgtctctgtgtgtgtgtgtctgtgtgtgtgtgtgtctgtgtgtgtggtgggggggtgcttactgcacaggttgccactgcatttgggccttgcctgggcactcctgacttgccttcccctgtcaggctgcagtctcagttttggggggcctggtcactacctggctgcagcttccttttcagacaccagcttcctttctgcctcccacctctgctggtggccttttctctttttcactgtggctctgacatccatcatggccttggccttggaaatctgtgggagttattcctacagagacgggcagtcaggtcacctggccttcctggttcagctgagccccgactgtttggctgtggcaggccattgcctctctgggcctcagtttcctcctctgccaaagggtcgttcttcctgtcctcagttctgagagccacatggttacagagagaccttatcctgggaagggcagaggtggcactgaaggacttgttgggggctcacatttctctgccagtattctttcttgggactcgaaggagagttggttgcccaaggggtcatcggtgggatgggcaaggccagtggagggcagggcaggctgcttgaggggtggattcgagctccttgtgggagctggagtggacagaggtgcctgggtgacgttgggccagggctggggctgtatgatgttctccgcacacacacccaagagtcctggcacctgcccgaggtccgctcagcagcaggaatgaaggctgtggcgggcaggttggggcagtggggaaggcgggcatgttgatcagtccactcatcagctgagtcatggtgccagggccacgggtcctcccctgagactcacccaaccaaccttgatccactgcaagccctctgggggccggcacgaggcagagagtgcagcaagacacagccggggctcaggggcctggctttctgtcttggccctgcctcctctctctcgagtgactgtgtacagaggcctctcttggtctcagtgaacccatctgtgacatagggggaaggggctgagaggcagaggtgaggcaatgcttttgggtgtgcatggcctcttgtggctgtgtcgtgtgactggtgggtatctgggggcctgcctgtgctctgctgcctcaagttctgagggcttcatgagacctatctggcttgaccagatctaaagcccagatcctgggtacctgctgtgtgcgtagccctgtgcagtggtgagagttccatatctggtccaggggattcctgtaagagagggtggctgttactggaaccagacgagagaggtggtctctgcagtgacaatgaacgggattcgcgattcagcacctgtcacgtctccccacaggaagggttttgtcccagagtcccacgatacagcagtatcgaactaggagcctgggctgtaaggcaggacattttatggagctccaaacctgtggggctgccttctggccatgggaagtgtcagggcagggggtctccctgagggagctgcaaaggctgccagtcctgctctaggaccactcgtgtgcaccatggatctccaaaggtgttcagggaactcttccccacggtggcgtgagcttgagttcatagtcatttccacgtggggctgcctggctctctctgtggatcttctgtgctactcagcaggctgagagacagaactctggcgcctggcctgggatgcgtacggtgaggattgcacgtctgccagggtgggatgtggggaggttggaggaacttctggagggccgaggagctcgtggccaactatggcatttgtcatgaactgggtcccagaaagccctttagaacttgggccctggccctgctgttcccatgctaccaataccagtggtggccgctgatgctccagggaccttacctggttggggacttgattgtgtcagagtggcattgactctacctccagtagcttcctgtcatccctgctgcccaggaaactgtccgaggccttggaaggcccatcttatctgtagtgttccaggcgaatatgatggtcaggtttgggcttgcagggcccgaggttgtggggcgtttcaggagcctctgagaccttcctagaggctggtgtcattccagcttctcccagagaaaaccgcagggtgcagtgctgctgtgatggtgaccatatctcttccaggatggggtatcggggagggtccgggcggcaagacctcaaggctggccagggcctgcggggctgagggccaggctgggattgtgggccgtgcttgggctgcatgagatcttcaggccctgccccccaccttcctccctgaaagggacttggggcctgggggaagagcacaggaggagtttccctggggtcaggcctggaaagtccaggaagctcacccctgagtctcctcgggtgaatctgcagcagtgactggttgtcttgggctcagggaattgtagaaagggcatagagccccctgcctccctccccacctcccgtgaatgaggttcattcttagagatcttgtctggaggctgggcatgcagtgggcactctggcccacctgtcttccctgtgtaaggcagtcacctgagcctgaaggcctgggccttcctgcctttattgagtcctgagaccttggggcttcacagctgaggtgggaccgagaactagctggcgtggttagtcccggctcgggctggagtggagaggtgttgtggaggccaggaggagcacaggacacggagtctagcccacctggatcacatccggacttcattgcttcctccctgtgtcatcgtgagcacgattcttcacctaccccagcctcagtttcctcatctgtaaaatggagtttctcatatcctgccccagagggcttttgcagaggttccatgaaataccatatgtgatatgattggggccccttccttgcctagagcacagagaagcaagtctaggggagcactgaggctgacctgtgggaaggggtgcagtctgacccagcctgagcgtggagtcactctgtgtgaatggcctgctggtctgaccccagtgctgctgacgttaacagggcctgcaaacatggcttttgcccttctcagaaacatgagccttcactagcaggctagactttgctctcttccacccgagcctctgccaggggctgcctcctgacctgagaaggtacgggctgggttgcctcctgacctgagaaggtatgggctgggctggcagatgggagaggaggccaggcaaagccagacattggggcaccctggcaggggctcaggcctgctgggcaggacccctagcaatggggcacggtggcctgtccccagaacttcagactgatggctgtcctggagaaggagctgggttttctatggatgccgacaaagctgggccagactgcagggtgccaccagtggaaatgatggctgttgtcttcctgagagtgagagagccctgtgggcttcactgtgatgggtggttcatggcatgactgccagagcaagactgctggcttcagtggctgtgtgccttgggacagatgacatagctcctttgcctcaattttctcatctgtaaaatgtgcatggtactagaacctaaggtgactgtgaagatcaaactaattaattcagagaaagtgcttggaaaaaactgattgccagctcctctggcccagaggactcaataaacattagctatgatcactttttctccctagagcctaattcagttgtttctattcttcaagtaatctccagtccagatcagaggcttagactcttcttccaccacaccccctgcccaccaactcccctggtagtccctgagctctgggcaaggcatgtggctacttccctttcctagggtcatgctgagcttttcagactggagctgtgtccacagtctccctttcagccatctcaacacccaccgtgtgcagaggctgagagggctaggagctctgtgctgggggttggaggctgtgcagatctgccagcccatcagagggagggcaagccacttgacctggggccctgccagtaatctggaggatccacctggcttcccaggtggcttctccctcttcagagagagccgtcacagaaaattctgtctcccatcccccaaaccagaagggaccagccccaccctcccctgggactccttcagggacactctgccttcccgtgtctctgggcttctcagcagcctcagtgcttactcaatctgaattgttctttatctgagaggcaggttcccaggctagcccattgttctgtacgtgggaggagaaaccgtgtacatctgtgactccaggaagagcaaagagaatttcttcctcctttcctgggtatggcattgttggcatccacattttgacaaaggttaaaaactttgcccttgacatcttccagcctctctgttgtaatcctgttccctctcccagagctcccacctacccgcagtggcctagttccagagttagcccctccccacctggaagtgatttatgctgtagtgtgagtgctggtaccctttagccttcccagaggacttgttttcaaagggatattgtgcaatgacagggacactgataggagagattttggtaataaagttggagcttgttcccctcccccaccttcacacacagctggagccctggccggctgcaggtgtgtcaaaagtgcagtttctgcctctgtgaaacttgaggacactttatttagcaagtacaagggggaggatgtccctagaagtccatctggcagaggtgccccggtccccaggtccggtggctacccattccaggggacctggtggggactgacagggctgggcttctcagtaagggccgactggggaaatcttggctgagattctgaccttggtgggctctttagggcagacagggctgggggagggacagtgctttggaggcttggctgccccctctgtccccatagggtgccagttgccccacggtcaccttgatttaggatatctctggcatcctgcctaagccatgactccccttgggaagctgagggtgatgataccaagtcagtgtgatcgagtgtccttgtgggtccctaagtggggggtgtttggcgagtcttgggagacagatcccttgtttggctctcggagcagaactaggcactgaggctgcagggcctgggttgggttgctttgctcatcgcctgcctggatgaaaccttgccctgcctggcctggcccgggttttgccagggggggaaagcagaggaactggtcttccagctccacggctccacgcccagccctcagctgagcctgttctgagaccagtcctggcatgtgggctgctgaggcaggcgccagctctgtggaagggtaggtatgggggtgctgggggcagcactggcttggcttgggcatcggagctggcatgaggctgccaggatccctcctccttcaataaacgcccccggtgtactgtgagcaggcagtgcggtgcagggcaaaaagcccagggctgggaggctcggctctgcgaccttgacctcaggcttcccatctgtaaagccctgacctcacactaaatggaaaatattacccgaaagtagtcttgaaggccaaatgtgaatgccgtccctccaccctggccctgccctggaagcccccaggacagtgaggggtccgtctccaagtggcagggtggggctgtgcttgggggtgccgtccagagtgtccccgaaaggtgctcctcctctcagaagtgctgctggggacagcctcctcttcctgcccatttctgtctccctcctgccctgggccgggcccatcactccctgcctgtcataccctcggcaggccccggcttgccttgttctcagtagagagccagtgagctgataaattgctgtgcctgtcaccggaaatgctgatgctgccttgaggccccagtgaggcccctcctcctgggaatggcttcagtgggggatttcgggtctggaggcccagaccccatctgcagcctcagcctgcctccctggcgggctgtgttttcccggctcctgagttcggaaaccagccttaggagaggagtgatgtgtctagcacttcctccacaaccccgaggctgggggagcccagtgtctcctggcctgtggccctgccctgctgcctactcccacgagtcccaccattttggccaaacctccgttgtacagatggacaacctgaggcaaggtgtttctggcaccaccccgtaatttagggacagaggccagactgtcaccagactatccccatgttggacctggtcattttccctgggccaccctctggtgatcagtgctgtgggtccctgaggagggggcatttggagagtcttgggggacagaacccctgtctagttcccagagcagcaccaggtgctaaagccgccgggccagcctgtcagccgtaaagcactttagcgttatccaccaagccccttctggcgtctaggtggagaacaggtctagagagaggctgaaagctgcccaggtccccagcacgggagccgcatggcggattccagccctttcccagagacccttgctcctgggtgctcggatatgacctgcctgctcagtgcttaggccgttttcagtccaggctgaaggaaagggtcacagggctccccacagagggaaggcagccacagatccacactgcagggcactgaggcgttcggaaggcagtgggactgggagagggtgttgcagctttttctcccgtgccctcccactggtacccctggaaaagcaggaccaggccctgcagcctgtgctgccttccaggcccagccttcgtccccggagcccacctgcctgtcagctccagcagctgtcttctgctcagccctgctgggtccagccgggccggctggtgggaagccagtgggctcagccccaggcacgaaggagcctcagcccagcttcaggtagacacttcccagtcatgtaggtgcttctggatgttcagtgggccttcagctcctgggggagggaggctgggctgccaccgtggtgtgctatctatgcgagtggacgtgtcggaaatgtagaggacattgctgagctttccctggtcctttggccactagagcttgttcacagggctctgttgctactcagtgccttgactttgaacactggactcaagtgaaacgagctcttgcctcctccaggctgggccactctgggggatgccttttcctcccctcattgttttcaaagtgcagtctgaagaccccctacaggacctggggcttgtgaatgacagagtcagcctctgggcggggaactcgaaagacttcatttgtagtggtctcctggtgattcttggggaccctgaagctgagagcccccagtctggatgcaggtgatggtttggttatcaccctcagccagtatggtgtcttgatgcagaggtgggggtaaaggctggggctctgcagctcagagatatcagcccccaagagtcctgaagtctaggggaggggagagtcagcctgttttccttgtatgtgtagatctgactgagaaaccaagggggtaaagaagatttctaaacaactgtgaccctgtttcaagcctcctgaggacatttgccattgtgtggaatctcgggatggggagggtgggtgtccagcctgccatgaccatgggccctcctgcctcatgacctcgcagcctgggcttctggaacaggtctgggtctctcctgtccactggccccagagccagtgccatggcccctggtccaggttgcttgtcaaaggtggtgacctagctcctttgataaggggcagctctttatccctggtttgttggggtttgttgattcagtgactgggctcccacagaagccggggatttcgtggccacacggggcaggtacagctgacagatcagcttccctttcctgctccaccacgaatgactgcgaatcagaggccccctgcgctgcccaagttagtgcctggggtgagcgttgtcttatcctctcctgagttggtttgggggcttcaaggcctggccttagtagtccccttagggaagccctctgtacttcagcctctgaagctccccctttttaaatccccctggagccggacacctggccatatgttctgaggagctgggagctctgccgggccaggaccagactgtttcttccctcttttctccaaaagctcctggcgtgatcttggctcactgcaacctccacctcctgggttcaagtgattctcctgcctcagcctcccaagtagctgggagtacaggtgcacaccgccacgcccagctaattttgtatttttagtagagacggggtttcaccatgttggccaggctggtttggaattcctgacctcaggtgatccgcctacctcggcctcccgaagtgctgggatcacaggcgggagccaccgcgcctagtagtaatgctttttaaggggtttgtgttttacccatcactcacttcaagcagcaggtgaccaatgtcagtgattcagggtgcgggctggaaaccaaaggccttctgacctggtggcctcaggctgatggcggggggtagatgggcaacctctcgggttagcgactgggcccgctgccccccgtccaacctgtctgagatgcccactggacatcctggcttctgaggcagccaaggcacttctgagctgtcttgcagaggagctgcagcgcagctgccccttagccccagggctggccaggacaaggggctctgctgagacggaggttgccaaggagagtggccctctttacctctgttacgggagcgaaagctggcagttggcttgaggctgccttctggaagcttctctgccagctctctgcccacagacttcagatgtgctctttgtaatggctggcagccggtgatgatgactccccatccctggtggcacaggtcccgttctggtctacgccatttcctctccacctctcaaatgtgggctggtccctgggtagcgtcaccactggggcaggctcagcgactccagctcagtgaaactccatcccactgaggagccttagacaggttttccttaaaactgattgggtcaactggtagggctggggagagagaaggggatggcaggtgaggagagcagtgctgctgcacggggagttgtagtgtctgggcggccttgggcaagtccctcacctttcagagtctctagtccttatctgctagagacagtgatctcagccccgctgcctcatctgcaggggagttgtagggaagaaagaggaatgggtggaaagtgtttccagccttagagaaggccgcactccttcacactctctttcttgctgggtcagagccctgaccccaggattctctccagggtccccagggtatggccaggagaccagcatggctgagatggagatgggctgacctgacccttactcccttactccctgtccccagactccaggcagttgcctcttgatcccccagcccctaggcgagccaaaccttgggctttctaatcagtgagcttctagggtctgcgctgtgggtggggaaggggcaaggcatcccttgctttgaacaacagaatgagtggaagcctagatcttacctagcacaaagttgttgattcgttctatgaacagttggttttcctgggacttacagaggttaaaggctggttagcctgttgccttcctgggcagggcattaggtagtctccaagctgaggccacctgttcctgagcagccttgagccgtggccaggcagcctcggaagcacccaggttggagatgatgctggggagagctacccaggaggcctagagggagtttgctgccggctgtcagcacagcaggcctgctaaaggaaatcgaaagtctcaccagaaactccgggagtcagctggcaccttggtaatccaagttcaaactcagcagtttctgctaatttcctcctcagggggctgaaatctcaccttctcatctgaggggctgtcccagaagattcaagctggagaagatttgggaggtctctctagcctgtccccttagtggagactgaaggcccagggaggggagaggcccccggaggccagggagctggtttcagtggagaaaacatttgcttaagagcttgttgtgtaaacaagattgcagagggataagccagccgaactgagggaacaaattgtttttagggacagggcagactgaaatgcttatctagtcaggaggaaagccctgctcttgggaaactgctaacgtgttggggcctccctggcgttcctgggtctcactgggcggtgtctcccaggttgtacatgggccccagtgtgtgtgtcttccctgtgggcttcggttgcctcattgttgaatggagcatggatccaatggttctagcttctgctgaaagattcggcactctacaatgcagcagaggctcgtggggtcgaagtgccagtgccttgccccatccctgccccatcttgagctttctcttgggggaggcggtgcagcaggagagggcagggcagagtccttggatgagagtgaagccatgatcccagtgagtatgggtgggggtgcccactctgtgatcccccggtgggcagtattctttgatgatgaaggagacaggttgagggaggccagggcagcttcagagctctgggaaggcagcacaggtgtttgaagcaccacatggagatgttgtagatcggatgtggccttgtgtggaggcggggggagcatggaccatgactgtttgtttttattgattgattgattgagacggagtcttgctgtgtcacgcaggctggagtgcagtggcacaatctcagctcactgcaacctcttgcctcccggattcaggggattctcctgcctcagcctcccaagtagctgggactataggcccgcaccaccatgcctggctaatttttgtatttttagtagagatgggggtttcaccatgttggccaggctggtctggaactcctgagctcaagtgatcctcccaaagtgctgggattacaggcgtgagccactgcaccagtcaagtcaatgactgtttattgtagatgggccatggtggactgtgactgttcattgcaggtgagccttggcggaatgtgacttgttactgtagatgggctatgaattgcccttctagggtcaaaacctttctcttgggggaaggaagatacagtttagcttttgtcctttcaaaggaagttcagtgttatttctgaccttgtggtttctacacgtgtctgacgcttccctctgacctaggcccctggacgtggagcctccacctggtctggctctgccccagggctgcctcaggaggcaggaggtcttgtctgtccctctctgctttgcactacccagaagtgagacccgtgggcctgtggccagggcctggcaaggcctcttgggctgaggaggcccttttcctttggagcccagcctcaggtgggccccctctgacaagtcagtgcagaggcttctggtgaacagacttcttcctgcccccgtcttctcatgaaactttatctacctccctttcaccctctttctagacaggcctgctggcatttgaggctcccctagttagacagtggccactgtttgtgggtgcccactgggtgccaggctgtgttaggcatagcttcattgaattttggcagcagtcctggaatgtagatgttattatttccccattttacagatggagagacagaagccataagcagtttaatgacatcccaggaccacgcatctagtgagtggcaggatccggagttcctaaagctagtgctctggactgtgctgttctgcatattttttcattctttgttctggtcccagacattggggccctctcaagatagactgtgtagtgagtggggtccttgggtctaagtctcgcaggtgaatagggctctcaaagccacacttctcgccacctggctgctgggttctctcttccttacctgaggtcttggggccagtgtgaagggcagaggcagtcctgactttctgccctccctgccgaccagggttctgcacaggcctgctcactgtgtgtggcgtgatcctgcctccccgcccccgcccccggtcctgccagtcagccccggcctcaggaactggagagatgtgtatatgtttgccctctggcccctttgcctcttggagctgggcaggcgggcagcattcctgggactgctgtttgccagcagggcgcgtcccaggcccacagcccacttcttggaggcttgtcagtgcagggccccttccagattagccttatatgtccccagcctgatggacaccctgtccttccttccccaaggaggatgatactctgaccaaagggcctgcacccagtctttactatagacaggaactgggccaagtgtgggaaggtgtatcagggccaggcctggggttgccctgtgtgggcagacctgcctcagaacagacagttccttgtgcccagccctgcccctgccccttgtgccgtcctcggtatccacacctgggggccagcatgcctggaggctgcctctgcatccaggttgtcctgagattgttcttgggggtttttgaaagcctctcagtggggctgggtcggcaatctttggccccaaagctccctggctgatggcccccaagagctggttcacagtgtagggtgggctgatggggtcccatggggaccacagcctctgttcccaataacagctccctgtctgcccttctgagaggtctggagctccctcaccagactgagcttctcagggtgagggccctgcctactctgttgtgcccctgcagccctgcacccagtaccaggctgtgttgtagcatcaggggatggggcctggggaccaaagtgctgcccagagctgagggtcctggagccacatgagaaggcttctccctgtgtacctgtgcagcacagggtagggtgagtccactcagctgtctaggagaggacccaggagcagcagagacccggccaagcctttactcataccatattctgatccttttccagcaaattgtggctactaatttgccccctgaagatcaagatggctctggggatgactctgacaacttctccggctcaggtgcaggtgaggttgtcatgggggccccccccacccaagacggcaacaggtcatgcctgggggcagtggtcaggcagtctcctgtgtttactgagcatgtactgagtgcaccctgcctgccctgtctccacccagctggctccaaagggcaatgctgaggagaggaatggggtccgtgagctgcctggttaaggagagctcatgctcggaggtgaggtgaaggctgtgagctccagaaggccccagggccgcctgctgcacgcaggctcatattcactaggaatagctttactcactaagaaacctctggaacccccttcagaaggttatttgactcctgagcctctgttttctcatctgcaaaatgggaataataccttgacctgataagcttgtggagctgtaaggcagcacagagccagctggggtgtagctcttccatccaagctcccttccttacttcccctttccctgtgggggactgggggagagaagtccctgagctggaggtggtcagggaagcttcacagaggaggtggctcttgagtggacctcagaagaggggtgagagagctaaggaaggaggctgaggtcatccctggggaagtgacctagcggaggcctgagagctgcaaggtaggatatctgttgttggaagtgtctgttgttggaagtgggggcctttttttcagggagggtggggccagagaagtgtgtgccctgggataagtaggataaccacagtagttatgcccctaagggatgcccaccccacccctgtggtcacagaaaagctttcccaggtggcctaggcacctgtctcgtggctccagagaccaggctgcacctggacacacacaatgggaagggacagctctccttgtccattttccaaggagcttagcctcagctgccttgtccaggtactagcctccctcatagcctgagcttggccagcccaggtgctctggagcctcccccgacccacccaacacactctgcttctggtcctccccaccccccacctccccaacacactctgcttctggtcctgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggtgagtggcctctgcattccttgggaaattgagtgggttggtcctaatgcctggcacttggcaggccctacacctgtgccctgcgggcatctcgtattcctcaccaggaagacagggcacaggggcccgccttcccctacccccagggcctcgcccagagcaggacagactaactatgagatcagagcagaagcacccttaaagatcacccaagagagggctccccaaactcacaatccaaacttgcagcccctgctgcaagagtgaacgttataccaagtccaattttttattttatagcttcgtgggaattttacgctttacactaaaataagtctgcttatttccatacaaaaatgtgtgctttgtatcactttttgtgatatccatgccatggtccagccagggtccggagttgatgtggcaagaaggcctggctttcgggccctgtgcgatcctggtttgggtgcatctgagtgggtggtggcaaagatcagggaggcaggagctgcttctgggtcttgtagtggagctggttgctgctgctggcggtgacctggccaacccaatctgcccctgccctcccacaggacttcacctttgaaacctcgggggagaatacggctgtagtggccgtggagcctgaccgccggaaccagtccccagtggatcagggggccacgggggcctcacagggcctcctggacaggaaagaggtgctgggaggtgagttttctttcaggggggtagtttggggtgaattgctgctgtggggtcagggtggggctgaccacagccaaggccactgctttggggagggtctgcagcagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaacggctgctgtggtggtggttgagtctcttcttggcctggcgatgtccagccgtgtcaccttctaggggtgggagcctggttctgggcaatgctctggcttggtacagaacagcagaattcatgctggtccctcctgtcgtggaagacagagtccatctctgccctcctcccccaaacccctgtgcaggcattcagcatctcgccttcctcctcccggggctcttggccctcctgcccagcactccttgttccttaaggctccactggatcattcccttcctcaaggacttgatgggctccctactgattctcaaagcttgctatttattctttgctcactgtgatttctgtacactcactagcaacagtctttaagtgccagaggtctaaaaaaaccatgtgcctagtagggaaaaatgacagtgaaagacctggaggttgaggcagcacgctgcaccgcaggggtccttagtgtcctagagcatctattatagctggcttcccagtcttgtccaggctgctggcccactctgtccctggtgcaggtcaccccctgaccctagaccccagaccccaggaatggcctgggccctgcagagcaggagggaccgtttcttccccgcccctgcacctgctgatggagcagggactgctggctccaggtggctttgcaggatggagaattctattcttcctgacacattgtgttccaaagggtttggaggccgagataaagttttccaggtcatttattcattcaacaaacactgaaaataccagtgcctatctcctgccagttcctggactggacagggagggcccacttgtagaattggccatcagatagtaatacttttattaataacatattaataaccctccacatgggacctgcaaggttccaagaccccagctccctgggctgcctgtccccatatatccaaatcaaactgcaccccgtcccacctcttggccctgcttgttcttaatgccctctcgcaactctgtgcttccattctgagtcccccaccccagggcacccccagggcagggctgtgccatcaaacagactgccgcatgtttgagactaacagtaaaaaaggtggaggtgtttaaatgtcatccttgggcaccccttcctcaagcagtgactgcccacctccccttgggcctcagcctgctgtcctgtgtcgcaaagcctaatccccatctcttcactttcccacttgccctgcctgggaggggagcagtgggcactatttcctttttccgttccctttacatcatgcccacagtctggc

SEQ ID NO: 15006 - DNA, 15468 bp, Human
ctcccagcgcacgtggagcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggtggccgcacccaagcaggggtcgaaagcccgggtggatgcggaacaaggatatgataggccttaagggtgggggatacctctgggctcgaaatcggcgggcggtgcaaaactcgaggtccagttctcggagcccatagagccaaaaaagcctcagcttgtccggggcgggttcttgaaagccggaaagcggctgagtaccacgcggcttgcatttttctcttgggacgctcgagaggtgggctccgtgagggcagctgctgcctgcagattatagggagccctttgcgcatttattaagaagctactggtgtatctcgggctgcgctaggcacggcgcatgcaaagatgaagcaggcagcatcccagcccttccgcacctcagacggtcagttgagtaggatccgccggtaccaactcctccttttaacaaatggggagaccgaaagctaggagacagtcagggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctgggctgactgcctgcctagaggtcctctcggatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttctagtattgcgatttaaagtctggcgctggctgcgcgccagacctgggaggctgccagctaggcttcacgttgctggcgtctgcttcggggcattcattaggtctgaagtctgaatcccagctccctccctctcacccactgagctgcatagctccagattgcctctgcttacgggcggggcttctcagccttctgccttctggcccgatgcccgcttcccaacggccggaggccgctagactaatcggcttcgccctgcgcgctgtaatgcgcatgcgcacgcgcacaagttcctgggcccgcccatcttccggacttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggtaagtgagagtctaccacactggaagcccataccttgaccccatcctctacccccactcctacccctagaactgtattattacatttcatgtaacagtatttagatttatgcactcattcggataactttctgtgaaacaaacttttgaaatatgataatacaccaaaagtgtatctgaaattaaaaagaatcaaaggttgtcaggctggagacccagttcctaaaattcattattctgtattaacatgcatggattgactaccaatgaaaaggaagggtccatgattttaaatgagccaaaattcttttaaagtgatttttgaattgaaaatgacaattcaaaaattgtcatttattggtaaaattatatgggaaatcataagttctcccactcaaatctcattgcccctgtgccttggatagcaattttgttatcaattatggagctaaaatttaattagaaaaaagaaattgtgagtaaagcactccttattacactattgaaagctgatttatatttaaaagaaattgaggcagcttacaacattaaaatgtctgaggcggggcacagtggctcatgcttgtaatgccagcactttaggaggctgaggtgggtggatcacgaggtcaggagatggagaccatcctggctaacacgatgaaaccccatctttactagaaatacaaaaaattagccgggcgtggtggcatacgcctatagtcccagctacttgggaggctgaggcaggagaattgcttgaacccaggaggtggaggtggcagtgacccgagatagcaccactccactccagcctgggcgacagtgagactccatctcaaaaaaaaaaatctgaagttaagatgtggagtgtctaataaaagtaaaatgatgaattctgggttctaaatagaaatggattcaagtgagaagggactaaagacagaaatgagctatgaaaaggcctcgtaacaacacaggtgactctacatatgttcttaggaaaggccacataatacaccaacttttattccttacccactagatgagaaattgatgctgttttccccacacctacaaaccgcctatgttttttctctgtgatggcctctggctcaggtgtgggtaagaagagtaactgacactcattatattgtggatgatttagggatagatctgcagcttgaataacttttggtaacgatagaccacatccagttgtattaaagctgttattggtgctcctggcctgaaatggacctatgaactttgagttgcaactataaggatattttttgccagtattatacactgcacaaacctatttatccataactgttagtattggttcatatatggaatcaaccagggaatagttcagattccatctctgaaagatgggcggaaatcagactttttaactttttaagtttttttttttgagacggaatctcgctttgttgccctggctggagtgcagtggcacgatcttggctcacttgacctcctgggttcaagtgattctcctgcctcagcctcccgagtagctgggactacaggcacccaccgccacgcctggctgatttttgtatttttagtagagacaggccttcaccatattggccaggctggtcttttttttttttttttttttttttttctgagaaggagtctcgccgtgtcgcccaggctagagtgcagtggcgtgaactccgctcactgctagctctgcctcccgggttcataccattctcctgtctcagcctcccaagtagctgggactacaggcacccaccaccacgcctggctaaatgtttgtattttttagtagagacggggtttcaccatgttagccaggatggtctcgatctcctgacctcgtgatccgcctaccttggcctcccaaagtgctgggattacaagcgtgagccaccgtgcctggcctggccaggctgtcttgaactcctgacctcaagtgatgtgcccgcctcggcctcccaaagtgttgggattacagatgtgagtcactatgcccggccagaacatttcttactaatttcaagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaactcctatagagctcgcttcagtggggagacagggctggagagagggtcagtgctatctatgtagggtgtaatctgtaagtcagcttttgaaatggggtgccctctactttgaatatctcgatactgtactaataaagtaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaaatgttttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacacacacacacacacacacacacacacacacacacagaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgactgcataaaaattgacaagctatagtaaaactgatagtatatgatatatatattatatatattttaaatattttgaaatattttaaaaaatacatttttaaaaatattttcgaatattattttaaaatatatatatatattttgaggcggagttttgctcttgtcgcccaggttggagtgcagtggcgcaatctgggctcactgcaacctctgcctcatgggttcaagcgattcttttgcctcagcctctcaagtagctgggattataagcgcctgccaccacacatggctaattttttatatttttagtagagacagggtttcaccatgttggccaggctggttttgaactcctggcctcaagcagtccatctgcctcccaaagtgctaggattacaggcgtgagccaccgtgcccagccacgcatatttattgattcatttatttttcttttttttttttttttttttttgagacggagtcttgctctgtcaccctggctggagtacagtggcttgatcttggctcactgcaagctccgcctcccgggttcatgccattctcctgcctcagcctcccgagtagctgggactacaggtgcccaccacgacgcctggctaattttttgtatttttagtagagacggggtttcatcaggttagccaggatggtctcgatctcctgacctcgtgatctgcccgccttggcctcccaaagtgctgggattacaggcgtgagccaccgtgcctggtgattcatttatttttcatgtttcatttcccttctaaggagatttgtgtgtgtgtgttttttgttttttaataattttaaaacattaaagggaatacaatgcctttaaatgtagttggagcttaaaattacctgcccaagatcttggataagggataagtttgtgaataattgttattctctttttttttttttttttttttgagacagtctcactttgtagctcaggctggagtgcagtggttcgatcttggctcactgcaacctctgcctcctgggttcaagcaattctcctgcctcagcctcccaagagctgggattacaggcacgtgccaccatgctcggctaatttttgaagttttagtagaaaggggtttcaccatgttgcccaggctggtctcaaattcctgagctcaggtgatccatctgcctcagcctcccaaagtattaggattacaggcgtgagccaccgtgcccgggcccataattgtctcttagttgataaacagtttattttcataaaactgttactatactttttttttgagagcatgtctcactctgtcgcccaagctggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaattggctagagaaacaggttagaatacagttaaaattcttagttttacataatgtaagtaaatgaaaatctaatctaaaagtgagtaatgactacattagtagtcttgaccatctaccaaaattgagtattcttcctccgaagataagagaattaggaaaatgaatcacaattactaatctgttggtacatgaaaataaatgtagtctgtactatttcttttagtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaaaaaaagaatgtgcctcaccttgcaaggcccaggccctaggatcacttgagctcaggagttcaaggccagcctgggcaacagggcaaaaccctgtctctacaataaatacacaaattagccaggcatggtggtgagcacctgtggtcctagctacttgagaggctgaggcaggaggatcgcatgagcctgggaggtcaaggctgcagtgaagcgagatcctgccactgcactccagagcctgctagcctgggtgacagagtaagagcctgtctcaaaggaaaaaaaaaattattgaaatagggaagctttcaacttggtggcattatttacctttgtggtcctgtgtggacctcaggtctatagaattaaaaaatgaatcatagccgggcatggtggctcatgcctgtaatcccagcactttgggaggccgaggcaggcagatcacgaggtcaggagatggagaccatcctggctaacacggtgaaaccccgtctctactaaaaatacaaaaaattagccgggcgtggtggcaggcgcctgtagtcccagctactcgggaggctgaggcaggagaatggcatgaacccggtagttggagcttgcagtgagccgagatcgcgccactgcactccagcctgggcgacagagcgagactccgtctcaaaaaaaaaagaatcataatctttagttcataacatattcttgtgattggtcaagcaaggccctcttgtttgtatttgtttaattaaataaaacctgtgaacccaccacccagctcaagaaagaaacacaatatctgtcaaataacattgttgaatcagaatttagtattctgctggtgtttggaaataagtggattctgtgctctttcccccagctatccctctgtccccctcacgctcccacttgagataatcctgagttaaggatgctatgttatcttggatttctttttaaaattcaatattatatttttaagaattatccaattttttttacaagtagctatagtttattttttgatagctgtgtaatattccattgtatcagtataccatgatttatccattcttctgttggaggacattggaaagattgtcatgtttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccctgctttttctgcctttacctatggtttcctatcatacagtgcttatgaggtgatcaaactcaaaggctacacatcctgggctattggactctctgtagcagatttggcagagagtataatgaagaatcttaggcgggtgcacccagtttccaccatgattaaggtaggtctatgtagtgatacgctgcatttgaatgctttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatacttgataatttgactacaaaaaagtcttgttcaattatgctgaggtaggtggaagactataaaagaaataaactatttctccattggggaaaatagaaattatattcaagttagcattatgttactatttttaatgactttcttttatactattaattaaatcataactgaacacctggaaaggaatttctacttatcaaagttttttatttttttgagacagtctccctctgtcacccaggctgcagtgcagtggccgatctcggctcaccgcaacctctgcctcccaggtttaagcgattcttctgcctcagcctcctaagtagctgggactacaggtgcgtgccaccacgcccggctactttttgtatttttagtagagatggagtttcaccatattggctaggctggtctcgaactcctgaccttgtgatccacccgcctcggcctccccgaatgctgggattgcaggtgtgagccaccgcacctggcctcaagttgtattttaaaatcttcataattaggccacacacagtgactgacagctgtaatgccagcactttggaaggccaagggcaggagaattgcttgagcccaggtgtttgagaccaccctaggcagtatagtgagatcttgcctctgttaaaaaaaaaaaaaaaaaaaaaaggccatgtgcgggcagctgatgcctgtaatcccagcactttgggaggccaaggggtggatcacctgaggtcagtagttcaagaccagcctgaccaacatggtgaaaccctgtctctactaaaaatacagaattagccaggtgtggtggcaggcgcctgtaatcccagctacttgggagactgaggcagaagaatcacttgaacccaggaggtggaggttgcagtgagctgagatcgcaccattgcactccagcctgggcaacaagagtgaaactccatctcaaaagaaaaaaaaaagcggctgggctctgtggctcatgcttgtaaccccagcactttgggaggccaagaggtggatcacctgaggtcaagaatttgagaccaacctggccaacatggtgaaaccccatctgtactaaacatacaaaaattagccaagtgtggtggcgcacgcctgtagtcccagaaggctgaagcaggagaattacttgaaccctggaggtggaggttgcggtgagctgagatcgtgccactgcactccagcctgggcgacagagcgagactctgcctcaaaaaaaaattaaaaaaaaaaagctttataattatagagactgtaagtcttgggaaacctgggaatgcatagacaaaatgtgagattttttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgcacatttttctgaaaatacaactgtgacccttatccaggcctgaaaaccatacttgtaaaggttaactgaacaacattattgtcattcccaactccaggatctttttccaaagattctttcctgagagctagttaagggaaggaattatcttaaagcctggttgtccaatcttttgctttccctgagccacattggaagaagaattgtcttgggccacacattaaatacactaacatgtgccagctgtggtggctgacacctataatcccagcacttggggaggctgaggcgggtggatcaggagttcaagactagcatggccaacatggtgaaaccccatctgtactaaaaatcgaaagatttgccaggtatggtggcctatgcttgtaatcccagctacttgggaagctgaggcacaagaggctgaggtgagaggatcgcttgaaccggggaggcagagattgaagtgagccaagatggcaccactgcactcgagcctgggcaacacagcgagactgtctcaataaaaattaaagaaattaacactaatgatagctgatgagctacaaaaaagttcatgatctggatacctgctgccacctaaagagtcctcacattcaaagggttggacacagctataaagcgtatcgttctgtggatttttagtgtattcacatagttggcaaccatcaccagtatctaatcttagaatataggctgggtgcagtggcttcaaattcccagcactttaggaggccaaggtgggtagattgcttgagcccaggagttccagaccagtctgggcaacatggcaaaagcctgtctctacaaaaaagaaattagctaggcgtggtggcaggtgcctgtagtcctagctgcacaggaggctcaggtgggaggatcccttgaacccgggagataaaggttgcagtgagccaagatcccaccactgtactccagcctgggtgacagagtgagaccctgtttcaaaaaaaaaaaaaagaatattttaattagcacaaaaagaggcctgtacttaatcctgtagccttttgtaaactttgagtcaccttcagtctttaaaatttttaaatttacattaattttatattatttgatacaataaattagtcaataccaacatgactgaaaaataatatttaagtgaaatagactgattctattaatctttcatgaattttcaaatgcaatcttgtaaagtttccttacttatgggcaaaataaatgttccaggttcagtttgtaccttcctgccccaggcaaggaataggccaactctgcaaagaaacttgattttttttttccatagtaaccttgggaactaaattaagcaggccttatccccatctcacagaagttgccagttagtgtagaagcaaatgtgatgctcagaacatggttctacttcctttttttcccccactaaagcccat

SEQ ID NO: 15007 - DNA, 10879 bp, Human
tcggcctcccaaagtgttgggattacagatgtgagtcactatgcccggccagaacatttcttactaatttcaagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaactcctatagagctcgcttcagtggggagacagggctggagagagggtcagtgctatctatgtagggtgtaatctgtaagtcagcttttgaaatggggtgccctctactttgaatatctcgatactgtactaataaagtaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaaatgttttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacacacacacacacacacacacacacacacacacacagaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgactgcataaaaattgacaagctatagtaaaactgatagtatatgatatatatattatatatattttaaatattttgaaatattttaaaaaatacatttttaaaaatattttcgaatattattttaaaatatatatatatattttgaggcggagttttgctcttgtcgcccaggttggagtgcagtggcgcaatctgggctcactgcaacctctgcctcatgggttcaagcgattcttttgcctcagcctctcaagtagctgggattataagcgcctgccaccacacatggctaattttttatatttttagtagagacagggtttcaccatgttggccaggctggttttgaactcctggcctcaagcagtccatctgcctcccaaagtgctaggattacaggcgtgagccaccgtgcccagccacgcatatttattgattcatttatttttcttttttttttttttttttttttgagacggagtcttgctctgtcaccctggctggagtacagtggcttgatcttggctcactgcaagctccgcctcccgggttcatgccattctcctgcctcagcctcccgagtagctgggactacaggtgcccaccacgacgcctggctaattttttgtatttttagtagagacggggtttcatcaggttagccaggatggtctcgatctcctgacctcgtgatctgcccgccttggcctcccaaagtgctgggattacaggcgtgagccaccgtgcctggtgattcatttatttttcatgtttcatttcccttctaaggagatttgtgtgtgtgtgttttttgttttttaataattttaaaacattaaagggaatacaatgcctttaaatgtagttggagcttaaaattacctgcccaagatcttggataagggataagtttgtgaataattgttattctctttttttttttttttttttttgagacagtctcactttgtagctcaggctggagtgcagtggttcgatcttggctcactgcaacctctgcctcctgggttcaagcaattctcctgcctcagcctcccaagagctgggattacaggcacgtgccaccatgctcggctaatttttgaagttttagtagaaaggggtttcaccatgttgcccaggctggtctcaaattcctgagctcaggtgatccatctgcctcagcctcccaaagtattaggattacaggcgtgagccaccgtgcccgggcccataattgtctcttagttgataaacagtttattttcataaaactgttactatactttttttttgagagcatgtctcactctgtcgcccaagctggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaattggctagagaaacaggttagaatacagttaaaattcttagttttacataatgtaagtaaatgaaaatctaatctaaaagtgagtaatgactacattagtagtcttgaccatctaccaaaattgagtattcttcctccgaagataagagaattaggaaaatgaatcacaattactaatctgttggtacatgaaaataaatgtagtctgtactatttcttttagtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaaaaaaagaatgtgcctcaccttgcaaggcccaggccctaggatcacttgagctcaggagttcaaggccagcctgggcaacagggcaaaaccctgtctctacaataaatacacaaattagccaggcatggtggtgagcacctgtggtcctagctacttgagaggctgaggcaggaggatcgcatgagcctgggaggtcaaggctgcagtgaagcgagatcctgccactgcactccagagcctgctagcctgggtgacagagtaagagcctgtctcaaaggaaaaaaaaaattattgaaatagggaagctttcaacttggtggcattatttacctttgtggtcctgtgtggacctcaggtctatagaattaaaaaatgaatcatagccgggcatggtggctcatgcctgtaatcccagcactttgggaggccgaggcaggcagatcacgaggtcaggagatggagaccatcctggctaacacggtgaaaccccgtctctactaaaaatacaaaaaattagccgggcgtggtggcaggcgcctgtagtcccagctactcgggaggctgaggcaggagaatggcatgaacccggtagttggagcttgcagtgagccgagatcgcgccactgcactccagcctgggcgacagagcgagactccgtctcaaaaaaaaaagaatcataatctttagttcataacatattcttgtgattggtcaagcaaggccctcttgtttgtatttgtttaattaaataaaacctgtgaacccaccacccagctcaagaaagaaacacaatatctgtcaaataacattgttgaatcagaatttagtattctgctggtgtttggaaataagtggattctgtgctctttcccccagctatccctctgtccccctcacgctcccacttgagataatcctgagttaaggatgctatgttatcttggatttctttttaaaattcaatattatatttttaagaattatccaattttttttacaagtagctatagtttattttttgatagctgtgtaatattccattgtatcagtataccatgatttatccattcttctgttggaggacattggaaagattgtcatgtttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccctgctttttctgcctttacctatggtttcctatcatacagtgcttatgaggtgatcaaactcaaaggctacacatcctgggctattggactctctgtagcagatttggcagagagtataatgaagaatcttaggcgggtgcacccagtttccaccatgattaaggtaggtctatgtagtgatacgctgcatttgaatgctttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatacttgataatttgactacaaaaaagtcttgttcaattatgctgaggtaggtggaagactataaaagaaataaactatttctccattggggaaaatagaaattatattcaagttagcattatgttactatttttaatgactttcttttatactattaattaaatcataactgaacacctggaaaggaatttctacttatcaaagttttttatttttttgagacagtctccctctgtcacccaggctgcagtgcagtggccgatctcggctcaccgcaacctctgcctcccaggtttaagcgattcttctgcctcagcctcctaagtagctgggactacaggtgcgtgccaccacgcccggctactttttgtatttttagtagagatggagtttcaccatattggctaggctggtctcgaactcctgaccttgtgatccacccgcctcggcctccccgaatgctgggattgcaggtgtgagccaccgcacctggcctcaagttgtattttaaaatcttcataattaggccacacacagtgactgacagctgtaatgccagcactttggaaggccaagggcaggagaattgcttgagcccaggtgtttgagaccaccctaggcagtatagtgagatcttgcctctgttaaaaaaaaaaaaaaaaaaaaaaggccatgtgcgggcagctgatgcctgtaatcccagcactttgggaggccaaggggtggatcacctgaggtcagtagttcaagaccagcctgaccaacatggtgaaaccctgtctctactaaaaatacagaattagccaggtgtggtggcaggcgcctgtaatcccagctacttgggagactgaggcagaagaatcacttgaacccaggaggtggaggttgcagtgagctgagatcgcaccattgcactccagcctgggcaacaagagtgaaactccatctcaaaagaaaaaaaaaagcggctgggctctgtggctcatgcttgtaaccccagcactttgggaggccaagaggtggatcacctgaggtcaagaatttgagaccaacctggccaacatggtgaaaccccatctgtactaaacatacaaaaattagccaagtgtggtggcgcacgcctgtagtcccagaaggctgaagcaggagaattacttgaaccctggaggtggaggttgcggtgagctgagatcgtgccactgcactccagcctgggcgacagagcgagactctgcctcaaaaaaaaattaaaaaaaaaaagctttataattatagagactgtaagtcttgggaaacctgggaatgcatagacaaaatgtgagattttttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgcacatttttctgaaaatacaactgtgacccttatccaggcctgaaaaccatacttgtaaaggttaactgaacaacattattgtcattcccaactccaggatctttttccaaagattctttcctgagagctagttaagggaaggaattatcttaaagcctggttgtccaatcttttgctttccctgagccacattggaagaagaattgtcttgggccacacattaaatacactaacatgtgccagctgtggtggctgacacctataatcccagcacttggggaggctgaggcgggtggatcaggagttcaagactagcatggccaacatggtgaaaccccatctgtactaaaaatcgaaagatttgccaggtatggtggcctatgcttgtaatcccagctacttgggaagctgaggcacaagaggctgaggtgagaggatcgcttgaaccggggaggcagagattgaagtgagccaagatggcaccactgcactcgagcctgggcaacacagcgagactgtctcaataaaaattaaagaaattaacactaatgatagctgatgagctacaaaaaagttcatgatctggatacctgctgccacctaaagagtcctcacattcaaagggttggacacagctataaagcgtatcgttctgtggatttttagtgtattcacatagttggcaaccatcaccagtatctaatcttagaatataggctgggtgcagtggcttcaaattcccagcactttaggaggccaaggtgggtagattgcttgagcccaggagttccagaccagtctgggcaacatggcaaaagcctgtctctacaaaaaagaaattagctaggcgtggtggcaggtgcctgtagtcctagctgcacaggaggctcaggtgggaggatcccttgaacccgggagataaaggttgcagtgagccaagatcccaccactgtactccagcctgggtgacagagtgagaccctgtttcaaaaaaaaaaaaaagaatattttaattagcacaaaaagaggcctgtacttaatcctgtagccttttgtaaactttgagtcaccttcagtctttaaaatttttaaatttacattaattttatattatttgatacaataaattagtcaataccaacatgactgaaaaataatatttaagtgaaatagactgattctattaatctttcatgaattttcaaatgcaatcttgtaaagtttccttacttatgggcaaaataaatgttccaggttcagtttgtaccttcctgccccaggcaaggaataggccaactctgcaaagaaacttgattttttttttccatagtaaccttgggaactaaattaagcaggccttatccccatctcacagaagttgccagttagtgtagaagcaaatgtgatgctcagaacatggttctacttcctttttttcccccactaaagcccat

SEQ ID NO: 15008 - DNA, 47403 bp, Human
  misc_feature (1)...(47403): n = A,T,C or G
gcactgtagtttgcctaaaaatgaggtgcctagaactgagcataatactccttaagtagttagatgagcccagaatagagtagaaacactaacttcctggatctagacactaagtttctatattacaacctaaaaacagtattagttgtgtttaagtggccatgttacacattgattcaacagagcaagtggtcaactaaaacccaaagaaattgtttacataaataaaatcttcttagccagtagctacatacagtagaactgagctcaaattgaaagctgctattaatcaaatgcaacaatggatataaaaagtacctagaaatgtacaaacagtataaagaggaacagcagaatgctgataattgttcaagttgcgttaagtgtacatgagggttcaatttattatcctacttttgtctgcgtttgaaattttccacaataaaatttaaaaaatatatacataatattgtacaagccttcaacagctctatttcttgaaaatctgttatctcctccctgcttctttttccagccttatttcccatcttaacctctctattctccaactacattggactcgactctttttttctttttcattccataaacttgctgtgcctccatggtttaatatatgatgtttatggaatcttcccccatttaccaaaaccctacctttctgcaaagctgagtttaaatgttacttctgtgaaggcactctaccaaaaactaagaacatagaagttggcgacaaatgcttaaccaaagtaaatgaaacaacttttgggagactggcttgcccaaggatcacagagttcataaatggtagagctgagattagaatacgcgtctcctgaatccaaatctcatctttccattatcgtaaaatagttcagtgtttgttgctcacacatcaaatgcaaacatgtttctcttttgccccagtaggtgcgtggaggaagaggagaaagaagtaagaaagatagcaaaaattgaagaaatgagaaggggaagttgcagactgcctcattttcacaatgggatctttctatccaagaagaaatgatcagaaaacaactctctgcctcagacaaatggcgactgactcatttatacattcattcattcaacattctgagtgcctactatgttccaggacctgaacacaccgctagagacacagggatgaacaaaacacaatccctacccacaaaaagctccttgcctagtggaactactacctttttaacagcagtaactttaatatcttgagatttcttgagaggagacccagtaaccaattttcaaagccaggctcacagaccagcagcccggaggtcccagcccagctccaccacatccagggcagtacctcgcagctctcagtagatcggatcttgtctcccggcttagcgccggggaactcaccgcgcactaagagcggaacgtgaacttcagtctcccctcgcgttcctccccttccttgctgacgtcatccaggagagccgcagactggaaacaacgctactaacggcacttcctcatcacgtgacgagtcacgcccctccttgcgcgtggtccctccccctcaggccgcggtcgcgattacgctctctacggcctgcggccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctggtaagtttagaccgaagaatgcaggcgggcgggtgggtgggcgggtgaggagctgacaggcctgggggccgctggacggcgtggattctacccctgttcccagcgtcgctgtcgccgtcctcccaacgcccaagcctggcgtcttgtttgcccttatcccgaggcgaggaagaggcgacccctaatctacttgtctaaaggaaacctgctcttaaattgagagcaggtttacccaaagccaggatcagatttggcttatgagaatgaagtggaggcctctcccagacagagaagcccttcccgtcaggaaatgtgctgttgagtctgggattctgtaagagaaaagctgtcaccttgttgtctgcacaccttttgcttccacctgtcaatcttacctctcttaaaaaccttaacacgtgccagtccacacactcctagttttggtcatttgattgtcgtgtaatgatgaaaaatagaccatgagtacctggatatatgtaattattttgtaaatcccccagtgttctcaaaggccaaattaaataaggaggtgacttttcttatttttttttaagagacagagtcttgttctgtcgtcctggctggaatgcagtggcgtgataatagctcactgtaacctcgaattcctgggctcaagcgattctcctgcctagacctcccaaagcgccagaattatgctacagtgcctggccccaaatgactcctaaactccaattttagcatcagtaaaatggggatggggaaagaagatatgaaaaatacaccctttgtccatttgaagacccagtcttaaaaacaaaaacaaaaaaaaaactgagtggtttgaatgaaatgtgctttgcagtgagtattgactccatacaaaccaatatccagacttgtgattttcaaacattttaaaggagtggaacaatttctccccatgaatttttatctggaacccaatatataaagcagcatgctctggtggaactaaatttaaaagggccaggccccaccaccccacttaacttctatcctagaggccactccttggaacacagtttgaaaaccactgaactggacttaggtaattaagccaaagttgccaaccttaagattttttaaaagacaaaaccagagcagttgagatggagaggtcacaaccgcagggaaggtaacctctagtagcaggccttggacttagagaaggactaaactctggagagaactttgtacctgttagcaggcttaagtccctcattcagaaaggagaaaaaagagatggtctgctatcctcactcagccgacatttttttttttttttgagacggagttttgctcttgttgcccaggctggagtgcaatggcgcgatctctgctcactgcaacctccatctaccgggttcaagggcttctcctgcctcagcctccccagcggctgggatcacaggcgcacgccaccatgcctggctaatttttgtatttttggtagagacggggtttcaccatgttgaccaggccattcagccgacttgtagcagtgcaacagattggtaagtttgagtctctcttaggtgatataaaatacacattgcagtacaaatgtgaaaaaaaatcaaagcaaattcagagagggcttttgaaaaatactaggaaacttggtgcagtgtgggagaagaatcagttaaaagtagtgaagccagcgaccagcaccagtcctgggttgtgaatgcttcctgtgtgtactgccctcaaggcttgtaacttctccctgctggtaccatgtgtcctgccctctgataacctgcttctctgtgctattttattccctaccatcagaatgttgtctggcataccttgagctttcctagcattttggccaccatttatctctgccttatgcatactgctgatagagatgtctttgtgcccttcctttctctttcctgccttcagtgtggcagtatcagccattgacctagtagttcctcttttcaccactttgattaccaactgattactcttctctcaattttggtaatatactcttgtcagcatgcagtatttattaatggatatgagcatattttcttctgtcatgcatctctgtcgcattttcctcctgcctcttccctgcactgctgtaaaatgtacaagtgctcagtcctaaaattgccacatcagttattctccttaatatcttccttgtctgtgaaattatccttaaaacagtacattttggtcactctttacatacttataaagttattccctttaatgctgaattgttcaaacacttttggattgcttgatggcaagcagcattccaaatctccatttttgtatgctggcagatataacagtgctctctagtaatccttctttcagaagatttctctttcacttgttgctccctatctcctctcctccatttatctcttgcacattggaaaaggggatgtaggtaatggaaatgcagaggtgcagtaatgtaaagatttgtattcaaccagttcatattcttccttatcactgttgccttttaagagcaagatccagttattagaatctgtatgagaaatggtacattgatctgtgaattgaaaactatagtggttcccggagtttaggcaaagatgtatatgcaaagattccttattatgtcttagcaagagattgtattcttttaacagcaagatcttaaatgatgtcattgatacttcttggactcttcttataggccaaacactatattactgggtgctatattacagagaacccgacatatatggcctctgccctcccttatgaagcttgcaatctgtcaggagacgtgtacattaaaagaatcacattaaaaattatgttgttgtaagtgccatgaagaaaataataggagactttagctggtaactttgaagcttaacatagactgaaaaaaaaaatgagtgaaagttagccagttgatgggaaaggaagagaatgtacaaaggctcagagcaaggtatatgaatttagattcggacaaatacatttttaactgcaaataaattaatgcctttaatatagatcttgctatttaaggaagtcttagaccatttcataagtaaatagtcttttagtaaagcgagatcttcattgacctgatctgtttaaatgtagcctacaccaataactttcataaatttctatggctcttatagagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcggtaatttatctcagatttattttttaaatttccccataaatgaattttgatataaatggttttatatgttatatataagaggttatggctgggcgtggtggctcacgcctgtaatcccagcactttgggaggctgaggcaggcagatcacccgaggtcaggagtttgagaccagcctggccaacatggcgaaaccccatctctaccaaatgtagaaaaattagcgaggtgtggtggtgcgtgcctgtaatcccacctatttgggaggctgaggcaagggaatcgcttgaatccgggaggtggaggttgcagtaagccgaaatgaggccactgcactccagcctgggtgacagaacaagactccttctcaaaaaaaaaaaaggttatgtttttcccagttgctgtagtcagttctgtctcatgatgtattctccactttgcagtttctgtcttcatgcatttttttaccttctcaactcataaaggtctttgtattattttccaatactaacactttatttgtgcctgtaagtccagttaattggagacttgctctatcagctgtccttgctcactgcttttcttccaactgctgacatacttaaaattatcctacttaagtaggataatgaagtatcaacatacttaaaattatttgccaacttccccgtcagatcctcccctcatctttcttagattttaattcatttttcttaaaacatatgtttcctaatttgtatggtttgcagtccagtttcatattctacagagtgggctttttaaaatatgttctctaactcccaacctcaagtgatccacctgcctcaaaacctcatctctactaaaaaaaaaatagaaaaattagctgggcgtggtggcagatgcctataatcccagctacttgggaggttctggcagaagaattgcatagttatatgtttattgtaaagaatactagaaaatgaatgttaaaataaactattgaaaatagaaaacactgttttcaaattctcacactagcacccctaacactttcctgggttacctttataaacatttggtttgatagagaagaaactcttgggaagacttttttttttaataactgctctagtataaaatacataattattatagatcagaaaagagaacatttaaatcatctgtatttttatcacccatagataatcattattaaatttggtatctatcccttcattcgcatatattttcagagtaacatagtgaaatttcaaagacagactgacccagattcaaacccagttctgctacttccctgatggtttaagaaagcctcttgatttctcagacccagtttccttatctacaaaatgtaactaataatagaacctacctcatgggattattaactggggactgagataatgcctataagaaacttagtgcagaacctgacacattattaagcattcagcaaattctagatgatggagaatactctgtcacccagactggagtgcagtggtatcatcacggctccatctccctggactcaggtaatcctctcatttcagcctcccgacttgctgggactacagatgtgtaccaccaggcccagctaatttttatagtttttgtagggacagggttttgctatgttgcacgggctggtcgcaaactcctggtctcaggcagtctgtccgcctcggcttcctaaagtgatgagattatagacgtgagccaccctgcccagcctaaattttagatttttttaaatttaagaatatggggcaggccgggtgtagtggctcacgcctgtaatcgcagcactttgggagactgaggcgggggatcactaggtcagttcgagagcagcctgataacatggtgaaaccccatctctactaaacatacaaaaattagccagccatggtggcatgtgcctctaacccctagttactgaggaggctgaggcaggagaatcacttgaactggggaggcggaggttgcagtaagccaagatcgggccactgcactccagcctgggtgacagagggagactccatctcaaaaaaaaaaaaaaaaaagaatatggggccaggcactgtggctaacgcctgtaatcccagcactttgggaggccgaggcaggtggatcacctgaggtcaggagtacaagaccagcttggccaacatggcgaaaccccgtctctactaaaaaatacaaaaattagccgggcgtggtggcaggaacctgtaatcccagctacttggggggctgaggcagggagagtttcctggaactgggaggaggaggttgcagtgagccaagatcacgccactgcactccagcctgggtgacagagcaagactccatctcaaaaaaaaaaaaaaaaattttatggaatcatgccaggcatggtggctcacacctgtaatcccagcactttgggaggctgaggcgggcggatcacttgcgtccaggagttcaagaccagcctggctaacacggcgaaactccatctctactaaaaatacaaaaaattagccaggcatggtggcacatgcctgtagtcccggctactctggaggctgaggcaggagaatcgcttgaacccgggaggcggaggttgcagtgagccgagatcgcgccaccgcactcctgcctgggtgacagtgagactccatctcaaaaaaaaaaaaagaatatggaatcaaactacatgccttttttttctgtgtatcttttcatgtcattaaatagtcttaaaacagttttttaaacttcaagaagggaaaactctcaaagtcttaagacatcaaataagtcagttaaaaggtggtatcgtttattaagaattgtgatcctttatcatatttgatatatggatatcaaaatgggattgtaagaaaacaaattctcagtggtgagtaaaaatcacaaaataatggacttgaatgtattttatgattacatttgtaaggtgggtacagataaggtaagcacaattaaaaatgaggaaaattgatgttagggttgtgacatggaattttttaaatccctttttaattaaaagcagtcatctaatcgggctttattccagcgtttgcaaatgcctacataatgcagactatctccacctgcatgactcagcagtacctcacattcatcatgtccggaactgaattccttatcttcactttcaaatctgctcttccttctcattaatttctgaaaatggtaccactgtgctcatgtcagtaaggctcagaaatggggtatgggcaagcaaccatgacgcttccttcagcactttaacaatgtctgttcattctgctgcttcagtggtcctccttgtcccttcctctccagtctctcctgctgctcacagattaatttctaaaatacaaatcactcccctattcaaaagtcttcagaagttttctgttgtttgccacatggggtggccttctccactatatgcctccatcttaaccatccaacctcatatcctactgatctcatgaaccttatgctatatcctaagcagattactcattcctagagagtttcagtccactgccccaaactatttcctttgcctctgacacctgtttccctttactttctctgtagaagtcgtctcttcaagacccaatttataaccaaactatgtattaaacagaatgaactgatacatatacaacaatatggtggatttcaaaaaacatgttaagcaaaaaactagagacaaaaggagtacatactgtatgattcctttcatatgaaatcctagaacagataaaaactaatctgtggtgatagaaatcagagtagttgctagaggttggggaaaagagattgacctgaaggaaacatgagggaatgttcaagggtgactgaaatgttctgtctctcattttgggtaactgtaaatgggtgtgtactatagtcaaaacgcatcgaacagaatgcctaagacctatgtatttgttggtttgttaattatatcttagttttttaaaatggctttttaaaaattctgtggcaaacatttctcatggctttctgagtgaagaaactgcctcttgagtcctaacttggaacatttttgtgtcccttttgggacttcatgtcgtgggtagcaactgtctgaagctggtggcaccagtaataaaaagaattcaccaagacagttgtaggtaaagaaaggcagatttgttagagaaagtaggaaaatatgttgcaagaaagcaacgtgcagattagcaagcggagagctgactgcaaggagacaaaagcttccaggggattttataggattgtacttttgttgaagagggctacatgaagtactgctaacaccaaggctgcagtgagctaacttgcatttttctatccgctgaggttctggtgataagtggggcacaggaagattgtgaattatttgcacgggagggctatgtgtcctggaccatgaagaaaggctgacttgtagcttatctgctttttctttttgctttcccctgctcccaccagcctgactccttttccctaattaggagtctacacacattctaattagtatacactaacaaatagcacacatatacacacttgctcactgccctggaagatctttgaaagcagaaatcaacagacgttcatctttggatagtccccaggctccttggctcagtacagatttgttggataaatgtattcacattgacctatttcctttctgttctcgggatagaatagcctgtaaagacctataaaaggggtatctgactactcatacttgagataatcaacttcagagaaagtaaggtttcacttttttccctgtattttttatttctaactcattgtttgagcgaataagaagtaataattgttttaatccagtggtttgttttgttttgttttgaggcagggtttcactttcatccccaggctggagtacaatgttgcgatctcacctcactgcagcctctgcctcctgggctcaagcgattctcctgattctcccgcttcagcattccaagtagctgggactgcaggagcacatccttttgcccggctaatttttgtattttttgtgggaatgggtttcaccatgttgcccagactggtctcgagctcctgagctcaagtgatccacctgccacagcctcccaaagtgctgggattatagacaggagccaccgtgcccagccatatttattaatcttaagaggtgttggtttgctgggcgcagtggctcacacctgtaatcccagcactttgggaggccaaggcgggtggatcacctgaggtcaagagttcgagaccagcctgaccaacatggagaaaccccgtctctaccaaaaatacaaaaatagccaggcgtggtggcacatgcctgtaatcccagctgctcgggaggctgaggcaggagaatcacttgaacccaggaggcgaaggttgtggtgagctgagatcacaccattgcattccagcctgggcaacaaaagtgaaactccgtctcaaaaaaaaagaggtgatggtttaagtagttttttgggggttttttttttgtaactttattacaagaatttctgatttctattgtttttaatccctgccgtactccccttcctaatacttattttcccattatgttcaaatagaagttctcaattattttggagaactaatggcagatccagtatttcattgttcccattttatttgtttagagacacaggtctcactcagtcacccaggttggagtacggtgtggtgattatagctcactgccgcctcaaactcctgggctcaagcaattctccccctttggcctcccaaagtaattagacctattttttgtacagacggggtctcactttgttgacaaggctgatctcaaactcttgggctcaagtgatacctcctgccttggcctcccaaattgcggggggttacaggtgtaagccacatcacttggcctgttttcattagttttaaccctcagaaaaatgttgcggtaaagcttcacttatttgcccagggcaaacgtaattgttaaattatattttggccattcctctggggatgaaaactaaagtcataacttcaccagaaatggcatatatgtggcattggtgccacaactttccccatcctggcccatggcagacagcaccatcagtcagcagtttttctcactgagtccagacagccacactcaagcctggaggatttgggttgggcatttaagattctcagaggcaggggatggaggtggagggaccagactctttcttaggtaactagttaggcattataccaatgaatcatggccaagacgtggagagcagttgaagacatttgaatgttaaaagataagaaattagcatgtgaagtgttaaatatttagttctctcagttttatttatacagaagaaacagaccagaaatcaggaaactttggtgtggtttcagctctgggagtggttctgggaagtccccacatatcttgcagactttagtttcaattgaaacaaatttgaactaaataataaatatgactgtaattctacagttttacaattgtaaatatagactatatgaaagactacacattttcaaattgtgtgtgtataagaatataactgaggaaaataaattaataatactcattagcatataagtattgtataaatttacacctgtggtatgagcaaaatgaaatttaattgtagaggaatgatgccgtgcaactttatcttcaactttgaatgagaaaagagactttcttcttccccgttaatttcctacagtttagattttatatttgaaagggactctagaagtcaacaaattcaaccctaattgatgtgtggaatagtttttttcttcatcttttttttctctcttagcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacatttctgcaaagaatttcctgtttaatagttgatgtgtttttttgtgttattgttggtagggacagagtcttgctgtgttgcccaggccggtctcaaactcctggcctcaagcaacactcctgcctcatcctctcaaagttctgggattatgttataggcatgcaccaccatgcttggccaggtttatgcatttaaaatgctgatagatgatgccagattttccttcactaaaattgtaccagttaggcaagttgtctgatctttgcttatgtggccatcttctgttgagaagactcaaccttatagtgaatgtaggtggtggaatctctttttataaatttcaggcatgggctaggtgcaatggctcacacctgtaatcccagaagtttgagaggccaaggcgagtggatcacctgagatcagaagtttgagaccagcctgctcaacatggtggaaccccatttctactaaaaatacaaaaattaagggccgggcgcggtggctcacgcctgtaatcccagcactttgggaggccgaggtgggcggatcacaaggtcaggagatcgagaccatcctggctaacacaatgaaaccccatctctactaaacatacaaaaaaattctctgggcatggtggcgggcgcctgtagtcccagctcctcgggagcctgaggcaggagaatggcgtgaactcaagaggcggagcttgcagtgagccaagatcgcgccactgcactccagtctgggtgcgagactccttctcaaaaaaagacatatatttctgagagaatgccctacaaatttctgttactagctaatagccttagctactaacatttctgtaacaatagacttataaattagcagtattagcgtctctctcaaatgggaagctagccccatagctttgtgtaatacacacgcacattgtgataaccacagtgtacaataaacagtatgcccatctccaatttctctacaattcttctcagttattggtgaaagcagtgcatacccaaaactagatttgcaccagaacagtttcaagttgaatatttgaaggaatgcccacatctgaaagaagcaattgaaattgatttagttcttatcatagctgacaaagttacagaaaattttaaagaatgatacagtgaaaacctacgtaatatgccccacctagatattagttattattttgccatatttgctttattatttgtgtgtgcacttttattgcttgtaataccattatcacactgaaaacattttaataaaaaatagccattgttacatttccattggttgtctcagtaatgtttatagttgtggtttttggtttatttttttatttttttattttaaaaaaaacggtatccaatctaggttcctgtagttgtcatttctttagtccctttcagggtatagccttgtcaaatatcaaacattctgaatatttctgattgtctcctcaaggttttaatttattcctgtatacctgtattttttataagctaaaagtcagatctaaaggcttgaatatattcagcttaaacattttgtgcaagagtaataacatacatagtgacattcacttcctgttccatcacctcagaaagcatatagtgtcaggttgtctcacttttaatgaggctaagtttgataactttattaaagtggtgacaccagatttctcgaatataaaattacatatttcccttgcaaaaagaaatgccatgggccgcattttgcagtcttttggatcatgataggtcattttttattaatgataatgttgatttggggcagtttgtttaaaatacattcaggaagctttaaagaggtctgccctgccctagttgaatggtaacaaaagcccattaatatctggaggtagtagcagtgggtgagaagtgctgcatgacaagagtaccaaagaaggaagcagagtgttagtgagtttgatgagcatgctctggttgtatgggatcatttaagaagagtgcattctacaaaagcatcagtattggaatagggcagttaaagcccaaaggaatcctgaatcatcttgggagaagtaacttactgtatggttattcccacagtgtgagtgtcatcatctaactgccctcatgcttctttttaggccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacaggtgggaggaaaagaatagccttttgaaagagatactgggttctctatagtctcctagtatgctaatagcttgttagctatccccacgttttttcggttttggttttggttttttgttgttgtcgtttttgtttttgttttgtttgtttgtttgttttggtggtggtggttttttgtttgtttgtttttggatttttttgagacggagtttcgctctgtcgcctaggctggagtgcagtggcacaatcttggctcgctgcaacctccacctcccaggttcaagcaattctcctgtctcagcctcccgagtagctgggactacaggcatgtgccaccatgcccggctaatttttgtaattttaatagagacagggtttcaccatgttggtcaggctggtctcgaacttcctgaccgccagtgatccacccacctcagcctcccaaagtgctgggattacaggtatgagccaccacgcccggccacctatcctcacttttgctatgatactgtaatgtaggaaaatatgggctctagtgtctttaccttggtgtttagttttcagctttaaaatcttactgcttgtttgactttgggaaacgagaatgtgcaaacccagaagctgaattaactgcatcatgcttaacatctgcttaggagcagaaccgggattggaaggtgctgaagttccttaatttcttttcccagttctctgtcacagagaagatgctaagccattggaagtatgcttatgaacaagaaacctaaaataattcacactgaaaaagtgagacagtatgtaaaataatgagaattttttttttttttttgagacagaatcttgctctgttgcccaggctggagtgcagtggcgtgatctcagctcactgcaacctccacctcctgggttcaagcagttctcctgcctcagcctcccaagtatctggtatcacaggcacacgccaccacacttggccaatttttctatttttaatacagggtttcaccacgttggccaggctggtctcaaactcctgacctcaagtgatctgcctgcctgggccttccaaagtgctgggataacaggtgtgaaccgccacacctggccacaatttccttatgaattattccatcaccaatatctttcaggccagcagtgcttatatctgtgcatgcttagcgccatgaaaaatccattgctgaaggcggggcataatggctcatgcctgtagtctcagcacttttcgaggctgaggtgggtggatcacttgaagtcagaagttcaagaccaacccagccaacatggtgaaactccacgtctactaaaaaaaatacatatctatgtatacaaaaattagctgggtgtagtggcgcatacctgtaatccagcaacttgggaggctgagtcaggaaaatcgcatgaatctgggaggcaaaggctgcagtgagctgagatcatgccagtgcactctagcctgggtgacagagcgagactccatctcaaaaaagaaaaaaaaaacttcattgctggaaaatttcaagcatacctccttttctgcccatttacttctgtatatgaaagagaatacattcagccttccatatccaggagttctacatccacagattcaaccaactttggatcagaagtacttgggaaaaaaataacagtacgataattaaacataatacaaataaaaatataactatttaccttgtatttgatattacaaatagttattattataagatttataatataagatttaagtatatgggaggatatgtataggttgtatgtaaatacaccattttatctaacggacttgagcattttcagataccaacagacagtacactgcagacatggtgatctttgaatcactgggatacggagatgaataagatcaaacccatgtcctcaaagggtttaatctttcctttacacctacctccatttatcaccacttcatttgttcctccaaaaatgtggggtattttgctcttaattactgaaaagtgaactgaaggacctctgctgctcaaacatcacaaaataaaagttgtgtgtttcaatgttttgtgttgccaaaatctttttaaaatgtacctacatggtgttttattctagaagttcagttatattcagtatattctgctttacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggtatgtgagccttctagatttctgaagaaaataaaaattcaaaccccaatatgtgtcttaagaccattattccttttgtaaaacttagcatttccttaaaggaaagtaatggaaaattgagtatccatggtattcttcactattattgaactattattattatgtttgtttgtttgtttgtttttaaaagacagggtctcactctgtcacccagactggagtgcagtggcacagtgatagctccctgcagcctcaaactcctgggcttaagcgatcctcctgcttcagcctctcaagtagctgggactagaggtgtgcaccaccttgcctggctaaattttcttatttttatagggcggggggcagctctttttgtatttcccaggctggtctcaaatccctggcctcaagagttcctcccatcttagcctcccaaagctctgggattacaagtatgagctatcacactcagccctcttccaaaatgtttttaaaatacatataattttttttaaatttatatttctttttaccagttatgttttcttggcctttggacttgaccctagcatgctggtagtcaaatggaatttgaaaatgactctttcagagtttggactaatacttactttttcaaatattttcaaatgtagggctttctgctgcctttttaaacctttgccatattttacttacaatacaaggttaaatgtatcatgaccatattatagaaaatgtaagatttgtaaactatattagaacaattgggaataccttatctgtggaattatggaatggaattcagtcagttggtattctagtggaaccagaatagtattaacacattcaacaaaattttgaatactatttgtatgtttggtatcttttttggatgtttattagtgaagtgaattaataaggcctttcccaaagaagtcagtcagttaatgttaatttaattatttactaaccaaggtttgtagtgatttttatgactatacaagttttatcttaaagctccactgcctctctgccttcatacttaaacatgcctatttgaccatattagacttccaaaggagcagattttataggtcacttaagaccgtgagaaaccagtcaggcttttttgagtcctgcctctgtgcaaaaagtgaaggtgagggactttctctgtctatgcagttagttcagaaatttttttttccacctttgtccagtgtccactgggacctgagccatctttccctgatgctctaacgtgtatgtgtgtatgggctttgttttaggctgatgtccggccccaaactgatggctgtaacggtctaagatataatttaacttctgatatcattgagtccatatttaggacctatccagcaggtaagaagaatcagttctttcagatggttaaaatatatggatatattctatagtatatcagtgaaaaacaaaaagcttcagattcctgatcaagtgcaataaattatgtaaagtactttttacccagtgcctgacatatggtagatactaggggctcagtaaataatgtgttgtcatcagttcactaatatgactgccattcgagtctgtctgtactactaactcagatcattcttcattctgcatccagagtgaccttcctaacccacaaattacttcccgtgcagatgccatcctaaaagtatagattccttgaccccagcctcagtgatttattatgtgtagacaaggatgagagccagtgtgtcagtcattcttctgactaagcagtactctcttaagctgtattctgttctcgcttccctcttccccactcttacccctttagtcccttaggaatctctctctcaggactcagctcaagcatcacctccttgccacctctatgaaatcctggccagtcccagtggctcacgcctgtaatcccaacacttcaggaggctgaggcaagaggatcccttgaagcaaggggttcaagactagcctgggcaacaaaacaagaccctatctctttttttttttttaattgagacagagtcttgctctgtcaaccaggctggagtgcagtggcgcgatcttggctcactgcaacctccgcctcccaggctcaagtgattctactgcctccgcctcccaagtagctgggactacaggcacgtgccaccacgccaagctactttttgtattttttgtagagatggggtttcaccctgttggccaggctggtcttgaattcctgacctcaagtgatctgcccgcctcagcctcccaaagtgctgagattacaggcttgagccacagcatctggctcttttgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcctgagattcttggtatttctactaaaacttcaaaaccttattcttttggtgcaaataaggttttgtttgtaatttgtaagatttatagaggtcatacctcacctaatctctcaagttacccttcatatttataattagattataacttatagtatgtagagttgagagctttatggtctagattttgctatttgtatttcagttacctaatttgagaggttttaaaaatggaaattcagtatataatatttgtgggtttttttccacagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggtaactgtttatctctgatagacactggtatttaacttgccaccctctagacattataagtgttaatttctgagacagataagacatgctgaactttttattttgttgattttctaggcctaaaaacaatggtttcattaggagtgaaaaacccactactagatttaacagctttggaagataaaccattagatgaggtaagaagcaataaaagaagttttgagagaaaagagtcttttcctagtcttcaacattgtcttaagcgtagtagacctattccacttgtgagaatgtcaaataagcaaaatactgttacttgaagtgatttatcggaagtgctttgaaatagcgttgtttgccattaaaattgcctagaagaaatgaaattcctgtgtgagttgctaaaaccttttaaaaataaatttctagctccctcatccgcagttctctagtaataataaaggcttaatgtgatgagttcagctttatgctctagctaacatttaatctaaagaaatatggataaattaataaataaggaagataacaaacatttgttgattgcttactatctgccaaaccttaagcactctcatgacccttataccatgacaaccccaatgtttcagcaagtaggccatcatgtatgacctacctacctcagcatcatgaccccagacctacagatttatctacttgcagagaaagagatggttcctgttgtgatcaaggataattttatcactgcctctgtcttctaggccagaacttgtcttcctcagttattccctttactctgagttttcattttcttgctcttatttttcttctttttctgtctctttttttttttttttttttttttgagaaagagtttcactctgttgcccaggctggagtgcagtggcgcaatcttggctcactgcaacctctgcctcccaagttaaagccattctcctgcctcagcctcccaagtagctggaattacaggcacgtgccaccacacccagttaatttttgtatttttagtagagacagggttttgccacgttggccaggctggtctcaaactccttacctcaggtgatctgcccaccttggcctcccaaagtgctgggattacagtcatgagccaccacgcccagccagtgtattttcaatttatactttgatcatacagtgagtttttcaggacatcaccctttcagaagtgaagaagaatctatacaaacatggccctctttaattatcctgagaaaataaagcttagtggcgcttagacttacaacttagtatgaaaggaagacttttttagtgctttttttttctttaaaataaacatgatggcatattgtacatgtacatttgtaactttatcttctgtttagtatcaatagctgtataaaccatcccatagtttaaaacatagactttaaaaccaaactagctgacttagattctgatatcttctaacatttctaggccctgtttggtttttgttttgttttgttttgttctgttttttgagatgggatctcactctgttgcccaggctggagtacagtggcctgagctcggctcactgcaacctctacctcctgggttcaagcgattctcctgcctcaggctcccgagtagctgagatcacaggcacatgccaccacgccaggctaatttttgtatttttagtacaggcggggtttcatcatgttggccgggctgatcttgaactcctgacctcaggtggtccacccacctcggcctcccaaagtgcagggattacagatgtgagccactgtgcccggcccaagcccagtttttttgtttttgtttttgttttccttagtgaggctaatagtacttgccttataggatttctatgagttaaaagagcctagtgcgtaataagtagtaggtaataggcattattgttgttatctgtatttttagatgcctgcatagtattccattggtatgggtatatcaacatttatataaccaatctttttactacaaatattggttgatgccatttttcatttggtgttccttctttccttctcaatcttctggttatagtaactatcacaggctatgatctatggcctcctgaatgcattctctctattccattgctttactagatatggggaacaggggagggagtaaaaataaaaataaaaacattcttgttacataatgatgaatcctgaataaccatagtctgtctttgactgcagagctctagctgcctacttgacatctcctctcaggtatttcaaagacatctcaacttcacatgtaaaatggaatctttgattcccatcctcataaacgtatctccatgggtattccctctcttagtaaaaagcattacaatttgctcaagccaaaaacctgggagtcggcgagtctccttgattcttcctcttcttttttatgacgggctcactctgttgcccaggctggagtgcagtggcacaatcatggctcactgcaatcttgacctcttgggctcaagcaatctgccttaggctcctgagtagctgggactgtagcacaggctaccacacctggctaattttattttttgtagagacagggtctccctatatttcccaggctggtctgaactcctgggctcaagctatttttccacctcggcctcctaaagtgctgagattacaggcgtgaaccattgcagccagccatgttttcctcctgttatgtccagcattcagtgtatcaacaagcctcgtacaatacacctctcatctgtgggatctacacaaacgcttacaccctttcatgtttacggtatcatcatctttggcctgtttgcttgccttagccttctaacctttatttttgctatcttgtcttttatagtttattctcccctagcagtaataattataatataggccgggcgtggtggctcgtgcctgtgatcgagcactttgggacgccaaggtgggtggatcacctgaggtcaggagtttgagaccagcctggccaacatggtgaaaccccatctccactaaaaatacaaaaattagccgggcctggcggcacatgcctgtaattccagctacccaggaggctgaggcaggagagtcgctggaaccggggaggcagaggctgcagtgagctaagattgcaccactgcactcctgcctgagtgacagagtgagactgtctcaaaaaaaaaaaaaaaaaaaaggattataatataaatcagatcctaataatcccctatgtgaatctcttcattatcttctcattgagcttagaataaaatcaaaactcctacaagactgctagatttggctcctgcatacttctcagttggggccacttctactcattcatgctttagacataatgaccattcacttccatgccacgctttttctacctcagggcctatgcacttaactgatcttctacctgcttgttccctaaccagcttctgcctatctttagatacctgttctaatgtcatttctcgccaggtggggtggctcatgcctttaatcctagcactttgggaggctgaggtgggaggatcgtttgagtccattgtgagaccacatctctaaactttttttttttttaatttaaaaattagctgggcatagtggtatacacttgcagtcccagctactcgggaggctaaggtaggaggatcacttgagcccaggaggtcaaggctgcagtgaactgcgattgcaccactgcactccagcctgggcaacagagcgagaacctgtctcaaaaaaaaataaaaatataaatttaaaaattaaaaattaaaaagttgcgtgcttcagagaggctttctctaaccacccacaaattcagtcacttcatcatgttaccctctgttttattcaatgacattttccactttcaaaaaatattgtgtttaccttgttttacttgataattgcattcacactcctctcagagtgtaatcttcatgaagctgactttgttctgtttattggcctgttcctagcgcatgtcatgtagtaataatcacttagtaattatttgatacattgatgaacagcatatggatctttttttttttttttttgagatggagtcgtgcccttttgcccaggctggagttcagtggcgtgatctcagctcactgcaatctctgcctcccgagttcaagcacttctcctccctcagcttcctgagtaggtgggatcataggcacacaccacgcccagctaatttttgtatttttagtacagggtttcaccacgaccagactggtcttgaattcccaacctcaggtgacccacccacctcagcctcccaaagtggtgggattacaggcgtgagccaccacacccagcacatatgagtcttttttttttttttttttttgagacggagtcttgctgtcacccaggctagagtgcagtagcaccatctcggctcactgcaggctctgccccctggggttcatgccattctcctgcctcagcctcctgagtagctgggactacaggcgtccgccacctcgcccggctaattttttgtatttttagtacggaaaggatttcaccgtgttagccaggatggcctcgatctcctgacctcatgatccacccgcctcagcctcccaaagtgttgggattacaggcgtaagccaccacgcctggcccatatgagtctcatgatctttctttcacctttttagcctcaccaattcctggaccaccgttattagtgtattgaaccatatacagtctcatgacacaatatgtactacattgctgctttgcttgtgttttgttttatttttaaatagagacaaggtctcactgtgttgccaggctggacttgaactcttcggctcaacagttcttctgcctcaacctcccaaataatcaggaccacagtgcctctttgcctttgtttaagcagtttcctctccctgaaatgttattgtctccgatctacttggcaagcaccagtttatcttatggttctctgtgaacctttttcgaaccctcttctccagtaggattgattagtaattctctccagcccagcttcccactaactagtatttaagctcctatggcatggggtcttaatcaattttgtatctacatggtctagcaagtagcgtgcactcaatacatgttttaaaatataatctcattttattctcttttatcctactttatagagcttggaaaagtttatcttgcctagattaacgttagaaaaagaatttgactctttatctttctgaatccatagtcagtgtttttctcactatattctattctttttatttacttttttttttttttttttttttttgagacagtctcactctgtcacccaggctggagtgcagtggtgcaatctcagctcactgccacctctgcctcctgggttcaagtgattctcctgcctcactcagcctccccaacagctgggattacaggtgtgtgccaccatacctggctaatttttgtatttttgatagagatgaggtttcaccatgttggccgggctagttttgaactcctgacctcaggtgactcgcccaccttggnnnnnnnnnnnnnnnnnnnnnnnnnnnnnnnnnnnnnnnnnnnaactagatccaaattgttctttaaaagagaaatgcagaccacgcacggtggctcacacctgtaatcccagcactttgggaggccaaggtgggcggatcacttgaggtcaggagttcaagaccagtctgaccagcatggtgaaaccccatctctactaaaaatacaaaatattagccgggcgtggtggcaggcgcctgtaatcccagcttctcaggaggctgaggcaagagaatcacttgaatgcaggaggcgaaggttgcactccagcctgagcaacagagcgggactccatctcaaaaacagagagaaattcagtttaagatgtattttgtaatgctaaaacgagttagtgctatttgttaatcttttatgtgcataatgtcacttgtttttaaatgtttgttcataaatatttaatgttcgtgagaagtaataaaagtcccatcatccagcaaattttttcagctaagcgtgtcttataataagaaaagcagaacctttttaaaaaatttttaatctattatttctcacagggctatggcatttcctctgtgccatctgcttccaattctaaatccataaaagagaatagtaatgctgccatcatcaagagatttaaccatcacagtgccatggtcctggcagctggactcagaaaacagttaagtataaatgcagaggtgcagtaactgggcttttcaggatatccagatggagttgtggtgttgttttgcttgtggtttttaacgttaacttttttttcccctttattttaagagaagcacaaaatgaacaaactagtgagcccagcaacatggatggaaattccggagatgcagactgctttcagccagcagtcaaaagggtatgggcaaaaaaatatgaaccatttggggctcaagtttctccaaatactttatgtgactgcaagtactgtatacgcttatttcctgtgactcagttcttctaactaagatgttaagcatttggcttaaagtgtatagcattacaaagagtatttccccagctttggcttgccagccaactttccattgactctagcctgttagccatttttattgttttttgtttgtttgtttgtttgttttcctcacatgtacacatacatacagattgttcttatatgtgattttgttctctgggaataaaatcttcattcaacagaggcaatatgacagaaaaaccgaagtttcatgtatatgatttttcaaagaaagtgaattggccctcatgttaaacctagcatttcagagctgaaagtgtcttctcattaaatattgaagaaatcatttgagggtgtggagaaggatggacagaattagctgcttgtgtatttattcttctcctgcaactttgccacgctattttgtacctcccttcctaattatgataaagctttcttagagagcagtcaggcaatgtgtattaaatgtttaaagctttacacccttagttctacttgtggacatttatttcttaagaaagatgtatactaagatttagatagaaatattcattacagtatcataataaagacagtagcaaggattctgttatctgtgttgcattaatacaatagagattgatgcaactgttcattattttgaaagcattaatgataatattgcatcaaagagttcactgaacagattgtacagtacagttttacacacaaaaaaaatagtttgtgagctttaaaagggccttcaaatgaatatgctaaacggttatctttcaataaagagagtatgggtaagtcttaatttctttcatttatttcagtaatttaatgtttttgttgttgttattgtttgtttttttgagacagagtcttgctctgtcacccaggctggagtgcagtggtgcaatctcagctcactgcaatctcggctcactgcaacgtctgcctcctggattcaagcaattcttctgcctcagcctccggagtagctgggattacaggcgtgcaccaccatacctagctaatttttgtatttttagtagagacggagttttgccatattggccaggctggtgttgaactcctggcctcatgtgatccgcccatctcagcctcccaaagtgctggggttacaggcatgagccactgtgccagcctatttcagtaacttaatgtttttacaggcatgtattacctataaaattaataaagccagtgaggtatttcttttttgaactaaagcaaagctaataataagttatagagaagttagagaagaaatctattaagtgatactttctttgtatactgttgcgctgagtacccttgattcttggtggtgaacaagttatcagaaatttcttggccaggagccgtggctcacacctgtagtcccagcactttgggagtccaaggtgggtggatcacttgaggtcagaatttctagatcagcctggccagcatggtgaaaccctgtctctattaaaaatacagaaattagccaggcatggtgacgtgcgcctgtaattccagctacctgggaggctgaggcagcaaaatcacttgaacctggcaggcggagttcgcagtgagctgggatcgcgtcgctgcactccagcctggatgacagagcaagactccatctcaaagaaaaaataaaaaagaaatttatttacttgtgtgaatttttacaatacagatgcttctcgacttaaatggggctacatcccaataaactcataagttgcaaatactgtaaatcaaaaatgcattgaatacacctaatgtatggaacaccatagtttagcctatcctactttaaatgtgttccgaacacttagattagcctgtagttgggcagcattacctactataaagtgtattttctaataaaatgttgaatatctcatgtaactcattgaatactgaaagtgaaaaacaatgtatgggtactcaaaatatggtttctctactgaatgtgaatcactttgacaccatcataaagttgaaaaattccaagtcaaaccattgtaagtcaggggctatcagtattcagtggtaaatgctggctctaactattcttccaagtcagtggttgactgctgtttattctataaagggttacaatttatagattctctcacttgtagaatgagagattcagaattaatagcagacagagtccctaccttgatggagctttcatttaagtgtgaaagtcaggtgacctaacaaggccttggcataagtttaggatttggattgttatgggagcttgggtagggacatgtcataggtaaggcaacagcaggggtagagataagcttgacatatgtcaaaaatcatgaagacatcagtaatccttgaagttggctgaaaggtatagagttgagaaagtagttaaaaaaaaaaagtcaggctgagtctaggtaaggatgtgtttctctgaggtcagatttgttcctgtaccataaagggactatttagaatcttaaagctggagcaatttaaaacgttaagttttcagattgaggtcagatttgtgacttcatgtgaggtcagatttgttcctgtaccataaagggactatttagaatcttaaagctggagcaatttaaaacgttaagttttcagattgacgttttttgaggtatagttaataacctgaatgttctgattctagtcttggtagtcaataagagttgaccagatgaatttcatagctttgtagaggatgaaatatttcaaggctgatttgcacaaatgtttacatagatcatgtatctttcataagtaatatgtttgtattattacaaggctgtaaaaatttaagcaggttgttaatagcacagggggtaacagattaataaaattaatgaataaaattactaaaagagtccagaagtaaacccaaatacgtggaggaattaagcatatgtatgatacacatgacattttaaaaatcagtgggaaaaggtaaattattttacaaatggtgttagaagcactgattgataattttgttaaaagaaacttagattccctattttactcctaatccaaaataaattctgagtggatctaagattaagcaaaaattaagccggaagctgagcatggtagcatgtgtctgtaatctccgcaatttaggagactgagtttggctggggaggtggtgatatgcgcctagaaaaaaaaaattttttaagccacagatgtataagcaaaaagcgggcaaagaggcggaatttttttttttttttttgatgaagtctcacttgtcgcccaggctggaacgcagtggcgtgatctcagctcactgcaacctctgcctcccgggttcaagcgattctcctgcctcagcctcccaagtagctgggattacaggcacctgccgaggagaggatttttttataattaaaacaaaacaaaacaaaaaaacaccaaactggaagataaagtatttacaacatgtaaaagactgtttccttaatatttaaaagtcttattttttaaaaagtacccaatataaaaatagtggagagcataacagatcattcatttggggaaaaaataataaaatgtaaactttcacctaccagattggcaaaagtaaaaagttcaataatacttcatgtggtcagagtgtaagaaaactagtattcttaagtagttgttgagaaaattggttcagccatttgtaggacagtcatctctaggaagagaagctcatggtgggaagacttcattttttaccctctgtacagttttgttttttcagtcatgtttattgtgtaagagaaagttgtgacaaaataaaaagtactgtgttaataattataggcgaaattacaagagtccattgaatatgaagacttggggaaaaataattctgtaaaaacgattgcactaaacctcaagaagtcagataggtaagtttggtcaatattaagcagaatagctatgtaacaattcagtccaaaatatatcctacaagtatagcactcatgttttaatcagttcgtcaccatcaaagtacaatatccttttctgtttaaaatttaggcttctcaggaagcaaaaatgatcaaacccatgacaataaatgtggatctttctgctgttgctttcttattgcccttatgggaattaaattattttattgaaatctctttacttatcgtttcttgccttgaggggaacttagtactgactgctaaaatgttgcaaagacaaatgttgagcatctttactgtgtgtgattagtaatttcttctgtgctaacctgcaggtattatcatggtccaactccaatccagtcactacagtatgcaacaagtcaggacattattaattcttttcaaagtattagacaagaaatggaagcttatacacccaagttaactcaggtaggtgacttctactgtttgaaggccagaattcccatagttccttcctcagtttatgagcacaagcagattgaaccatacaactaatattttaattgggcttaaagacatagttctgctaaataaattgaaaaaatcaagaggtagcaagaaaaggtgtttggcatattcaagaggcatctgaagataagatgataatgaaaaaaaataagttgatgaattttgtgatttttacttccatatacttttattgggaaaatctcccaggtttccaaattctgtctggacattattctctgaatattctgcatgactcaggcttaaaatatgtaaaacagctcatcattgttctttgtttctcttcgtacttcagttgatcagcaatttgtcagttctgccttcaataatacttcttgattctatcacccttatttaggcaaacctgattgattttccataatgctactgcaagttgtctttctaaaatcacttattttggccgggcacagtggctcacgcctgtaatcccaatactttgggaggccgaggtgggtggatcacgtgaggtcagaagttcgagaccagcctgaccaacatggtgaaacccgtctgtactaaaaatttaaaaattaactgggcgtggtggcacacacctgtaatcccagctactcaagacgctgaggcaggagaatcacttgaacctggaaggcagaggttacagtgagctgacaccgcgccattgcactccagcctgggcgacaagagcgaagctccatctcaaatagatagataaatatttaaatatttaaaaataaaaacatgtattttatcactgcggcttgaaaaccttcactgcctcccttcactgcagtagtctgagtgcctttgtctggcctgcaaaactctttatagtctggccccagcccactactcgagtctcatcttcagcgatagtctccgctactcccttccacacatggccaagggttccagcctaacacactaagctgtccagaatcttttgatcacattatctccttcatgcttcctgtgcttcggcttatgctctttctctttagaattcccttagccctgtttctcccccaaggaactaataattactcaagactcagctccagtttcattgcctctggaaagtaatccttaactagtgcaaagaagaatttgttttttccttttctccgtttttatgagcactgaggcactgagtgtatacctatattacgttatttatcacacatcaagacttacttttttactttttattttgaaatctcagattttacagaaagtgacagaaaaatatgttttccaacccattttgagagaaggttacaggcataatttccctttacccctaaatatttcgatgtatattttcaaaaaactaagacattctcttaaataacagtacaattatagaattagtaagttaacattgatgatgtgttatctagtctatatatcttactacattttcaccagttataccactaatgttctacatagcaaaagaaaacttttcttggtccagcagacaagctgggtttatgagttgtatttatttctcatgtgtttttagtctcctttaaaatggaatgatttgtcaatctttgtcttttcataactttgacattgaaagagtactgggcaattttttgtagaatgaccttaaatttacctaatgtttcctcatgactagattcacattaggcatttttgccagaaattccacagaagtaatgttgtatcctactcagtgtgtcatatcaggaggcaaatgatttgtatatatcctagcttgtgatattaaattttttcacttggttaaaggtagtatttgcctggtttctccaccaaaaagttaactatttttccctttgtaattaatacatatcttgtggagctgtactttgagactatataaataccccatttgtcaccaaattttttatttttattttttaatattattatctttagagacagggtcttgctctgatgcccaggctgtagtgcagtggcacagtcatagctccgttcaacctcagactcctagactcaagcaatcctcctgcctcagccttctgagtagctgggattataggcatgtgtcaccacacaacaaacttacatctggtagtttttttagaatcactgatgattcttgcctggaagagcagttgttaaatgatgattttctaattccatcagcccttctatgtatatcagctgacatgaaaggaagagcattcccttctcctctgtttgttatttatatcagcatggattcatttatgagttaaacactgttgctatctttttttctttgtttctttttgtttttgtttttgtttttgagatggggtctcactctgtcacccaggctgaagtgcagtggcatgatctcggcccactgcaacctccacctccctggctcaagcgatcctcccacctcagccccccaagtagctgaaaccacaggcactcaccaccatgcctggcaaagtttttgtatttttggtagagacagggttttgccatgttgcccaggctggtctttaactcctgagctcaagcaatccactcgcctcggcctcccaaagtgctgagattacaggccgtttttttctttttccttttttttaaaatttttttaatttttctttattttttttttatttttattttgtgagacggagtcttgctctgttgcccaggctggagtgcagtggcatgatccccactcactgcaagctccgcctcccaggttcacgccattctcctgcctcagcctctggagtagctgggactataggcgcccgccaccacgcctggctaatttttttgtatttttagtagcaacggggtttcaccgtgttagccaggatggtctcgatctcctgacctcgtgatccacccgcctcagcctcccaaagtgctgggattacaggcgtgagccaccacgcccagccttttttctttttattaaccaaggtacaacttaacatacagtaaaataaataaataaatttacttatttatttatttatttcgagacagggtctcactttgtcccccaggctggagtgtagtggcacaatctcggctcactgcagccttgacttcccaggttcaagcaatcctctcacctcagccctccaagtaactaagtagctgggactccaggcatgtgtcaccatccctggctaatttttatatttttgtgtgtagacagggtttcaccacgttgcccaggctggtctcgaactcctgagctcaagcgatccacctgcctcagcctcccaaaatgaaatttatctttttaagtctgctattctacaagttttgataaacacatgctgttgtgtagccaccaacaaaatcaagattttaaaaaaccggttctgtcaccccagaaagtctacccatgcccctttacagtcaaacccttcctacccacttcacacaggctctcctgtgtctttctgacaatatccccgtcattcttagcccctccttactgaatggtatagtaagatagatgttccaggcttatcttacatctgccctgtcccaggcgtggaattttctttttagcactgagtggatcaaggtaggaaccaagatctgggaccgggcacagtgactcacacctatagtcccagcactttgggaggccgaggcacgcagatcacttgagagctctagaccaccctggccaacatggcaaaaccccgtctctaccaaaaatacaaaaattaactgggtatggtggtgcgtacctgtagtctcagctactcgggaggctgaggcagaagaattgcttgagcctgggaggcggaggttgcagtgagccgagatcgcaccactgcactccagcctgggcaatagagtgagactctgtctcaaaaaaaaaaaaaaaaaaaaatctgggcactaggtatacattggggtgtcattgtcccttcagcagaaagctagaaaatacatatgtgtacataaatgcacacataaccaacctgggattatttgaccaattctttcaatgtagactatagttgtccagtatctggcccttgggcccgagtagacccacataacttttgtcttgggggtggtggtgtttgtttgatttagaggtgaggtttctgtcacccagactggagtgcagtagcactatcatagcttactgcaaccttgaactcctgggctcaggcgatgctcccacctcagcctcctgagtcactaggattataattgtaagccaccatgcccagctctccccatgtaatttttttacactgtagtcaatctttgtttttttttttttttttttgcagtcagggtcttgctttgttgcccaggctggagtgcagtgacaccatctcagctcactgcagcctcaacttccccaggctcaaatgatcttctcatctcagcctcccaagtagctaggactacaggcatgcaccaccatgcccaactaatttttttgtattttttgtagagacagggtttcaccatattgcccaggctggtatctgacaaaaggaaaataggaataaagtgagctccaatgtccccttcactcatggttgtcccatactgtacttttacactaagttgaaaaaatgttttcatccaatctatacatggatggatttctactcataaaaacttcattggaaaatcttagagatgctaaccctgcacttgctgtttcacaaattatttgttcctccctatagcagtgcctccctacagtacctggcacttgataggcactcatcgaatagataggtcaattttttcctaaatgttgatgttgatacagtggggagtatatttttcccccttttggctatatttattcacttccttgaaaattaaatgacagttaataaatttctgctctttatttttttttcccccactctgttatcaagggtatatgttagcaaagccaggtgcggagtacacacctgtagtctgtcccagctactcaggaggctgagggaggaggattgcttgagcccaggagttcaagttcagcctgggcaacataacaagattttgtttcttagaaaaataaatttaacagaaacaaaggatacaggttaacatgttgttttacctgttttctttccttaaactcaattttaccttcagtggtaagagttctcatattaaattgaattggtacttaagaaagggctttaactaggcaaaaccttgggagttttgaggtccctgtggacttgcctggcatgcctgggagatttgtaggtatcttctttctacacggattgtgtttctgccctcaaggaaaatagttcactttgaccactgtaaatgatgtagtatttaaacaaaaggaaaagcacttcattgtctgctctaaaactaaaatgttaagaaagagaggtggcaaaaaaaaaaaagggaggaaaaccagttttaatgcatcttcatttttttcaggttctctcaagtagtgctgccagtagtaccatcacagcactgtcacctggaggggcacttatgcagggaggaacacagcaagccataaaccgtatgtgccgggccatcttctactactttctgcctaaatcagctttaaaaagcaagctgggaggagtgctgaacttttattggtttttccttggaataatcctgggatttctattttgtagatttgtttttatacattcagattctgaaacacatctagacaagatcttaggtttcagaaccgtcttactattacaaatagtggtacattgctagtttctctaatatcatagtaaaagctcctttcttctcccctacctcttagaataaaggggaaacctgaaagtttctttgaaatcccaagagcttttaaattttatgatctctcagccacaaaattactaacttatctgaaaatagcacatcctggtttggcattgacaaagagtacacattcaaatttattctctgagtggtcatttttttcgagactgtatatgttaaaatagctcttaacctatgggccttgttcttcttttgcagagatggtgccaaatgatattcaatctgaattgaaacacttatatgtagctgttggagaacttctacgacatttctggtcctgctttcctgttaatacgccattcctagaagaaaaggttagaaccagttctgaagacagccagataattgtggtagtgacttacaagaagttttgaaattggaaagttttattgagtcttaccatgtgacagacactgggataactcttttgcatacatcgtttcatgtaaacctcacagcatctttatggagtagctattggtacccattttatagatttggaaactgagatccagacgagttccataactaataatcatacaacttaaaacttgtatctacctccaagccactgtgaatagagacccaaaacaaattacatcaataaagttatttatatttgatacgtttttcagggataacaaaatccaaaataagaactgacaacaaatatagcactagctttttaacactaaaaccgctttaaccaattaaaggacagttgacaaatgaaaaatgtaacattaatagtaatactataaattgctttcataaactatgattaagtaaaagataaagacctcattaagcacaataggcaaacactttacaagcaactcactaaagaatggagtggcctaggaagattaaggggaaatgctcacacttaccagtatgcagataaattacagctacagtaaaagaacattttggccaagcacggtggctcacacctgtaatcccaacactttggcggggctgaggcgggagaattgtttgagcccaggagttggagaccagcctggacaacatagcaagactctgtctccaaaaaatacataaataaattttttaaaagaatatttttttcacctactaatttgcagaagaacaaaaatcttaaaatgatcaatgttgaccaagtagccaagagtcctttcttccactgctagtgtttttttagatgcttttacttcagcattcaaatgaaacttcaaatgaaattcaacatttagaaatttaggaaataattaggaatgcaaatacttagctagagatggtctaccactctctaagatagaggaaatggcctaaatatctaccagaagggggttggttagagaagcatttggtatattcatacgttgaaagacaataattattttattttattttatttattgagtcagggtctcacgctgtcacccaggctggagtgcagtggagtgatctctgctcactgcagccgctaccttctgggctgaggtgattctcccacctcagcctctctagtagctgggactacaggcatgagccactaaaccgggcactttgggaggccaaggcaggcagatcgcttgagctcaggagtttgagaccaacttgggcaacatggcagaactccgtctctacaaaaattatgaaaagtagctcaggtgatcacctgagcctagagaggtcaaagctgcagtgagccatgatgttgccactgcactccagcctgggtgacagaatgagaccctgtctctaaatgaatgaataaatgaatgagtgactatttaaatgagttgggattttttgttgtttttgttttttgagatggagtctcactctgtcggcaggctggagtgcagtggtgtgatctcagttcactgcagcctccacctcctgggttcaaccaattttcctgcctcagcctcctgagtagctgggactacaggcgtgtgccaccacgcccagctaatttttgtatttttagcggagacggggtttcaccatgttagccaggatggtctcaatctcttgtccttgtgttccgcccacctcggcctcccaaagtgctgggattacaggcgtgagccaccacgtctggccaaatgagtatttatgactgaaagatattcacattgaagggttaacaatgtgatataattggtatatttttattttatttttacatttaaaaaaattctacaagaaaagtaactttcatatgtagaagattgtttttctgttggtctctacagcttgagatttctctgtaatttattgtttctcatcttttttaggtagtgaaaatgaaaagtaatttggaacgattccaagttacgaagctctgtccattccaagaaaagattcggagacagtatttaagcacaaatgtaaggcagcaatctgatttttgcctgatcttctttctctttgtagtaaaatgatgaaattgattttgctttcatgtaaatgagtagatacttaattttcttttttttttttttttgaaacggagtctcactctgtcgcccaggctggagtacagtggctccatctcagctcactgcaacctctacctcctgggttcaagcgattctcctgcctcagccttctgagtagctgagattacaagcgcatgctgccacgcccagctaatttttgtattttagtagagacggggtttcaccatgttggccaggctggtctcaaactcgacctcaggtaatcagcccaccttggcctcccaaagtgctaggattacaggcatgagccactgcacccggccaatactttattttctgttgctcaaagtactgttttttaatattgaaatgtgtcatgcattcagaagtatataaaatacatacatattttttaaataataaaataactgtctgtttactcaccaatcaggaaaattagtagaatgttgccataacccatagatattccctgagtgcccctgtccagttgcataccactctctcttcccctccagaggtcatgactaaccaaagcatttgtgataaccatctccatgctttcccttagaaaagttttacaatctggccgggtgcggtggctcatgcctgtaatcccagcacattgagaggccaaggcaggctgatcacttgaggtcaggagttccgagaccagttctggccaacatggcgaaaccctgtctctactaaaaatacaaaaattagcctggcatggtggcgcatgcctgtagtcccagctactcgggaggctgagacaggagaattgcttgaacctgggagacaggggttgcggtgagccgaggtcatgccaccgcactccagcctgggtgacacagtgagactctgtctcaaaaagttttacaatctatgtgtatgttctgaaaaatacatattactaatttattaatttggaaaaactgagtagcaagcacaaacctagcagcgtaaggaaagatagaattgccactactcatagtaagcaaaactgttcctgggttctatttggcatcagcttccctgattgtttacagtggggaaagtcagtggatgaggtattgagaagtgtcactttatgcccagcatttttagcattgtatttaaaacaaggttagagcaaccacatcagatcatttgtatgtgcagttatacaagccctcccagaggtaccttggaaagaatagtacagtcacgtgttgcttaaccacagggatgtgttctaaacaattcattgacagacagttttgttgtatgaacctcacagagtgtacttaaaacctagctatatagcctactatacttctaggctatatggtgtagcctgttgctcctaggctacaaacctgtacagcatagtactgtactaaatactgtaaacagttttaacacaatggtatgtgtgtatctaaacatagaaaagttgcagtaaaaattcagtataaaagataaaaagtggtccacctgtaaagggcatttaccataaatagagcctgcaggactgcaggactagaagttgctctgggtgactcagtgagtgaatgtgaaggcctaggacattactgtacactactgcagagtttactaacactgtacacttagactacattaaatttacaatatagctttttttcttcaataataaattagccttagcttactataacatttttaccttataaacttttaaatatttttaaagtttttcattctttggaataacacttaacctaaaacacccattgtatagctgtacaaaagtattttctttgtattcttattctataagcctttctctctctctttctctctctctctccctctctccgtatagatatatatattttttctttttcttttttttttttttttttttgagatggagtctagttctgtcgcccaggctggagtgcaatggcatgatcacagctcattgcaacctctgcctcctgggttcaagcgattctcccgcctcagcctcccgagtagctgggattacaggcacccaccaccacgcccagctaatttttgtatttttagtagagaccgggtttcactgtgtcggccaggttggtctcgaactcctgacctcgtgatccacccacctcggcctcacaaagtgctgggattacaggcgtgagccaccacgcctggtgccttttttctatttttaattttttttttctttttaaacttttgttaaaaactaagacacaaacacacattagcctaggcctacacagagtcaggatcatcactatcactgtcttccacctccacatcttgtcccactgaaaagtcttcaggggcagtaatgcacatggagctgtcatctcctgtgaaacaataccttcttctggaatacctcctgaaggacctgcgtacggctattttacagttaacttttttatatatataagtaggagtacaccgtaaataatgattttaaaatacagtaaatagataaaccagtaacatattcattatcattatcaagtattaggtcctatacataattgtacatgctatacttttatacagctggctacttaataggttcgtttacaccagcatccctacaaacgagtgaataatgtgctgctgtatgatgttacgacatcactagatgatgggaatttctcagctctattataatctgatgggaccgccatcatatatgcacattatgtggcacatgactctagttacaaatttaagattcagtattcaataagtaggataaataaaaggggagttttacaattgaaagctgaaaaatcatcagcaagatttttcatatttatttcctaaatattctaagtgggttttcttaaaatacaaaacagcattacttataatcagatagaagcttggagtgtcttctcacagcagggcaaggatggcagataggtttcaggtcatgtgccttctcaattgattataactgcttggagtgctgtgttggaaaggatgctgagggccaggcgcggtggcttacacctgtaatcccagtactttgggaggctgaggcgggtggatcacctgaggtcaagagttcgagaccagcctggccaacacagtgaaaccccatctctactaaaaatacaaaaaattagccgggcgttgtggcaagtgcccctaatcccagctactcgggaagttgagacaggagaattgcttgaacctgggaggcggagattgcagtgagctgagatcgtgccattgcatctagcctaggcaacaagagtgaaactccatctcaaaaaaaaaagaaaaggatgctgaggccatgcatagccttgcagaaggatatggtgttcatgtcttccaattgataatatagatactgctgcccatcaaacagaataagtaatttttatagtttccagacagagctaaatattactatcccccataatgataaacaggtatggcagtaagggtaatttttttaactctgtacccctcagacctaaacattgacatgccaaaggaatttaggacttcctgatctccatctccatcctcccagacttggcaaaactttacttctaaacacataaacactgtccacctccaaggaaacatattccagagacttctacctcaaaagtcagtataagccagatgcggtggtatgcacatgtagtcccagctactcaagagactgaggcaggaggatcacttgaaatcaggagtttgagactatagtaaactaaaattgcacctgtgaatagccactgcactccagcctgggcaacgtagtgagaccatgtctcaaaaaaataaaaaagattccatatgatcctgttgacttctagctatgtccatgatgagggcaaaattcttaatctactcaaagatctatagtcctgacccaagacatgacatagcacattgtgtgaagcattgaaaccatttaggttttctgtaatctgctgagttgtattgaactcctgaaatgctggagttggaaaaaccctaaaaatagcaaactgtttcacaaaattatgcagaattaactgcaggagcttttgaaaatcaaagattcttgggtctcatcccaggcctgttgaatcagaatcttcaggagaataaggcatttttccagtgttctgccaagatgtatatacggggctgggcacagcagctcacgcctgtaatcccagcactttgagaggctgaggcaggaagattgcttgagcccaggagttcgagaccagcctgggcagcatagcaagagtccatctccactattaaaaaaaaaaaaaaaaaaaaaacctggccgggcatggtggctcaggcctgtaatcccagcactttgggaggctgaggtgggtgaatcacttgaggccaggagttcaagaccagcctggccaacatggtgaaatcccatctctactaaaaatacaaaaattagccaggtgtggtggctcatggttgtaatcctagctactcgggagtctgagacatgagaactgcttggacctgtgaggtggaggctgcagtgagccaaaatcacaccatagcactccagcctgggtgacagagcaagactctgtctcaaaaaataaaataaaataaaataaagtttatactaccatcctggccttagttggctgaccagtattcaaatctagaaaatcacagatatagttcagacccctcgtttgacagaaggaattgaggcctggagcacaattgtgactttcatattgtcctattattggttaatgacaggacagccattacaaccgcagccttttcactgccccctactttctgtctttcctttccacacaaaatgtgtctgacagcaccttctcagagggcttgcacattacctcattgactggggaaatacagaggagctccgaaactacactctgaagtgtgtgccagatttgggttggaaggattaacttcccctgcttttgcccagttgttaagtgtcttgctgtgtttttcagttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactctaacacatctctggtttctcattatgtgtgaatttccttgggtgggctgcctgagaactgttcattttattttaggccatgttacaaactggttatccttcatataatgactgctaaggtcagaatctaagccaggcatggtagcacatgcctgtagttccagctacttgggaggctgaggtaggaggatcacttgagcccagaagttcaaaagtccagactgagcaacatagtgagactccatctctttttttacagaaaaaaaaagaaaaatttatgaagaccttgaactggtaaagggaaagaagccacatcattttctgccttcagtcttcccatttctctttcagatcagtatatgtactggtataatcccttaaaatttacactttcacaaagtactttcaaatgtgttactgctacagtggggcaaatagaaaaatgattgaaataaaaaaaagtggctattgggcaaggcagacataagaaatagaatgttctgttgagtgctgtgttgaaaattaagttgtaagctgggcatggtgagtcatacctgtaatccagcactttgggaggccaaggcaagaggatcacttgagctcaggaattcaagaccagcctgggcaacatagcaaaacctcatctctactaaaagtaaaaaaagttagctgggcgtggtggtatgtgcgtgtagttccagctgctctggaggccgaggcgggaggattgcatgagcccaggagattgaggctgcaatgagctatgatcacaccactgcactacagcctggacagtaagacaaagccctgtctcaaaaaaaaaaaaaaaaaaaaaaaaattttttatatatatatatatatatatatataaagcctgaaggaaagacttcatttaaaagagcgttttagctaagtcttgaaggttgagtaggattttgtgaggtagagaagaaagtcatctcttctagactgagggaagagcatgatgatgagaaggtttgaaagactgaaatatgttaga

SEQ ID NO: 15009 - DNA, 51754 bp, Human
gagtcctagttaagaaaaacgacttccaagtagaaataataggcggggagaaggaagggagatacagggatctggggggttcttagggcaactggcagtgaattttgtctcgagagtcctttctccactcaaaaaaccaaacgcgcgagccccgcgaaaggtttagggatagatcgtgtgggagaggactgagcagagagcgtgggggcagtgtcttgtagaatctttcttttcttaataataattttaaaagcttctgagtggagacgacgcaaagtcaagcagcaaaggtggcctgggaggcaagcggagggctcaagtgccgcatctttaccctcagggtctcctgcgcctacgggatgcgcattcccaagaagtgcgcccttcgagtaagtcctgggcccgcacacacttcgggtccgcagccagaatttaatggcgacaacgtttatgcaatgcaagctaaaaaccaaagcgtaaaaaattactatgtcatttattgaaacgccattctttgtcaaactgcaactactttgcttcacataagtttggctggaaagcttgcagccccagcccgggccagccaggtacaggaggccggactgcaaccggttgcttccctcccgtcgcgcctggccgtcccacgctgcgccgtcgctgctgcctcctggcgcccctgggattttatacgcacctctgaaacacgctccgctccggcccccggttcttctccttgcctaggggttgtttcccaatagatactgactcctttagaagatccaaaaaccaaaccaaaacaccccctacccgccccaaacacctgctctggggcgcgggggctgccaaacagagactagacgaagggagtcagatttagcgaagctcttcgagctcccaaagattcgaacactaactcgcgcccgtgggccgatggaggttctccctactccactccttggtccccttaactggcttccgcctcctggtcaatcactgagcaaccagaatggtatcctcgaccagggccacaggcagtgctcggcggagtggctccaggagttacccgctccctgccgggcttcgtatccaaaccctccccttcacccctcctccccaaactgggcgccaggatgctccggccggaatatacgcaggctttgggcgtttgcccaagggttttcttccctcctaaactagccgctgttttcccggcttaaccgtagaagaattagatattcctcactggaaagggaaactaagtgctgctgactccaattttaggtaggcggcaaccgccttccgcctggcgcaaacctcaccaagtaaacaactactagccgatcgaaatacgcccggcttataactggtgcaactcccggccacccaactgagggacgttcgctttcagtcccgacctctggaacccacaaagggccacctctttccccagtgaccccaagatcatggccactcccctacccgacagttctagaagcaagagccagactcaagggtgcaaagcaagggtatacgcttctttgaagcttgactgagttctttctgcgctttcctgaagttcccgccctcttggagcctacctgcccctccctccaaaccactcttttagattaacaaccccatctctactcccaccgcattcgaccctgcccggactcactgcttacctgaacggactctccagtgagacgaggctcccacactggcgaaggccaagaaggggaggtggggggagggttgtgccacaccggccagctgagagcgcgtgttgggttgaagaggagggtgtctccgagagggacgctccctcggacccgccctcaccccagctgcgagggcgcccccaaggagcagcgcgcgctgcctggccgggcttgggctgctgagtgaatggagcggccgagcctcctggctcctcctcttccccgcgccgccggcccctcttatttgagctttgggaagctgagggcagccaggcagctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggtaagtaggccggggagcgccccctacgcgcggggcagtggcgccagggactctccgctctaggacacccccctctcctaccccttttgaccgcagctcttacccagctgcttcccaagggccgtgaggatagcggaagcggcggctggggaggaggccggagagtgggagtgcacgcaggcactggcccccgacatcctccaaagccaggcagagctaggagcctgactgttcgcaagagccgggagggcgtctggggccccttagagtccgagagattccgggactgctagtccccacgggagtggaaccaggagaccggcgcagtgtctggctctgccttggggagagttttgttaattaaggaaacgccaaattgtcaccaagcgtagcgcttttcagacgtctggactctggattcggagtgggaccagcgcgggggtgagcgcctgtgctgtgctgcctccgcagcgctaaaatgtccaggagcacctccagcccttataatacggtgttggcacacacttaggtgcacattaagtatcgtagagaactagaatgagcacatgcacctccagtaactaaatggctttctggaacagcgtcgtgtccgtggatagctcccgcgtatggtaatacagaagtggatcttcactgggcttcgctcaggcggcggccacgcaggttctggggatggaagagaacttgacttatccgagtccaagctatgcgggaccaggttctaccgcaggcagtggaaggaggcacgagctttggcctttctttcagcgcatctggggcgcctcttcatcttgtaaacgcggggctcagctgggacagtatttcttcaagacctggggttagaacaaggacagggttattcgctgtgcttagtcaggatacaaggagggaactcggcacacgataagtatcaggttggtttctcatcccgcgccgatgcccgcccacctctctttcgcctgggcggcgcggacccgaacctgcggagcccctgtagtttgccctcttcatttattttcagtggatttccacgctattgagaacctaagccagttcggtttgattcggtaatttagtaaacgctttactaatacaatggcggatgcttttcctggagcaaaattactcgagggcctagggaccgggatgtttttggaatgcgtgggaagcagagtgtatcttttgcaggaggtaccttcgcccaaggctcgggagaagggctctgcccttgttgcccgccttcacccgcgccttctaaacgcgcgtcttcaggccgctcctaccttagcctaaccaggagcacccggcccccgcgaagccttggagaaatcgaaaccgcccttttcttcgggagaatctgggatcactgtcctgtggaggaaccgcaagcagacccaagggttgcctccactctatgcttttagttagtgaaattagtgttttgtactcaaggggcgttgggacaacttactggtcgctgaggcttgtgttctttgatcagatcgcgccacctttgtttagcaggctggtgttacttttggggagtttctaggtctcagtgtccccgtctataagaggacagctgagatgggcaacctggagattgggtccggcttgaagttatactccatagatgcagaagcgctacccaccaccctcttggggctttaaatatggaactcggcaacccatctaaacatctgtgactgagaaacaatgaatccgagagcactgtctgcatgtgtgctatttggaggcggttgagaaaccatcgaatccatgcccctggggcacaaaatactactacgccattatctttttagtacttctaggggatttttgaaacctgggttctgtcgcttcgtttgggtcccttgtccagcccttttcagggcaggtctggtgcctgggatcttatcacatgtcgtggggggtgggactgtgggttttgcagccagcaggcattacacttctggaaaatatctggattcttctgtaatatacaggcgtggctgccatggagaaaaagttaaaaggggaccaggactagtaggtgaatgtatccttcttctccaccctggagaaaaagcccaatggagagagggccctagattcaagtcatatagcctggaagcaccatctccaggtttaagttttgtcttgcagtgaaaacagatgggtccatcttacccagcccttgaggctcattgggcagcttggatgtgagaagcgctccggctgctatcctggagtgggcaagggtggccctcgagattctgggtttattctttggatttccagggttcctgctgcttccccaggaatgcagggcctggcccaagacttgggctgtgagaggcaagggcatcaactctcaaaaatgtggaaatggccatcagagcgccaaggccaaaccccaggggagaggaatcaaggccgtctctggatccctagggcagtctagccatggtgcacaggcaggggcaattgttggtacccactcacaaccgcccaaaacttcacaagcatgttcatattttaaattcttaaatattatatcttgcatcctaatcttgtaaacattaatttagcaaacatcaatcgcctacttggtcaggcactgggttctgaatattaattaagacaatggcctcgagaacctttgcaagaagctcaccagctaatcctggagaggccccttgttttggatgaggaaatccaggttctatgagattaggtggcagaggtgggatttgaacccagaccatgctagggtgtttctactccttttccagggatcttggccccaccgttgagatggatttcttctggcctgcgggaggggcaccaaactcttagtccatgtgtgggggttgacgggtttgtgagggcagatgtggggtgaggacttgagtagccccagactagatgcaaggcttaaggaggaggggaaaaaagcttgcttgggccggacgcggtggctcgaggcggttggatcacctgaggtcaggagtttgagaccagcctggccaacacggtgaaaccctgtctctactgaaaatacaaaaaaaaaaattggccgggcttggtgacgggcgcctataatcccagctactcgggaggctgaggcacaagaatcgtttgaacccgggaggctgaggttgaagtgagctgagatcgcgccactgcactgcagcctgggcgacagagcgaaactccgtctcggaaaaaaaaaaaaaaaaaagaggttgcctgctagtccactgatcccgcagccccgcaggctcgcagaaccctaacgcatgattaggcctgggatcatcaggccaccctagggtcaggtgcggaggcctgcgacgcccgagggccaaaggctccctcttccggtcacacaggagagggtattttgttgggggacaggttttccccaatcacagtgcagctgcagtcatcgttttcagccttctgagcaccttcctggctgagcctgctgtccatttcacccctcagctctcacggcccggccaggccaggcggttcccggcttctctgcagccgccggcgggggaggagggcacagagcgcgtctcgcctcttagcgcacggtcaaggttgcgctcccctcccgggccgggactaaccgtgggaaaggcgctaccttggccactcgattctctccctccaaggcctgtacaaggagcctttgaacacgctgctccttccagccggcagctttacctcccctggcccctgcccccgcactctccgcgccaggccaagcgctgggcccagggacagcgcgctctaatcaaacccgtgtccgataagcttctaattaaaagagacctccctccgctccgcaggcgctttcaccactgcccctcccggggggacctgaaggagagggtttgaggccggtctttgcccgccgaggtctgcgtgtccggtctgggaggaggcctaggagggctcgcgggccacgggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttcgtctagagaaaacttcttcgtagcttctatttcgtctctctctctctctctctctctctctctctccctccctctctctctctctctctgtgtctgtctctctttctctctctctctttttagtgtcctttcagaaattcggccttcactccgggcaatagtgggtgccctgagccaaatttcgtttgtaagctcatctataggcctcaaagaaggccaggcctcaggtttcaaaaggaagtctgtggaagcccaaacgtgctcgcccatgcaggagagctaacggggccgggggttatctttgcccacttagcaggagagaaatggaggccctcgaggtcatatgataaaagctagtggcttctcaaatccccagtgtgtggtgctgagcagtgtgtgagacttaagcctggacctgtactatccgggagttaggatttgccccctccttccctcccttgcactctgccacaccaccctccaggctcatgcctctgttgccccagagaagctttttttttttctttttctttttttttttttctgggcggggggtggtggtgtgtgtgcatgagcgtccgtgtgtgtttcgaaaatggaggtaacgatgccctgggtcctgctcatcggctgagtcctgcttaagtctttggaggcactttggtcaaatagtgcaagagtgggagaatgggtgctgtttgacccaatttactcctgagaattttgtgaagtttggagacccagggcagtcctgggccaggaggatctgaggctgctggggtggccctgccaggatcccataggagcagctctccttagccattgtgtctggacttcaggccacagactccggaacttgtagaggaatgagaccccatccttgggttccggggccaatgacgtatctttagccgaaggatccttttccccagaggcagcaacagctttccagaagcttgtggggtataagtttaaagcaatttaataacaaaaattataaaagactatgttttccaactgaggctccacgctctttttctcactttgggggggggggggaatgctaggatttccctagggggaaactgaggcaaaggaccgaagcactaccatggagggaaagggagatacagtgtcaggcacactctaaaggaaattggttgtccagcctggggagtgaggaagttggctcctacagcagtggtcagggtcggacccctgggcgcaaggtgggtcccataggggggaggaggaggagagcgcagggtcgccatctgaaggcccaactggaaggggcccttgttttccccctcaccagctttcccttgggtgtcatggtgtcaggtcgggtagccccagacagataacattactcggtaattactcttcccatttttaagaccaggccatttaactggctccgagtaattaatgaaagttggtgcgcgggcccctgatttacagctcggagtcaacgcggggttagcccagcagattcatttcgcttgcccgcgctgctcctgcggaagagctgcagtttatttttggggggtgaacaaccttctctgtcgatcaggcaacgagttttatacttaatttgccaggggttcgctgcagaagcggcagagaccgtagaagactgcggcataaataaattgggaaaaagcgaggtgggggttttagtcagaaaaggatggagaagcctgtcccaaggtcacatccagggacttgggccgtcttcctgccgaaagtcctggaggcttgtggggctggattctcctccgctgggggtccgaatgcggggttcagcgcacacccccccccgcccgtggctggttcagacccactgccccgtcttgcgagagcaccgctgacactgtgcttctctccgccgctcccgcaggttacagcacggtcaccttcgacgggacgcccagctacggtcacacgccctcgcaccatgcggcgcagttccccaaccactcattcaagcatgaggatcccatgggccagcagggctcgctgggtaagcgagcggaaccaagtggagtccttctccccttcttccgtgctatcctcctctcccccaggaattcctaacccacagcaaattaggcaaaggaggacatctaaaaggaccttagaaatcattaccccaatggcactgtatttaaaggacaagactgggtctccctccatcccaagtacgttagggacatcgccatccaactaagtctatgaatgtccggagggcctttttggtgcacagcgcagcgactgctaggggaatgcaaagtgagaggcttagcttcttgcattctggacggcctcgctctgcacgccgctcatccaggccccagtgccccaggctcaggatctcgtgtctcccccaacccctgcccgcagcctcgcaccccgagcccttggggcgcactcgctcagctgtcttcggttctctctgcaggtgagcagcagtactcggtgccgcccccggtctatggctgccacacccccaccgacagctgcaccggcagccaggctttgctgctgaggacgccctacagcaggtaggaaggcgctgggctctgcgtctgggtccttgggaccccggaggggacgcatgagccggcggacttgggaacgccccagccgggcagccctgactgcgggcatgcagggtcttggaggcacgagacgcctcgactccactctactacttagaggaaattaaagctgatctccctggtctctgagttgttcttatgttgtataaaaatgaggacaattactctttcgagctgaagaaggagcggcgctcgagaagttattatttttagaaggtctttactgggaggaatttaccttcatcgggactaaatattaaacacggagtccactcccactcggttctgagacctcaaacccatccaatggccacaccggccagactacctcgaaggcgcgtaccttcggccacagccttggccacagccttctccccacctcaaccctccagggtttcgacccgtggcagcgctttgtggacgtcgttcccagcgcccctgctacgctctggggtgggcccccggccggggtgcaggacggagatcgggtcgcaacagggccctgcggggaggctgctctggcccgcgtgggaccttcttcctgtgagcgggaggcccaaggccagcttcattcccttccaagcttttccccgctccgtgcttcctcttctcgcctctcgctccaccttctctcccccaaattttttcttcaactttgggtgaacttggccggccgcccgcgtctgcgatagggttgcctagtaactgcggcgcacaccagcccgcacggggctggaagttggggcgggggccggggagcagcagcgcgaggcctgtgcggcccgggattgggcgcgcatgacctcatagccccctcctccctggtgctcggggatcctgacaccggctgcccccaaacccatccccatcctcccgcccctccgcgcggggacccggggctgacgtcaagggaaggaggtagtgaggtcatgaaggaaggaaaagcgcctgccctgggagattgggtgggggagtggccgcgcctgggggactgtccagtcccgcaggtggaggaggggcgggagtcctcgatccggagcgaggcgcagccccaggcccttgctgcctttacgagagtgagcccggggctggcctggctctcgcatctaaggttctccttcccgggagtttctagagaggtgcagggatgcgccccttctatttctaacgcctgaggcgcgcggactggggaaacctttttttttcctttttttcccccggaacatccggtttatctattcgaaacttggattcctcatcacactttttttgggcgggtggaggcaggcggtgggcaagaacaccaatggtcgcacctccccatccttctttttctgcgtccctagctagaaatcattcctgttctgcaccacaggcgcggcatgctgccccaagcctgccacctcagcgcctcccttcggtgggtaaagtctttggaatgggggcaggattcgcacctattctctgaggtgaatctccttccctagcaaaactggcagcggggccattgccattcttcttgtgtagctgctcctgcccattgccagggtgtcattgctgttattctagtagccatcaggcgggctgttggaatggttcccacgtaatgaccttggtccaccccttcctccttagctccctgtggactcagttggtgtgtcacactaggctgagagaagaccttgatgcgggagtgggcactgtcgatatgggaggtgttcttgggggttggggactggaagaccttgcagtctggtgcctcagtgactcgaagctacacacacatccgttacttccctctcccaagccgagactcaccctgtgggaccctaggaaggggtccatcagaggacctggcagccttgaaagaggagtccaggaaaaagcgatcattaccactggtttaatagcaattctccagggtgcctatggtggattttgacttaggtctgattttgtggttgctagggaagtaggaaacatcacataaattttcacgttttctaatccagcttctgattggccactgtattaagcacttcatcaaattcacctttcagaagtatttgtttatttctatcttctttctttataattgaggaactttctttggtcctgttatttttacacaaatccaataaaaatactatttttccctctcacagaaaatttcccaagtagtaacatctcaaaaaagaatttgtgacccctgtaggaagagtttgttcccttggaatttgtgctgtctggatcttgaaagctccattcactctaaattaacatttccattcagttttcaaagatcatgtgcttcccttgcagtctaaagatgaatgggcaggtgtaggaatgttttaaacctgggtctgtgcaccaacattactacagttatatggtttccctctttcctactcctaaacaagtttgaaagggtatttaaatgcttttgtgaatgtaatggttgaagaagcataaaaaataggactaaactttaattgcttaacaccctaacttttggattttaggtattcagtggtgcttctactggtccctggtttcattcattttttctctctaaagtttgggactttctggggaaagcttgcttgtattttgtttgccttgttgcatttgaccctctgaggctgactgcccagctttttctccccctccctcaccaaactttttcttccccagtcttttttttttttttttttcttttcgagacagtctcactctgtcgcccaggctggagtgcagtggcacaatcttggctcactgcaactccatctcccagattcaagtgattcttgtgcctcagcctcccaagtagctgagattataggtgctggccaccatgcccagctaatttttgtatttttagtagagacggggtttcaccatgttggccaggttggtctcaaactcctgatctcaggtaatctgcccaccttggcctcgaaaagtgctgggattacaggtgtgagccgctgtgctgggcctcttcccagtctttggatatactttcccttgtcagtctaaagaaaggtaatggtacagatctgacattaaataagcaaaatacagtgtggagtgtgctttgaggacattctcaaaatcccagttcttcccttgtcccctgcacaattccctcctttctctcaggtgacagttctgaggagttgcagctgcatatatatttgttgtggctatgaacaacagtgaatagaaaatacattcaatcagcaacttatgggaaatgacaggaggtggttttctctatcctccttaccctctcctctcatatacaaggtgggtggagttttgtgtaaaggtcactagggtttctgaaaccaggtgtctgcccttacggaacccagtgatcattgttggatgacagcatgagtccttataatgtaataactggaatttattgcatgctgactatatgttgctgtgcatgacgttaaatggttcactcagtttacccatttaacccttttgactactcgttgaggcaggtactataatttctagtttaagttcagagtctcaaagtaacttgctcaaagtcacacagcaagtgagaatcagaatcaggatttgatccttagtctctctgacttcacagcccagctgtgctctgaatcactgagtgacaccagaccacgcaggattccctatctgattactccccttgtataggcaatgtatcacttttttttttttttttttttgagatggcatctcgctctgttgcaaggctggagtgcaatggtgcaatcttggctcactgcaacctctgcctgccgggttcaagagattctcctgcctcagcctcccaagtagctgggactacaggcatgtgccaccacgcctggctaattttttgtatttttagtagagagggggtttcaccgtgttagccaggatggtctcaaactcctgaccttgtgatccacccgcctgggcctcccaaagtgctggaattacaggcgtgagccaccgcaccaggccaatgtatcacttttgctcataaatcataagagcacatgcttatgtagacttaacatgcaccaggtaccactgtaagcactttacaagtgttgacttatttaatctacctagtgactctctgaaggacacaacaggttatcactgccattttacagaggaggaaactcaggccctgagaagtaaatttccccagtgtgacacagttaagggacggaagtggtgttcaaattcaggcaatacagctccagaatccatcctcctaccctctgcacttgctttctctctagatggataagtgccattctctttgtgaaggtggcatctgtcctcagtctcactcaaggatggtctcctatttcccacagttgtgaaagaagtcagttatccattagttttacctgtagctttcaacagaaagttcttagtggtttgggacagcgttttccctgaaggccattatcagaagcaggcttgagcattctcctgaagttctaacacacagagcagttgtctttcaaactccagactcctccagttttgtctttaccactgggtgtgaactgttggggtgaagttcagcccaggcacctaaagaattgcagggcagagacctttctccctgtccatccagacccagaaagaatgactgcttccaggaccaccctggtttgggcttgcccagagggaaggtaccagggaaaagttcttctgtcagtgtagggagtagtggggtccaaccttactaggcacaatttcccccctaatttctacctagaaaaggcagctagctgggccttttctgctgtctttccttcccagagtccctttgcctcatctttttgctgacttcctcggagaccccagtccttgactataccgacttcacatatgatcctcatggctactttgaaaagttctgtgcactgcgtttgaaaaatattcccatgcacactgattgtttcttttaggcattctagccctttccctttccttttgctcttttattaggtttgcatattcttctttagcaactgtgctacgaatttaaatgaagatatttccttttgctgtacttttgcctgttagcaggtgaaaccactccgactctggaagcaatcattcaatgttagtctgttttgaactggatgtgatgattcacaaatggtgacattgacagtggagcctgttacaagtagattatttttcatatgagagaaacttcctcagcagccatagagtttctgggaaatcttgggttccataactcagtgggaagtgccgatctaccacttgggttggccttcaacatagacagaaatcagatgacagcccatgcccaagaaaataaaattgtaattaataatgcctcttttcacttgtgtacctatgtacattgtacactgccttttcccttagtagaaaatcaatatttgtttcctgcaatgataggcagaaggtggaaggtctgaaacggcttccagggtgatgggcaatgttatcaaagccacaggcttgaattaaactcgtctccagggaggaggaaaaatctagttccaaatattcctgtaacttttgtgctgaccaagtgtttattaatagaaatggaatccccagtgggtttttctttggttagctggtgagcttgagagaaattacaataccaagagagtgactgtgaaataattattcattatggcctgctgggcagaaatttctaggcaggcaggctgcaaagcacctcaaagggaggagcacaggaaaagggtgtgtggaagtctggctgcaccctctgttaagttattaggtagaggtacacccacagaggcctttctgttggtgtgggacacagctattaccgaaaaagctggaaacatgaattctaatcacagatgccagttatgtctactttgagcctttttattttttatcctctgggggcagctctttacttcttccaagatgttacctggccagccagcagctacgtggcagaggtgaccctgatctcagccaggttagatggttctattcccttgatgacacaaattattctgctgaatataataaacagacttaaagatgaaaatgtgcttgaatcacacatgcgtttgaagagtggaggagttctcatctagataacagctgaggctttttttcttcctttctttttgtgcagaggtcgagaacttaataatactgcagttcaggccaaaacaaactctatatgatctactactgatttccttttaagctccccctttttgctaggactgacttccttttattttactccaacttgcattaatcccagttatagaagtttctttcctctttcctttgcctccaacttcaaacattcttacataggaaacaagtgactttaaaaaaaatctacttaaaaaatataaaggacaccatgacttttggaatacattttggcagcctgcaatttgaaagttcacttccgaacaggcagagttagacggttggagctgaaatgcctacgtgaccacagtggtcgctgtaagccaaaccacctgcttatctgatctcctctgggaatgaggtggtggcacctacagtggttattgagtaattagatgcttcatttgccagaggctctatattccttgaacgaagctgcctctttccatgggcttccatgatgagagctgggtgttgagcgattgcccaaagagatcagagcctgagcatgcttcggcccagtatttttagctccagttcacatttttgtcccctccccagcagccgttattgtcattgctgtcattgacttccatttgaaaggccgtgccagccaggcccactgactgagcagctgaggagccccagccagcaaaaggcaggatgtggttaaaactgtgctctgatcctatctctggcctcaggaaacctattagtagcttggggattttctgaaagtccttctgtcccatacatcctccccaccttctctcctcttctgagagtttgcaggctaagctatcaggacagctagaatggcaaagggggcttctattgggatcttggcactctgcccttagtgagctgaagaggacacatggggcatcttgcagcatcgtcattttctagagactgagtaggtcatgatgctcccttgagcatattctctttcacctccagactcttgtctgtattattgttattattattattatataaatggtaatgagaggatgaggctcaggatgccttcataggggcagggcagagtgagggtgggggctcaggcatgccagcactgggcatctctctgtgcctcaaccctcatctaataaatggggactcagaattacatctgcctcacaaagttgtgagcagtattgagaatgtgtgaaagtgctgtgcaaaatttggtaggttagaacaaattaaagtaattaaagtatattatctgtatcatcttcaaagggccattgagggcattaccttttatgggcctcacaacatttctgtacagttagactgatggagattaatattcccattgaacagatgagaaaactgaggggcagggagctgaactgatttgctcaatgtcccaaaacttatagaacatcactgtccaatagaaacataacacaagccatacatgtaatttgaaatttgctagtaaccacattcaaaaaataagaagctgtggaattaatttttcaaatagcatatttgactcaatatagcaaaaaatcttatcattttaatgtgtggcatgagtcacatgtggccagtgtataccatattagacagtacagtacacactagaaaaagtcatatacgtaagacatagaccttgtatttgagaagatttgccttctgagggccaagaaaatgccattaaaaatattggccaggcacggtggctcatgcctgtaatctcagcactttgggaggctgaggcgggtggatcacctgaggttaggagtttgagaccagcctgaccaacatggtgaaaccccatgtctactaaaaatacaaaaattagccgggcatggtggcagatgcctgtagtcccagctacttgggtggctgaggcaggagaattgcttgcgcatgggagactgaggttgcagcgaactgaaatagcgccactgcactctaacctgggcgacagagtgagactccgtctaacggaaaaaaatgtttattttctctttggggtacttccttacagagaccttaggaatcaaccagactattctttaagtctgtgagaaaatttccaactcataaagttagatatttgggattcattcacccttctgcatcagcgtctgtcactcatctttctttcccagttctcttgaaaattatgattttctgagttgtgaaaggatgaaataatttcagaaagatcccatatccccaaagggcctaggaaaattgtcaactggggctgagtgattttagttggtgaacaatttttaaaaaattagtgacaaaaatatagagctgcctggggaatacaatgcctgttggctgagattaatggtaagattaataaatggattgcttgatgaaaaggcgcaggagaacaaaaaccagtagagagattgtggaggaggccgcttattaatgaactgtcagcccaaagaaagttcaagaaactctcctgtggtaaatgctgcaggctggcacttctaataaaagttggggtccttcaggaattaattactccagccttacagcaagaatttgtggaattgcaaaatgttgtggcacagaccagtacgggctgctgctacaaacagggaagctgcaggagaaactcatcattttttttcattgatatgtaggatattgtagtagcataatagccagtcagacacggggatgagtgacggcgtccagatacacactgactaatgaaacggcacatactttgagtttgaagtcacttcacttttcatatgcaaaattccctcctggaatctgatttcctccttatcctgtgtacccaccactaaggagttccaaataattttcagagttattatatgagagtcagatggactctgccatgatttatcacgctatgcggacagagagcacagaattcatttattctgagttgctgtaatttccctctcccctcctcaagttcccagttatgcttggcctgaaaaaagcctttctgaattaaaatttggtgttgcctctgcccagtgaagcagcttaaaagaatgccatgaccagacagagatggtcctatatctgcaatctgataccacacatcggatattaaatgcctcttatcttttttcatttctgccatgaaggtagagtgaaatttttcttctgtaaagtgtttagaccaagaggtcccagaaaaactcttggtctcttgggtctcaaatttcataattaaccatttcagttcaggcataaatttattcctgatggagcttggtaatttaggagatttctggcaattgattcatgtgctaattttctaggaatgagataaatacagaggggacagaacagctttttgttggtttacatagcggtgtaagacttctttggagtcttaatgtaaatgataagccatttccctcatagagtcttatagaactgggctcttttttttttttttttaatttgacttgtaccaggattataaaacatatagaaaatgattccttccgctgtgcatagagtttatcatcgtctttcttctgcttgtcacatccttgctttttagaccatttatcacccatcactctgacttttcagaccctcataatccacatgatacttatccttttgattaaaacaacttaatggccttttcacgaataattaatctgctgtctttactttcagctccaggcttttaactttaatgttgagttatccagcctgtgttgcctttcaaagtttcactccccttagccttttcccctcaaaggtttaatacttctttagaaacttcaatagttgctatacaaaggttttaaaaaatgcttctgagttactctcacatcccttctgctgtgtatgaagtgtataactgtgcagagatcagtgggatgaaatgaaaataattcagatttgcatattctgtcattctggaaaatgtggaggcttgcactttcaagaaaagttaaaactccattgcttttgaagaaacagttgtgtattattttgtggttatgtgtttctaactctagatgtttttctaacagtgacaatttataccaaatgacatcccagcttgaatgcatgacctggaatcagatgaacttaggagccaccttaaaggggtaaggttttctctattccattgcctttccacagtaacttatacctgtttgaaccatttcaaaggtgcttagaacttatgaagaaagtacagttttagaagaaagggcaaagctctctgtgacattagaacgctttcctccttcccctagttggtgagttgtgttcagtattaaattttcaaaaacataaatgtgggttgtttctatctggaacaaggaatattgaggacacttattatggtcttgttgaatgttttataattcttcaaaggctattcaacctcatttaataattgtgttttactatgatatcacagttgttaaccattccactatcttatcaagaagtgctttgggtgtgcaaagtccgggatccaaatttgtatttgtgtgatgctgatctgggcaattcacagtcagatacgcccatacctgattgcaccaacagggtttttctttccatacttgataatacaaccataatagggagaatacagccaggaaacatcagaaggagctactctttgcacctaaaaatgaaaaaataaaaaaaagaaggcaggtgggacttgctttcaccattgaaagagctcacttttcattttctaccaagtgtgaagagatgggcagtagcatagaacactcatgaagtgcctgcagcgtgtcaggtgtccttccaggttacctcatcttatcttcccaacactctcatgagagctaagtactgcttggtttacagataagtaaaccaagctcagagggttaagttacttcccaggttcacatcctactaagtgctagagctgggatgccaagtccagatctgattccaaagcccaagctctttgcagcctccggtggtgccttccaccccaccattggccccagtgggactggggacttagttcagcactcttgatagctagcttgatgtctctgtgtattgaggggcttttcactggattctgggatctggggggcttgccagatccatgcatgctccattccccactccccacctcttcttcttttctagagttgctgctgggagctccagctcagtgaaatggacagaagggcagagcaagtgagtggacaatgcggagatggcaaagcaaatggcgtaggccttgctgactggcacctggggcaatgcaggagttaggactgacgtgggtaatcagggtagcatttggtggatgggaagaatctctctcccccgcccccacctcttcttattcatcatacacatgctggggacaaaatggagggagtagcatttctcatcaacatgcccctggaaaacaatgtaaaaaattatgcagcatcctgttcatttctttgtgaatacttcacaaaatactaaatactaaatttgtggcattacaaccataatgccacatgttcctgttagatcagtcaaggctttcagtcttaacttgcttcttctttatttacctttaaatctctcagggagaacttaccctaagtctgaggccaggctttgaaaagacttgttttttgttgtttttcaaagtttgtttttattcccaaacattcgcaccttccccagccctgtaccctgcaccttggggaatttctgtagctgtttctttttcttctctctgctttaactccacaaccagccgccctcttttcttctttattgtgtgggcccagtcctgttatttggttcatccttcagtaatcaacagagttgtatttcatcttccaagacttactgttaggttcttcacctcacccccgcccccaaatttttcagcagttttatccagatctcctcttcctctctctggaccacaaagaaaaggctttctgttgttttaaattatttctctcctgtcttccatctgggggactgctgacagttttagcattctgtctttctacccattctcttttctttttgagacggagtttagctcttgtcgcccaggctggagtgcaatggtgccatctcgctcaccgcaacctccacctcccgggttcaagcgattctcctgcctcagcctccccagtagctgggattacaggcatgtgccaccacgcccggctaattttgtatttttagtagagatggggtttctccatgttggtcagtctggtgtcaaactcccgacctcaggtgatccgcccaccttgatctcccgaagtgctgggattacaggcgtgagccaccgtgcctggcctttctacctgttcttaactcgtcttaagttccttggcttcttggtcccaccctttctttctggctcccttccttttctcctttctcctctcctcagaacttgataaccttccccaagctaaatagcaaggatagacagaacatgattgtgaagtgagcagtacatttcagtttcaaaaacttcttcatgctgtaatacaggggcttgtttgttcagttacaaaaattacagataaggaatttggcatgtatttgcagctggatatttccatggttaagataatttcgatactttttaaggtctttagacatgtactgttagtcacttgctgaggaggcagaagctgtattataaggatgaagcacaaagtgtgaacaatttgttctgttcaatcctacataagaaaaaaatgagaagagttttcattggtccgttacttacatcttagaaaggatttctgaaataaaaatgtatttctttttttttttttttttgatatggagtcccactctgtcacccaggctggagtgcagtggcacgatcttggctcactggaacctctgcctcctgggttcaagtgattctcctgcctcagcctcctgagtagctgggattacaggcatctgccaccatacctggttaatttttgtatttttggtagagacaggttttcgccatgttggccaggctggtcttgaacacctgacctcaggcgatccgccacacttggcctcccaaagtgctgagattacaggtatgagctgctgcgccctgactaaaaatgtatttcttggcctggcatggtggctcacgcctataatcccagcactttgggaggctgaggtgggtggatcacttgagctcaggagtttgagatcagcttggacaatgtggtgaaaacctttctctacaaaaaatacaaaaaaattagccagacgtggtggcacatgcctgtaaccccagctacttggaatgctgaggtgggcggattgcttgagcttgggaggcggaggttgcagtgagccaagatcaggccactgcattccagcctgggcgatagagtgagacccttccacaaaacaaaacaaaacaaacaaacacaatatatatgtatatttctcgaatattaactttattcagggagctgttataaaaagggctagatggcccaacagatagttccacaaaagaacaactgttttgcagagcaaaaattacaattagctaattgcctaccatcttctctcacactgtagaacatactgtaaatccacgaatttccgcttccattttgtgaactggacatttatctaaggatgtatataaacagtattgggtgccgtgtgaggggctgtacatgtttcctcttctgatctgatcttacaacacccccaggacactatggccacatccaattttttagctgaggaggtggagagattaagctatctaaccaaggtcacatagtaagtgagtggcagagccatgttggaatcagttctgtctgactccaggacctgggccctagattagagcttcttaaatgggtggaaaccttttagactgtgaccacagttagaaataccctttacagtgagatcccatatacacacatgtgcacacacatacacacacacaacatagattttcactgagcaatactcttatgacatgctctgcatgctgactttttctctctatcctatttcattttttaaaatgctgattgtgatgtactagattgattttacaacccactgatgtgtcatgacccacagtttgcctcacttttagcattcaaacatggtgacaccttggctgtctcctccaaactcatgaacagcccagaactggatttagttgaatctgtaattccagtagaaagtttggcctttccccaggggagaccaatctgggttggggtcattgttctttgtgatactggatttactttcttttgccatggtatgaaaagtattaatatggagaatacatttgagaaaaggtattccatgaagacaaattcagacacataactttttgtgttcattcataactagtgtcttgacactgtttgaaatcaatgttaagaaaaatcatgtgacaaggttgatctattacaggaaaaactggtgatttggttcatgttttagagaagaaagatgtaatttccatatcactcataaaaaagaggcattatcaattttttattaaaagatcatgcacctcagactaaaccccactaaatgctggttcgggtcttctttccttgaaaatgtttcgtttcaaaaaagtggcttcacaaagaataggtttgtttccttgtatcccaagcaagtccacggagacatctttcattagatgtcagggagcagtgttacaatgggtggggataggattttataaagaacatgggcagatgaaatgaaaacttgctgtgttagaggtgggatatacttgtgtgactgaaccgctcctttctcctccttctccctttactcattttctaatttctgcatacccactgggatcacagctacttttatgacctccaatgggagaatgtatttcaatttaagtcagtgagaaggtactttacggaaagtactttcttctccctcacccccaaacaaatgaaattagatttttaaagtgggtccctgggagaaaacgttgctggggaatctttctgagtatgagtccaccattttgaagccttctattgatggtgccttgtgttatctgctttctatttctttgaaaacattttctgtgtgttctcaatggctgctgatttccgaacaagcctctcctaccctgttggcctctgttttgtctcttctgaagaaaatatcctgcaaaatggagaaacacatcaaccttgactgtgatccaagttattaaaacaaggaagaagttattctctggggactcgggtagggggagtgggaaatcgaacacaatagaaatgtgaaaggagtgctcagcaaaatgaatgtccctttgctggtccaagaagttcacaggctgttgggaacacacagtattcaacctgtggatgcttgagaggaaaaacaaaaaagactcaacaatgagtgatgtgtggtgaaaacaaagctgtgcgttttggtagggccaaggctgtcgaatctggagaaaatccccgctagacatggtctcatccctgagaacctgtgccaaaagagatagctgtcttctctggctgggagctccaatacacagcccagcaccttccctcgcgggctcgtgaacataaggtatccgtccaagagatttacttcttggaaatagatagcttgcttttaagtggctcccggagcctgagatgcaaagtgaaggtggggagcctcagttctgtgaatatcagcattgccgagcctactccatctccacccccagcaacaagttattaattttccaccgtttaaagtttcatttaatgccatttaaagagttttttttctttattattgccttgcattggacttggcctgaggtctgttaaccctgccaaccagaacgaagaatgggactccagggtttgataaagatggagactcgtgacttagctctgtgtccctctcacttagtgtggactgattcggaagcttctttcctttgcttctcacttttctgcttcttctttctcctccctggctgttggccttttctatccttttatttttggacatgcatttgatgaatgtattgaatttttttattatgtaagtaatgtgtataaattatagaacagttagaaaatacaactacgcagagaaggaaattaaaactccccccaaaagcctagatgaaactatgatgataatgatgttgcacaaaattttagaccctttcctgtccatgcatgtacatttgtgtcattttctttcttacaaaaatgattggcttcaggtgagattcaattcagcaaatgcatatttataggccatcacgaagttgtcatgatagctttgacttcttgaaaatattctcagcctcttaaaaaatatttatgggctctgcagacttacctccataccatgattctaactattttattttaaagcaaggaattattttcatcttgtggaggtgaggaaaaatgctaggtttgtttagatctggagaagaaaggagctgaataggaaagataggaaagaaaggttgggatggagaaggggccaagttggaaatgagaaacagtgattgtagcacagggaggtgaagtgaggttaatgaggattgataaaagtgtgtgtgtgtgtgtgtgtgtgtgtattggagagggagaggttacatcagatgagtggaagataccttaatgatccaaagcagtatttggacttctcctatccctgatctcttctgagaccctctactcaccatttatccttctgcctgtcatctgcccaagaaaagatcataacctctaggtagaagaacattgatctggaagctacactaataaaaagttatccagaaaagtgtttctctgaaacaaggagctactgcatattttagtaggagtttttctattaaaagcgaacaagtttatttattctagctttatttctaactcttcatttttaaaacaacagatgtagttctgtatgcctagatggcgactttatctaaaatgaaaacagttattttctccttgattataaaagtcacacaggcttatcattttttaaaaaattcagacgggaccaaaacattataaagaggaaaagaaaattaatctgttgtctcaccacccagagataactgtttaaaaaaacattttgaggtgtatttatatcttcagagaaaaaattctggaaacatttatcagactattaattgcagttacctctaaatatattagacggaagagacaaaagcctgaaacagatggatttaagagacaaggagaggaggtaaagatcatgctttcatggagttctgctgcaaaagggagcaaaaaaatggggttctagctggctggggaaagaaggtcgggagaaggagtggttttgttttaaattgttctgcttttatttagttatttatctttagatagaagtatctgtatgtttgtttgctgatgagaatgatcaagaggaggaaaaaatggggcaggcatggtggctcacacctgtaatcccagcactttgggaggccgaggcaggtggatcacttgaggtcaggagtttgagaccagcctggccaacgtggcgaaaccctgttctctacagaaatacaaaaattagctgagcatagttgcacacacctgtaatcccagctgctcgggaggctgaggcaagagaattaattgcttgaacccaggaggcggaggttgcagtgagccgagatcgtgccactgcactccagtgtgggcaacagaacaagactctgtctcaaaaaatacaaaaataaaaaaagaaaaggaaaaaaagaggaggaaaaaaatggtcaatgggaggggacagaatcactggaacagtgtccttgaaggaggtgggagagaaggggctccatagataagttggtggggctggctttagccagaagctgggatagatcatctagtaacaatattaatttataagagttctttctgccaggctcggtggctcatgcttgtaatctcagcactttggaaagctgaggcaggaattcaagaccagcctggtcaatatagcaagatctcatctctatagaaaacaaaaaaattaaaaaattagctgggcatattggcatgcctatagtcccagctacttgggaggctgaggtgggaggagtgcttgggcccaggagtttgaggctgcagtgagctatgatgatgccactgcactccagcctgggcaacagagaccatctctctaaaaataataataataaagaaaaagtgctttctttataagagttattttgcttgtcatatgtaatgaaaatattttctctggtttgtattttaattctgttaatggtttttttctgtcagatatttttattttatggtaaaaatagtaagtttttgtcttacagtttcaagtttttgacttttcgatcatgcttagacttttcccatcccaagcattttaaaatatttaattatttctggtattttttaaattttactttttaaaataaagagatggagcatgtcacactcaagcaaataataaaataatatttatgttgatctaggggcatctgtgccaggttgccagcagctctgaatgtggataatccagtatctattcattccccaaataagatctgataagtgcatatgaaagtgacttctgaaattactttactgtggctacagggaaattggatattcattgagtaaagtgttaaacctaagcactgtggcataaccactgagaattcctagggaatactcctggatcttttgaccctaagtctcttagggctgattaattcaagtccagcaatctgtggttcatacgagtacacagtaagtacagagtacagtatttacacggaggtttattgttttgttgtattttgttttatttggtagttgtcctctcctaagtctagcttatattataacagccccctcctcccttttcttctcagactattggtttattggaaatagcaggtcagttttctggtagaatatcccacagtctggatttggcagattgttttatcttacagtcttttaaacttggtcctctctcccctgtgtttctttttttctgttctttctctttcttcctctctctctctcattctttccctcccttcctctgccttccttcttttcttttttctttctttctttttttttttttttttttttttttttttaagacgtagtctccttctgttgcccaggctggagtgaaatggcccaatcttggctcaccgcaacctccacctcctgggttcaagtgattctcctgcttcagcctcccaagtagctgggactacaggtgcccgccacgacacccggctaatgttttgtattttttagtagagacggggtttcaccatgttagccaggatggtcctgatctcctgacctcaagggatctgcctgcctcagcctcccaaagtgctgggattacaggcgtgagccactgcgcccagcatttttttttttttttttctgagatggagtttcactctgtagccaggctgatgcgatctcggctcactgcaacttccgactccctggttcaagcgattcccctgccttagcctcccgagtagctgggattacaggcaaatgccaccatgcccagctaatttttgtatttttagtagagatgagttttcaccatgttagccaggctggcctcaagctcctgacctcaaatgatccgcctgcctcagcctcccgtagtgctgggattacaggcatgatccaccgcgcctggcctcccctgtatttcctagaggcttgattcgatttgggtttctttttttattttcttttttcctttttctttctttcttttttaggtaaatgtaattgatgagtggcactgtgttcagcctcttctcttgtgtttaaactttaaggaagcatagtttcttagcatagatccttaaacaagggggtgatggttctcaaggcttgcagcggggtttattgtcaacactgaaaagaatcaggcatttcagcatctcacgtatgagccctgagtatcgagggtggggagagaagaggggttgatgggtaaattccatgttttagagacacaagagtttgaatgtccccaggtgcttcccttcaatctgattaactctgcagaggggagaagacggaggtgaagatggggggatgcctgcctggccaataactagaggtgggagagagaaatgacaggccgaaattccccctttttgaatattcatatgaatgctaattgccttccaaaggctctttttcttttctctcttttacttcttctgttgataagggattccagggcggctctggttttcctcatctgtaaaacctcaattcctttttattaatcttcatgtgcctgtggaatatcaaagttaatcatttctaaagaagccactcttgcaatgttaagtgttttgttttttgtttttttgtttttttgtttttcctgagccaaatctcaatgtacgtgtttttagcgggaagagggctcacaatttgtgttatatgagggacatttttctctttttgcaaactttctaaggaaagtgtgtatgcattttttgtttgtttttgtttttgtttttgagacagagtctcgctctgtcgctgaggctggagtgcagtggtacgatcttggctcactgcaaactctgcctcccggattcaagcgattctctcgactcagcctcccaagtagctgggattacaggcgcccaccaccccacccggctaatttttgtatttttggtagagatggggtttcaccatgttggccaggctggtctcgaactcctgacctcaggtgatccgcccacctcggcctcccaaagtgctgggattaccagcatgagccactgcacccggccgtgtttatgcattttaaagctgtctaggaaaagcaaattttctcaggatacatttttatgcatcttaaagctgtttagcaaaatgtacagtccaggccactgccagaagtgaagcgccaaagtgcatgctctgctgataactgcttctgcttattttcccagttcaatagaaataaatatatatattttttttttggtggagggtaaacttcatgctctgttgcacataagcagccatttccatcagttagccttgtgctttctttataccaaaggcccccaacccccgggccatggaccggtagtggtctgtggccagttaggaattggtccttgcagcaggaggtgagcggcaggcgaggtagcaaagcttgatctgtatttatagccacaccatccctcgaattactgcctgagctccaccttctgtcagatcagtggcgacattagattctcatggcagcatgaaccctattgtgaactacacatgtgagggatctaggttgcactctccttataagaatctaactaatgcctgacgatctgaggtggaacaatttcatcccaaaaccacccccacctccaccccacccctggtctgtggaaaaatgaccttccagaaaactggtccctggtgccaaaaacatgggggaccactgctttatgcaaaactacatgttgtgcctccaagtagaagctgaagaaggctaaagtgggaatgtttcaaacctgtccttccccactcccccaactctcctctaccctagtcctttccctctaccccagttcacctttaaaaccttcagcatgcctaatttcattcatcccgctggagaaaagagctgggagtcgttcaagtctcatgatgataaaagtgaacctgtagggtggggttaataccaccaggattatccagctcatttggaaggaagaaaagcactgacctggactcaaactctagctctgccacttgccatctgactgtgggcaaataacgcaatgtctccttaaacctcagtattctttgctgtaaaatggggataatactacataagcaacagtttaacacttattgagtgcataccaagcactgtgatttacttacctgacctattgcatcagtctgatgcgggaagtgctgtaattttcattttacatgaagctgaggccagggaggaagttgtcatttgtgtaaggtgatggaacttaatgaatgactcctagggttctaaggattgaaaaatatatatatttatgtataagtatatattctgtatatatttatatattcaacatatattttattatacatttatgaatatattatatataacatatatgtatattaaaaatatatatattttttacagacagagtcttactcttgtcacccaggctagagtgcagtggtgccatctagagtgtgtgttttatttgacccgacagtgattctttaaaatttcaattattcgcaagaacttataactcaggtgctctcaaaaaagtccagatttcctacttttctttgagaatggaaaagtatagcaatgctgggttcacattgtttacagttattggctgggagagctgagtcgtggctgcctctgttggtcagagggtgatgtggccagggtagccgtccctgtgagttcaatatcgtctcattctttagggtcgccttcattttacttgtcttacttggcccctataggaatatttgagttcatggctctgttttaaattaaaaagagtcaatccatattctgaccaatttagcaaacacatgaaataactgcctccttatccaataaccgggaaattcatggagaataagagaggtgaccgaagagttgagacagataaatgtcttagttttcaagtaggaaaaaaacccagtggattctggaaaccacagagttagcatgaattcttggaaaagttattaggccagatctttgagaacaagctggggagaaaacagggatcatgaccaaggttggttagtggtatgcaagacacgtgcccaagtccgtttctttttgggtagaattaccagtccaatagtggaagttcactaatattgtggctcttcattgcaaaagatatttgatatttttgatgtccttgtggacaaggtaggggatgatggactaaatgcttaaatggatgatttgtgcttggttgaacaataaaaccaaaggaactgttgtctaaagtatctttgtcaagttggagagtggcttctagcacagagtggtctctgtggcaggacaggagaagcagtcatattaccctgaacctcctctcccgtgactttacctgcctgccccagactcaccgttcttttccccacttggaaccatagcctcatgacaccttgctgtcaattcctgtgatcttcctgactatcttggccaaggactcataaatcccttctccctgtcattcagcagggtcaattatcttatgtctcaaaaggaagtctactaggaaacaaaacagaaaaacatgaaaactgtttgaaatctttttttttttttttttttttgagacagagtcttgctctgtcgcccaggctggagtgcaatggcacgatctcggctcactgcaactccgcctcccgggttcaagcgattctcctgcctcagcctcccaagcagataggattagaggcacgtgccaccatgcccaactaatttttgtatttttgtagagatgggtttcacaatggtggctaggctggtctcgatctcctaacctcgtgatccgcctgcctcggcctcccaaagtgctgggattacaggcgtgagccaccatgtccggcctcagtcactgagtttagaggatgcagagaagagcagagagtctttgtattcaaggccaagtttacaatggggcagaggagatacacacagatggctgtaaaatagtaatatttgcggctgggcgcggtgcagtagctcacacctgtaatcccagcacaatgggagccgaggcgggaggatcatgaggtcaggagattaagaccatcctgcaacacgttgaaaccccgtctctactaaaactacaaaaaaattagccgggcgtggtggcgggtgcctgcattcccagctactcagaagactgaggcaggagaatggcgtgaacccaggaggcgggggttgcagtgagctgacttcatgccactgcactccagcctgggcgacagagccagactctgtctcaaaaaaaaaaaaaaaaaaaagtaatattcattcagtggttctccaggagtccgaaatgagaagacagatttcagcttgtttttaaagctctcctaaaatggaatgggctatcttgaaaactagtcaccagtcatgttgatcaactgttgggcataagctggaagagatttctgctccaaatgggggttggtgtagatggcctttctggatcctttctatctctattagtctatggttcccagaccgagttgctttttaaaaacttatttagagagaattgctaccacatcagatgccagtacgttgtacttggtgttctgggcacactacattgggaagtgttgaattgcaggtttccacagtgtggaattgcattggtgtgtttgtcctttggagacccaagtccccataggcgggggcctggctgttttttttttcctcatggaccttgtaggagaatccactggcatatttggcaggtacagtcttgttgcttgttgcttcttttgtttgtggtttgcatccagctgtgcaaattgctgttccctttgagtgtcacaccacttaatttcatgagacagttgtcttcaggaaagtctgttcccatgcccccaccctccaggaacccagctaacacccagagcttagctgtcaagacagatttctaatttttacccttcgatggcagaactttaatgttgtgtccctagaaatccttcagccctagaaaatgtggaaagtaggccaggggcagtggctcactcctgtgatcctggcactttgggaggccaaggtgggagaatcacttgagcccaggagtttgagaccatcctatggaggacttagcaagaccctgtttctacaaagataaaaataaaaatcagctgggcatggtgcggggcacctatagtcctagctctttgggagatggaagcaggaggaacaattgagccagggaattcaaggctgcagtgagctatgatcgcaccactacattccagcctgggcaatagagcaagctctaaaaaagaaaaagaaagaaaatgtgtaagtcacattgtggctccatgcagatgactgaagcaagcaaaggcagcttctcttcacagcctttgaggcaaaatgttctggcagcaccatggcaccattctggtactgccctctttctgctgccaaatggccattgtcatcacctctcactttcccactgtctgtaccaagtaattgaaaggaaggcagacacagcctctttctcctgacaaacacattctaagggtcagaagggcatatgttctttgggtttggcatttttgcccaatttttgcaggtttgaccctggggctacttctttgagacattccccctgccctagataagtcaaaaattacttgaaggatgtggagacaagatatggtaggttagaggggcaggcagttctttctaaaatgcttagagccagaagtaaatgtgaaaccctacagcttctgtggccctagggggtgtggacatttcagttgtcctggcagacactctttccttcaggcactctctcctctgggtgagtgagtattgggtcaactccaggcttccccacaccacaccagatggagtgggctgatccacccaccagcttacctgcctccctgcccaggacccctggaaccaactgttagagtaatggaggcagagaatggaattctcagtgctgacagccagtttaatcccacctggaggcttttaaaaatgctgatgcggctgggcctggtagctcacacctgtaatccccgcactttgggaggcagagatgggtggatcatttaaggccaggagttcgagactggcctggccaacatggtgaaaccccatctctactaaaagtacaaaaatgagccgggtatggtgacgtgcgcctgtaatcccagctactccggaggctgaggcaggagaatcatttgaacccaggggcggtggttgcagtgagccaagatcgcaccactgcactccagcctgggtgataaagcgagactccatctcaaaataaataaataaatatactgatgcatccttctcggaccacacccccccccgataattttttaaaagcagatttatagattgcacggaccgtatgattcaccgatttagagtgtacaatgcaatggtttttagtatattcacagttgtatgaccattaccacaattttaggacgttttcagcagtcattttctttgccttcccaactcccccagttcaaggcacccaaccactaatctagtttctgtccctacagatttgcttattctggacattttatagaaatgcaatcatactacatgtggtcttctgtgaatggcttcttagcacggtattttaaaggttcatccatattgtagcatgtattggtactttattccttttcattgctgaataatattccattgtatgaagatactctctttgatttatctattcatcagttgatggacatttgggttgattctactttttggctcttaggaatatgctgctaatgcacaatgtatacaagtttttgtgtggacgtctgttttcatttcccttgggaatatccctaagagtgggatttctgggtcatatgttaactttatgtctaaccttttgaggaactgccagatattttgcaaagcagctgcatcatttcacagagctatttcataagagctctcctcggtgcttctaggtgtaattctaatgtgctgctggtgtgggtgaaaaacctcagtctgcctcatctcatctggaagtaaaataactgtagagcagatagaggcattgtatctgaaggagagaataattttagaacagaacattcgttcctttcaagttgtccttttcagcattgcacatctttcagctcttcctatgtagtcgaagcttaacctgagcaccagttaggggactagtcagtggaatgctggaggaagattcttcagtgcccacctacagcacaggctggctaccaagagttaagctgatctggaaaactgacctgtcatttaagcagagtgaggccacagatatgtaatccccacttctgaggacatgacatctcttcttgcgtcatcacttttttggtgctatctggtaaaaactgagtcatgaggtgccgacaaattcagtgcacttaacgtgaagcttgaggcattctgctcattcctgagatacctgcagctgtcagccctgccgtctagatggtaaacaacttgccgaggatgaaaccctgccactgtggtcttcctcggcttgtctgagcgagacctagaccgtgacggtgcacgcctacgagaatcggaggatgagggaggggctgcgaggtggcggccaggatccaggggcctcgccctccgcagaaccctgcatctaaagtggccccatggagggaggcaaaaaccaactatttttgttctgtgagctttaaaaaccatcattccctcctgattgcagataagcatttccaaatggcgactgtgagccacactgagcctttttcccttctttgtgtttgcagccacagcacagggtacgagagcgataaccacacaacgcccatcctctgcggagcccaatacagaatacacacgcacggtgtcttcagaggcattcaggtgagcacacagacaggccccagcgggaagggggccgcactgcctcttcctacttaccggccctttagttccttactgatggactctttggccctggcagcctcttcttcactgcaggctcctttaacatcagggacacctgctcgtcccctgggtctgataaggcggctgtgtcctctcctagagaggctgccccgctgcctgacgctgcgcaagatgcgtcctaacagaatcctctcctttctgcctttactgctccatttgacttctccagggcgggctgtgcagcttttgtatttaagctaattgggcttgaattaaccgcttggacctttgacttctaagatttggtctacatcgtaaagtgtccacaggtagactcacatcttgccaagtgttgatgatcatcatactaactgtaccgcctatggctggacattttctatatactaggcattgtgctaagctttatacatggactttagaaaaatggactttaccctattagtaccattttgtattgatgtggtacatttgttataattgatgagccaatattgataaattattgttaactaaagcccatagtttacattagggttcactttttgtgttgtacagttctatgggttttgaaaaatgcataatgccatgtacctattattctagtatcatacagaatagtttcactgcccttaaaattccctacactccacctgttcttccctccctcttcttctcttcccaataatcaccggtcttttttttttctttttcttttttttttttttgagatgggagtctcgctctgtcacccaggctggagtacagtggcgctatcttggctcactgcaagctccgcctccagggttcacaccattctcctgcctcagcctcccgagtagctgggactacaggtgcccaccaccacgcctggctaattttttgtatttttagtagagacggggtttcacagtgttagccaggatggtcttgatctcctgacctggtgatccactcgcctcggcctcccaaagtgctgggattacaggcgtgagccactgtgcccggctcggtcttttttcagaatgtcatatagttggaatcatactagatgtagcattttcaggctgacttctttctcttagcaatatgcatgtaaggtttctccttgtctatttgtggcctttcccccttcatttcatctgcaatacacacttatgaggtgggtactgttattctctccatttcatggatggggaaactgaagcccagaggtgatgaataatgtcagaatcacatcgctagtaaatattggagccgagactaataacacaggtcttgcctgacttcagaccccctgtttatacctacttcacgatactgcttcttagggaggcagaggatggtgaacagtttgtgggagggagaagtctccaaggagcatgaagaaagtaaagtataaaggtaaaagttttggagaattcaatagacacttttggtctgccacctccgtagaccttcagtctgccttccctgcagagtctctgttttgggtggtcagaagcacatacagttactaagggtttcatttatggcttataaacatcaatccatggctgcaacctgagtaacagcagtgatactttcaccagaatggtcagtactctagatataagttgtatctgggccagaccccacatgatacgtggggcaagtagctctgagatgttctgattaatgtttccagaagtgtcacgaagaaagaacagtgtgctccctactcccaagcctttcaatggagagcaataaaggcaagggttacagaaatacggaaatctgacgacggtttagggagacatcaagcctctcccctgacgaatacaatcagaatccttcaccgggacccttactgagattaacaactcctgttcccatgtgcactgcttctaggatgaattaagggaaatggaaaatgcttcctttgctttctttcccatcaagcccagtttgtcaggctcacttgccatggcctctaaaacactccagaccagacaggtattgagtattccaatccaacagctggctcaccatttaattttatgccttcattatccctgagacactatggcctattaacatcaatgttgtgttgtatgtcactgcagcatttattcttccaaaaaagaaaatgacctttcagtgcagggcaatgtgaaatagggactagaacataagcatggggtagagtggaaaatgcacagggcaaggagttggttatattcagaagtggttccaggtcttagcacaaaacatggatgcactttaggccaggcatggtggctcacacctgtaatcccagcactctaggaggccaaggtggaaggatcccttcagctcaagagtttgagaccagcctgagcaacatagggagaccctatctctaccaaaaaaaaaaaaaaaaattagctgggcatgatgactctcacctgttgtcccagctgttcaggaggctgaagtgggaggattacttaagctggtgaggtcgaggctgcaggagccccgatcgtgccactgcactccagcctggacaacagaataagatcctgtcttaagaacaaacaaaaccaaaacatggatgcactcttgtgtcagcatctcaccgcctttggggttgatttactcatctataaaggaatgaggagaatttagtggccactcaggcacttgctcagctcccatttatgactccctgaccccaagaagaggaaggggagcttgcctctttgttttcctccagttcttattcttggaagactgacaacacacacactgcacttccacaagataaaggggagcaacagatgccctgcaaaggacgtgtgcagagcacagaaggcagatggattccagtgctttctggcctcactattaaaggttgtgctggcttcaccatggccttctggtgggttttgcttcctttcacagatgggatccccaaatccaggggcttcttcttccttgttatttacttatacttggacgatctggtcagttaggggctcattcattatcccacttttttctaataaggatgtccccacccattgcagactggctctaggtcatgtggtcatgactccaagtgggagggagtagttagactttgggactttggacttgcagacatcactacctcaagaggagaagctgagagatagaatggattgggagctcttccaggtaccagcatttcttttgcagaggctctgggacagccatttcatgtaggtttcatctcaacagccacttctggttgctcagtagtgatgatcttagagcactgcattgtagaatgtcctgatctagcatccattactgatgtctgccatggggatctggagtgtgaatgggagtggttttaggtctgcacctgccaccccttctttggatatactccagtgctcactctccctcaagacctacgtgaatgttcacatgtggcttaaagcctcccttcctcttactctctgcctgcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtaagtgtgcccgctgtccagtcttgggcaaacatggttcaagagctccttttccaggctctcacactgctaaggacccaggttatttccaggatggaaagtaagcactgctttgaaaggtctgatccaggtgttgtaaagaggctgtggggccattttgcattctgattatctatcctttattacagaggtcagtaaactgtcttccagaaaggcagagcagagtggtagagagaaagtgccacagaattaaagagacctgtgtaggaatcgtgttggtgttagaatactattagcatttctaaggagagaggagctggcctgggaatatagtcatcagatggttttaggaggtcgatgggcaagatcattgtgaaattttagaagagatggtccaaagaaaaacttacctgcttgggtcagtaataatcaactagacaggaaggggaaaattgattgttagtttgattttttagtgatcacttaaaaaaaaaaggtcagtcatgggggctcacgcctgtaatcccagcactttgggaggccgaagtgggtggatcacccaaggtcaggagttggagaccagcctggccaacaaggtgaaaccccgtctctactaaaaatacaaaaatgagccgggtgtggtggcacgcacctgtacttgggaggctggggcaggagaattgcttgaacctaggaggcagaggttgcagtgagctgagatcttaccactgtactccagcctgggcgacagagcaagactctgccaaaaaaaaaaaaaaggagagagagagatgatgattttttatctttgaagatacgccaatgaaactggattttcccccaggtcagagaggctgcttctgggaaacagagaactggcattgtttggtgttggccaccttgaatgtggacagccatgtcacagaacgtttactctgggccttgtgggcactaggtgggagtgtgggagtgtggtaaaacccaggttttcctacagaggagctactgctgccttttccacaatcgaagaacagcattattataggatcactgttgcaactgtgttattactgctgattttgctcttgggaagctggagaaaaaagtgagctgcattcagatttccttggaccattgaaatttgctaattcactgtgtccagaggatgcaattctggtgtcaatctgagtttgcactcagtgggccacagactttgaggctaaaaaggaggggaccagtggcatgttatgtttttacacatttccccaaatgggatcatttgaaaagtgactgtcaaggttataaggaaaacgagaaagtaaagtcctgcctgaaaaatgcaagggaataaatgaaggcaatatggttgtagaaacttttagtgagagagaagcacttagaatgcagtgagggttagacaactgtgtgaagggaaggcagtgaacaagacagccaaaaccccagacccactggagcctttaagaaactcttccttgcagaagatgagggcaggttggtatttaacaatcctacagtcccccttgaaagagagcaatattttcttatttatttataacaacagtacagactgttatattaagtactttttgggtgtcaggctctctacatgtatatttcatttaatcctcactcacaaaacatttatgaagagtataggatatagcagaaagaggactcaaactccttctttttaactgcaggttataatcctccttctcaaagagttcctggtttgtttgggagctaggatataaagaaatgaaaagtgactgagagagtacatgatcatgtactaaatcagagacaggaggtaccgaggggtttggagggtatcagtttgaactaaggtcatccgagaaagtttctcagaggaagaacagcttgggttagccagtggaggctggtagtttgggcagagaaagtgatagatgagcagaagctcaaaggcaggggaaggaaatcagactcaataggggtaacatcttctccagctcacagaggtgaaacataaggcaccaacctggatacaaatacaaagaaaggggccaggtgcagtggctcacacctgtaatcccagtatgttgggaggcgtaggcgggaggattgcttaaggggttcaagaccagcctgggcaatatagtgagaccctgtctctaaaaaaaatatttttaaaaatttagccaagtgtgctggtgtatgcctgtagtcccagctactcaggaggctgaggtaggaggattgcttgtgcccacggtttcgaggctgcagtgagctaggctcacaccactgcgctttagtctgggcaacagagagagactctgtctctgagaaaaaataaaaataaaaaggctccagcccttaggattttccaacccattgaagaattgtagaattgtagacccagacacagctcaccacattagacagcctggaataaatgtcgtaatgagggaaggaagggaaattggcccatgcagtttccaagcaggcattgcagaagaaggagacacccaggagacttttcgatgtggagatagggatgggggacatttagtgtgagcagagtgcaaggaggacttcaggatgtgagctctggcatagtggggaatagagattcatgagggaaatagcccaggctttgagattggaaaggtaacagggggctgcctttgcaacagaaagacctgactgattctagaatggcttgtttccatcccagatgcctgtgactcaggattctcctaagaaggtgggaaggcctggggttgctcacttctcttggggctcaggtcccagtatttggctgaactttctctagtgaggacaggggtgaggcttctccattctgagacaggaggttgggtaatcccactactgacttctcttggataaagcacaccaaaaactttctcagtgcttttggtgtgttttgagggtctcacaaccatggagtcatatttgcttgatgcaagaacaaggagtcagtagcaaagaacaccagatctttgggccctaaaacataaaactcttatttcatgaggttgacctcaaggcacatgcatcccagaattctgcctcagattctgcctgggagttaaagattttgttttttatttgctaatagtttttgagcacgccttctatgccaggctctgggctgagccctttatgtgaaggtcataaatcctttaaagttgttggattattggacccattttacaataaagaaaccacacctcacccagggctttttttttttttttaatggcagagctagatgtgagccttggggcagaatcctctggcccctgagctcccattcatttgtaacttgcaagttggggatcatcctaccctaacaagctccagcgaagtgccttaggcattttgggatctgttcagtcctagtaggagaggttgcctttaatgagatccccttttccagtatcattttcaaatagaatatgtgtcttccccaaggtgagaaaccataccagtgtgacttcaaggactgtgaacgaaggttttctcgttcagaccagctcaaaagacaccaaaggagacatacaggtttgtaggttcacttctcattgctggcagctgtgttcccttgggctagggttgatttcatgattctctttgttgttgaatatgaatgagagagtcagccatgtgtttagtttttccagtattttccccccataatctctggagatgttcctcctcttaaataaagaaaaagaaagaaaaggaaacaccccacatttcccctgcaaaccacagaacagtgagatcccactagcagtgggctgatgatacactgagcatcagcaaagaatgagggtgatggagagcggaatccaatttgtagcgtgtgattcacttttcctgtctctgacacagctgagatcttccagctggtgagaagctggacctctgtggttaaggaatggttgttcccaagacagaagcaggtccttgaagattactgtgcagaatcagtgattcttgttgggcctgggggactggggaaatctaagggtgaggcagatgcagacattgcaggcatggcaggaaatgctgggctcctccagctgccggaagtcagccttgtgggcctcactgtgcccacattgttagggccgaggctagaccttctctgtccatttaggtgtgaaaccattccagtgtaaaacttgtcagcgaaagttctcccggtccgaccacctgaagacccacaccaggactcatacaggtaaaacaagtgcgtaaacttttcttcacatttatttttcattatttttttaaactattgtggaatgaaattgtgatgagagggattggaaaagactagtgtaaaagttctaaggtttagactcagttgagagaaggaatagtgcgtggctatctttaaataataaataataacattttttaaagaaggggagggtggaaatacagagaaggagaaagatgggaaaagaatggctggagtgtgcagaatgaaaatgaagagataagccaggtccctactgtttccagtttgttgcatcacacattttgttactctctttgatacgataatcaactttacagaaaagcagcagaaattctagcaagccaaatatttattcttctgagagcacatgtttaatggcactattttcagagaactgagtccttgctctgttaaaagttaatgcaccaggagcggtcttggtttctgctggaccagtatcagtgtgtggatattatttccttcatactagtacagagaggagaatagggcattcatttactggctgctgaaggtttttgctttctgcaaggctggtgtgattcataataaaaatagcaccacctttgttgcatattttctacctttggaaagagcgttaatatttagcttatctaagtctatcttcacaacatgcttgtaagtagagtaaggtaggaccggctgtggtggctcatgcctgtaatcccagctatttgggatgaggtgggtggatcacttgagcccaggagttcaagactagcctgggcaacatggcaaaaccctgtctctacaaaaaatacaaaaactagctgggcatggtggtgtggacctatagtcccagctatttgggggaggctgaggtaggacgctcactagaccttgcttgggaggctgaggctgcagtgagctgtgatcccaccactgtactccaacccaagcaacagagcaagaccctgtctcaaaacaaaacaaaacaaaacaaacaaaaaaaaatgaggtaggcatgttttattcccatcttacagatgaggagactgaggcaataataattcaatggcttatctaaagtcacaaagctagtaaggagcaaatccagttctgtctgcttccagcccaccttgtcccacttgcttctttattggagaaggggcagatatttactctgcagtccagggagcatggagagtcaagtagagaatcaaagtcagcaaagctgaacaccactgagagactgagaggaatgaagatgacaagagacagggttgggattagtccattaggagccagcccttaacagcactgctggaggtggggttggagagtgagagccaggccaggaagagcagaggaacagcgagtgaaggaaaacatgacatcacaaacccctgagcagccccagattcttcgcccaaattggctgcatttaaaaacagagccaaggcacctgtggcccatggttggcaggatgggatcttgcttcccttcctcaggtgcctttgatgcttctttaacttagtcctgagctcataattcggtggcaaagtgttatagtccctttgacacggctgtcacactccccaagtaagtgtgacatgacctgttttgccagcagactgtttaataccacatttgattggcctccagtctgaccctgggacaccagccctcctgggacatttctcagtgcttgtccaaaccagtagttctcagagaaggccaagtgggaccagcagtatctgagaagatccgtcaggtggcacagggtttagcttctgtgcattcttccttaagatggagctgcagctgcttttccatcatggctaggcctgggaggtgtgatacagggaagagcacgggctctggaattcgacagacctggagatttgagttctgcctggatctgccctcaatagatgtcctacctcatctgtagagtggggataataacgcttcccctacgggcagttgtaaggagtacatgaggttgtgtgtgtgcgtgtgtgaagcccagcacaaggcttggcatatgttaagcatcaaataaatggtagttattctccctaatgagaatgaggcttggaaagaatgtctgagggctctttgggtggagaagcctcaatcttttggcaagcttattaaaaatctaagaaccacgccccaactagaatcttccatataacaggattatgctctcagtaacactttaagagaaaaaaaaaaacaacacataacatgtaaactggtatcagtgatttattttaaagtatccagcccatccagggtatctacacagatagaagtgttaaaagcttcagtcacagctgagatccctggacagtgatcactcagtaatacccagggtagatgacccagaggcttctgcagcccagttcatctcagttcccaacttactcaacaagggggagaaatttacacagttcacaaaacattctatcagcagagactgaaacaaacgtttttccccttaattatgaattgctcagacatttcccccaacttgactcattctttatctcccactttccaagttttctgacctaagaatataactttttacaatatttcgatccttaaagccccaagaggtgctgctgtttcaaggctgcctgggaaatgagctcagttggttagctcagggacagaatgatgggaaattcagagtgggtgccttgtgatgacttcactcgggccttgatagttgaacttgtgcctgtctctttgttgcaagtgtctctgactggcaattgtgtcaacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaagtggcaagattccatcagctgtattgtgttcaaatctcaaggccactgagcctcttttaaacaggtaagagaagacgccaccgacatcgacggctactagtgagcctatccaggtcctgaccacaatttatttctctctgtcaaacttcaggagggacttatatgtcctagaagcaacagagaatatcttcaccttgtgttacagagtgattgtgctcatgctgtggttgaatggggtttgtggatgatgtggtgattatgttttaaggttttaaggtttattttaagcagattgtcattgcatcccatcatcccagatcagcaaaagaaaatagagagatgttaatgacaactagtccttttgaaaagttcagatacatcactgggagggcataggctgaacacctagtacaattgaatttacagctgtacttgctataaatcagctcagcagattgaaaactgctcagcctttccagggcaactgagtgtgaaagcaaagatctatattatctataaactataaactctctttctgttctggtgtatggtttttgaattgtaaataaggagattaatttggtgcagcccctctcagctccattatcttggggcttgcatgcattccgggttttatttcttcatttaaaatgcgtctcaaacagatggaagcctagctatggagactgttttacattgaagtgcagctcaaagtttgggcagcctaaaagtcaggtccagaggcccctcttattttgcatctggctcttgcatcactgttaattatagcgagtgtggtgactcatttatatcagccgtttttatcttttcctgccagaagacagcatttctctggagaagctcaggacaagcatggcaaacgtcagcgagtcggaaagagccaggtcttacaacaaaagtacagccacattgattgtttcaactgcacagggaagaacagagattctcagacgaccctgtaagtttagcttgcagttaagatcatgggctatggaaagcagaccaacctggcttcaaattctaaatctccagtttctttatctgtgaagtggggacaaaagtccctgcctgataggatcatagtgaggtttaattttttttaagtatgaaaacatcaagtacatagcaaatgctcataaacattatctaggaaaactattacccaagaaattactggctcatttcttttacctctccctcctccaggcatcctcttgcagtatctagccatcctcacaggtcagctctgaaaaatggtaaaaagtccattgccctctaccccaacccagagttaataacttttgcagcaattgagcttcttgccagccttgccacagagaccatctctgcttgctctgtgtcttctgtaaagcacttgtgaacactgtatgtgtttctgagacccactgtgttactcttccatagactgtgaggagttagtgggtgaaagtaggtcagtgggagctccctgtggcccaggcttgaggcggtgttgggtgcagtggtcagcatgtgcacttttccatcttgctttatttactgcagcacctggtttagcatatgactcagtactcccagctccccaactccctctgctggatcttcccagactcttccagtcacccggagccctctcttctctgaacctctgtagcatttagagtacctttaacattaaatagtactttagatcagaatagtgctttcccatcctttttgatctttaggacaatcctgtaaggtagacagggcaagtgttattcccactttacagatgaggaaattgaggctcagtagaagtaagtggctaaggcagctcttagtcttggtcttcagcatccaggtgtcgtcctcccaaaacatgcttggtggtgtagacttgcactctgctcccttgcctcatttttatatatcctttttttctttttggctggagtatagtggtgtgacctcggctcactgcaacctctgcctgctgg

SEQ ID NO: 15010 - DNA, 51754 bp, Human; identical to SEQ ID NO: 15009

SEQ ID NO: 15011 - DNA, 51754 bp, Human; identical to SEQ ID NO: 15009

SEQ ID NO: 15012 - DNA, 51754 bp, Human; identical to SEQ ID NO: 15009

SEQ ID NO: 15013 - DNA, 8321 bp, Human
tcatcatgttggccaggctggtctcgaactcctggcctcaagtgatctgcctgcctcagcctcccaaagtgctgggataacaggcatgagccaccgcgcctggccaatttattctttacctcttggtaattgtgtcttatttctcagcttatttccttcacagcatgaaattatatttattgtttctctccctatcaggaaccttgtcttattcattgttgaattattagcacctagctcagagtttggtatataataggagcttgataaatattgagtgaatgaataatgaaaagcatacttggtttcatgaacatgaatacctacttggaatttttaaaaccactttttcttccacagactggacttgagggacacataaagagaatccaccaacacctccccctccacacacaccagcttcccattctcccactccaactctagctataggagttattgttcctgggccgggcacggtagctcaagcctataatcccagtactttgggaggccgagttggacagatcacttgagctcaggagtttgagaccagcatggccaacatggtgaaaccccatctctactaaaaatttaaaaattagccaggtgtggtagcatgcacctgtaatcccagctactcggcaagctgaggcatgagagtcacttgaatccaggaggcagaggttgcagtgagccgagatcacaccactgcactccagcctgggcaaccatgcaaaactctgtctcaaaaataaataaataaaaggaattattgctccttggtttatgtcccagatggacttttgcagcaatacagtgatgtggtagtaaagatacaaggctgaatttgcagttgtctagacttaatttaatatagagtatccaatttataccttgtttttcatgttcttcactctaatgtcctggtaggattgaaattgtatctgaagtctgagcacactgcgtgcctagggccatagtagacctttcttcaaatttaaattagctgaaggctggttgtcctgtatgtgaaaatgtaatccaaatatcctgattaggcacaggccatcccaattaggtgaattatctgaagtccttgctttttatctgctgacatttatgattagaaagccttaaagcagttaaatttcattaatggcattcatttgtatcttattacagattgcctgtttcctgcaacccaaagaagctgctttccttctccttatctaatatttaagtttgaacatatattaagcatacctattaaaggaactatactggtggggcacagtggcttacacctgtaatcccaacactttgggaggccaaggcaagaggattgcttgagctcaggagttcgagacctgcctgggcaacacgagacctcatctgtacgataaaacaaaaaattagctgagcgtggtagtggtgcaggcctgtgattccacctactcaggaggctgaggttgaggctgtggtgagttgcactccagcctgggtgatggagcaagaccctgtctcaaaaaaaaaggaacaattctgcagaataaggaagggttaggcatctgtagccctacgtgtaaaccctttctgctacagtctccaaaagtgatccctattagcacgagttctttctctctccatctgtagattatgaaaaataattctgagtaaagatgctaggagagcattcatttattagatgcattccatatagacaaagtatttaccaagaaacaagcccaggagcagggaaccaccaggttgcctggtgaaccagcctagatcagaaatggagcaggtcaaaactcctgtactgatcagtagtgggatcatgcctgtgaatagccattgcattccagcctgggcaacatagcaagattccatctctaaaaataaaaaaaagagataagatttttatatccttaaattattatatataattctttctcttaaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatggtgagtgccataggaggggcaatgcaggccctttcccacccacttgggtaatagaaataatggaattttagtactggaagcttattatctttaaaggtcagtttaccagtgaggataactaaagcagacccaagcaagtcaagtcatttgctccagattatgtggcaagctacttacagagtcacaccagaaccaagattttaggcttctttctttggtggtcccttctgaaatcgactcttttctgaattaggggttctggtctttatgccttgggtggaaaagagaaaaagacaaaagttggccaggcacagtggctcatgcctgtaatcccaacactttgggaggccaaggcaggtggatcacaaggtcaggagatcgagaccatcctagctaacacggtgaaaccccatctctactaaaaatacaaaaaattagctgggcatgatggcattcgcctgtagtcccagctacttgggaggctgaggcaggagaatcgcttgaacccaggaggtggaggttgtagtgagccgagatctcgccactgcattccagcctgggctacagagcgagaatccgtatcaaaaaaaaaaaaaaaaaagataaaagttgatggtgggggcccaggagaaaagttgatggtgggggcctagtagaatactcatgctcggtgcctgtggtggtaacgctaacatgagggcaaaagcctcccactcacgtgaatgtctcttattatccagatcttctacttttaaatgttctaagcttctttgccccaaattctcatttagaattttcattcatctctaactgacttgttttggttttctggcagcctatgaccttctactttggctttaagaatgtggaactactgttttccggtttggtgatcaatacagctggaggtgagtaagccattaggtagtgttggaaggtgatagtcacatgagagacagtgacaaataatttggaagtccagcacctctttctgtcctaattactaagtcaacatggtaatgatgcataaccatcttggttcctatttcctacctagaaggtaggaaacacagtacttttttggtcctctggtaaacctctgttaactaacatgtatgttttggagctctaaaaaataatttagataccagatagaatcttttgcaatccattttctttcattcttttccagagtgtttaatttttttttttttttttttttttgagacggagtttcactcttgtcacccaggctggagtgcaatggcagctatcttggctcactgcaatctctgcctcccaggttcaagcgattctcctgcctcagcctcctgagtagctggagttaaacaggcacctaccgccatgcctggctaatttttgtatttttaatagagacggggttttgccatgtttgccaggctggtctcgaactcctcacctcaagtgatccacccacctcagcctcccaaagtgctgggattacaggcatgagccaccatgcccggcctcagagtgtttacttatttgataagttattagtcctggacataagactaactcaaattaagtaccacaaaataagtttaaaactattgttctaatacttcaattttacaataaattaagtgccacaaattgtgaaatgactcgccatcaatcatagagttaatatgtcagagctaggacaaggacccagaccttctagagctacctagaccagtgttcttttagtctaccaaactatggcccacatccttcctgattcttggcacggcccatcttagacactcctagttttgaggtagatgattacccatctgtttgtgtctattatgttgtatggtatactttaaatttaacttgcgcaaactcaatagtcagttggactgccttaggtaccagatgtctgtttggagccataaaatcaatttgttttgggaagaaggagagcatttagttcaggtaatgtgttaaattagcagtttgaatacatttatatcattaccaacacttcacagtgtgaaagacttagaattgaaatgcctattcaggaaatgtagtcagccactgatgaaactaaattgttttattccctgttccatattctacattgtgtgtttcagtgtaacaaacctaatttaatgatatcaagcagtctgaccaaaaggttattgttgttctgattatttttcttatcttaatcagaaagtaaatatgttcttggcagaggcaatagttttcagttacaccatcttagccgttctcctatctgagcaagagaagaggtaaaaatataatgtcttcaaaagctgagagtagcattttttctatgtgtctttctagctggacagcacattggctaatgattttgcacatgtttgacagtacctccatattttccttccatacttagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggtaagaactgaacagatccagatgaagtcctaaagaactcgatcagttaagcagcaaagcgcagctgtgtgatcagcagcagccctcttcttgagttaggagttctgtatgaccttgatcaaaactgtccttggaggtttgggtttgtaggtcatgagcaggccaaaggaggaatgagagggagtcttctgcaaatatgaatgtttgttctgagttgtacggattggccactttggaagaagggaagtgaggaatccatattttaaaatatttaccaaaataataatgaacaagttaagaaattcagatcaagatataaaagaatggcagattgcagttgattctataaagttacacctagtcagccctgtcctctttttctttacaatgtaagactgtattgatttctgtgttctgtctaagaaagtatttggatgattattggtttttcccatagattggcaaatgttttttgagattgttttaataaaaatgtaagtcttaaaaccaaattggaccttaagaaatcctatagactgatatcctgctttcaaacaagcagtgttatttattgtactgatgagcttactggggcccagaaggattgtgacctacctaaggtggcacaggggatgagtagccaggtctccttatccctaattaagtaatttcttctatactacccaaccctcaattctatttttttttctttttttctttctttttttttttttttctggagacagggtctccctctattgcccaggctgaagtgcagtggcactatcttggctcactgcaatctctgccttccagactcaagtgatcctcccacctcagcctcctaagtagctggaactacaggcatgagccaccacacccagctaattttttttattttttgtagagacaaggtttcgccatgttgcccaggctggtctgaaactcctgagctcaagcaatcagcccacctcggcctcccaaagtgctgggattaaaggcattagccaccacccccagcctctgtttctgtttttgtagaatgtaaactttgcaaaggtgggaagcctaaaaatattcgggcagatgagcgtgagagggtttacggcttccctttcaggatctaaggtggaggtaagtcgggattactcctcgtccttttctcctcctccggaaaagggttccttctactggaggaaccacagccatatctggccaatgtttataagcctgacagccctgtgctgtttcatttccatggaccaatcaaagaacattcaagtacccatgagttgccagagtggctgtccagttccagctgagctcatggcaagaactcttccctctttctcctgatctgcagaactcctaggagtccctgattgttgtgtccctgtttactctccaggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagc

SEQ ID NO: 15014 - DNA, 55264 bp, Human
ctacggcttaatacatgcagggcttttgagtcatttaatcctcaccaattctatgaagtaatagaattgtaatagtaataatagatactattattaagcccattttatacttgagcaaattgagctaattgccttaggcaaggtcacacaactaagaagcagccataatagggtttggatctaggtgttctagctcctgaatccatgctgttcgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcatggttcctttcatcttgccacagccactgataatcactttcattttctgtgtaactcaccaggcaagaagtccatgcagatttacttttagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaacccagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtggctgttatcaaggtggtcacagaagggatcacaattccaagtgtgagactagctggcaatgggttttccagaaaggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggcttatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacacagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctaggactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccactgagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgggtggcgaaggggagaaggaggaaaggggaaggaaaggagctcttgttgccccattctggggagtggtggactctggacaaccacgaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccctgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattacgtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagaggaggtggttggagatcacctgggcctcctcagcactgcctcctggctggggctggggctggggataagagagtaactgcaattgtgcttccccggcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcccagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcggtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttcccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaaacttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttctatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtatactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttgcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacgggaggacccatacaccagttgattcccctcttgccacttaacagcagcgtgagcttgggcagttgcacttgttaaatgtctggaacaatacttagcacgtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcactgaatgtccttcgtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagatagacagagagaggggagaggagagaaacccagggaaaggcaaaacatgagccaggtgtttaaagtgggggaataagaatggcttgattggggccaggggaggggtctgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaaacacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagggtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggtaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattttgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaaggagaagcactggatcttgtgagagcataatagggagatctcatctgatttaaagcaccagggaaagcctcccaggacctgttggatgaatagcagtaaccatgtctccaggatccccacaattccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatatttaaaaattagtagagtataggcactagctaattcaaatgcttggttgtaaacaactatgtcttgtaaatgagaataaagtttattctctcaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcaatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattactggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatgaacaggagggttttctgagccagtcccctgcctccacacagttagctcatgaatccaacatcatgggaggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctaagattgtgctactgcactccagcctgggtgatggagccagaccctgtctctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctatctatctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcgttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagccaataaactctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccatcaaagatcaaggtgccaggtgggggatgcctcccagcttcccattcatttttcagttgggggccactcagcagctcctcaggtgaggattgtctcagaactgaagaatggttcaaattggcccaagatgctgaaatttattgcagggatcactgggacagtgtgtagcaatttaggaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccataaccaccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagaggcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaagcaatggatggcatagatgtcagggggtcaggagagccttgcaagcgttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaataagtaaaatgtgtccatgagttcataaaagagtgagccttagacatacagaccacctgtcaaaagagccctgtcattctctattatattatcctcttttattttctgtgtaacactatgagtatctgaaattaccgtattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaatgtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagtgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaccaacatgtgacctggtgatttctgagtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtggtggttgtaaggtaaattgtaagtaagagctattggccaccaagtgccaagggttatgaatgatttacctttttttttttttctaaactgaaggaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcctgggaagaacaaatatccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtattagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatgtgtatcaagtttcaatgatcgcaatagtacttatctcatgtgactactgtgggattgaaacgagatagttcatgtgaagtaccgagcacagagcctggcacacagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgccgtgggctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaaccagtgcatcccactcccagatgggggcccccggcttatctcagcatgtcagcaacccatgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcattgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacggaaaaaaggcagagaaatcagggggtccagccaggcgccaagacgttggggtgccttgcatttctaagtgccaagtgatgaatagctcagttgaaagcaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccaggagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaagagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacatgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagctatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtctggagaactgacagtgccctctctttgggcatagtatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgaagataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagacgtagataatggcaacttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatcctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttcataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgagctcatttatcgctcagagggaggcacttgggacattttattcattacatgatgcaggagatttattggagaccagagggctcaacggaaaacattcttggtttatttccagccagaaaggcttgtttgagagatgcaatcagccatttagtattagcttcttgaatcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacacaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacaaacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacattgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgacttgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagaggatgtcaacatgtcttcttagagaaggacagtcattgaggcctgaggaagtgttcaggaggaataagcttcaccaggatagtttcaatgacttaaccctttgcatgcagtttcctcaagtgtaaaccgggggtcatatagtcccaggagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagcagagaagtttatttggctttttgtttgtttgttctttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgactttttaaggagtctgtcctaaactgaacttattactgtctccaaattatttatgcaaaagaatctaacatttctatttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctaccagttattctagagctgcatagagccttcctcaaactatggctccaagcaagataatcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactgggtacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctactgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaaccggtaggcaacatgaggtggcaaaaactcagtaatagcttacaaagagaatgcaatagattctagaatgttggtgttatccatacttgatgacatgatgtgatgggggtgagttggcgggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaacttattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgaggcattttatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcacgtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtgctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaagttgggtgaagggaaagatgaagccttgaggtaaacttggtacatcttgctggagtgtcagttttccctaaagatgtgaaggggatgttaaattagctggaaagggacttaagacattatcagcctgagacaaacacagatatatacatatacatatatatatatttatatatatatttatttatatatatttataaatatttatttatatttatatatttatattcatttatataaatttatatttatatatttatatttatttatataaatttatatataaattatatttatatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttaggtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggagtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctggtttcctagccagaagtgggtgtttgcacaagtggacaaaacttgccccttaaaaaagaaaatcaaaatcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcgggccgtgctgctagctactcactgcttcttgggttccctgtctttttaaagtaaccatgtcgaaggtgcttatcattatggtaggcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccag

SEQ ID NO: 15015 - DNA, 6096 bp, Human
gagtgcactatcgcagctctccgcaacctccacctcccaggctcaagatatcctcccacctcagcctcctgagtagctggaaatacaagtgtgtgtgccaccatgccggttaatttttttttctttttttttttttttttttcaatttttgttggaagcaccatggagccgcctgagcctggctgagcctaaaagccctgtggtgcatgcctggccaatttttgtattttttagtagagacgggattttgccatgtcgcccaggctggtctggaactcctggtctcaggtgattctcctgcttcggcctcccaagtagctggggttacaggcatgtgccaccatgctcagccctcccgtcagcacagtcctggcagccactggcctggtttctgtccctactgttttgccttttactggtctccatgctcacctaaatttttttgtattttttgtagagacagattctcgcaatgttgctcaggctagtctcgaactcccggcttcaagcaatcctcccacctcagtcctccaaagttctggaattacaggcatgaatcactgtgccagtgttgcattccaaagcatggatacatcacagtttttaaaatgtttaccaatgtaaatggcccgttttaatatgagaataactaatgttgaagagagtgctacaaagaggatcatggtcgtgatgtgtagacacaaaaatgaggttagaagacagtaaggtgagggccgggcacagtggctcatgcttgtaatcctagcactttgggaggtgcaggtgggaggattgcttgagcccaggagctggagacaagtccaggcaacacagcgagtccctgcctttataaaaaattagaaattaaaaaagccttggcggtggctcacgcctgtaatcccagcactttgggaggccgagacgggtggatcacgaagtcaggagttcaagaccagcttggccaagatggtgaaaccctgtctctactaaaaataaaaaaaaaaaattagccagtcgtggtggtggcacctgtaatcccagctactcaggaggctgaggcaggagaatcgcttgaacccaggaggcggagtttgcagtaagccaaggtcgcgccactgcactccagcctgggcaacagagtaagactctgtctcaaaaaaaaacaaaaaacaaaaaaacaaaaaaaaaacaggccggcgcagtggctcatgcctataatccaagtactttgggaggccaaggcaggcggatcgcaaagtcaggagttcgagaccagcctggccaatatggtgaaaccctgtttctgctaaaaatacaaaaaatagccaggtgtggtggcaagcgcctgtagtcccagctactcaggaggctgaggcaggagaatcgcttgaacccgggaggcagaagttgcagtgagctgagattgcgccactgcactccagcctgggcaacagagcgagactccatctcaaagaaaaaaaagccaaaacatagtaaggtgagggtgaaacttctcttttaaaaaaatgtttacatagaaacaaactaaatggacaaaatggatataaacaaaaatgttatcggtggttatttttgggcagtagaattataggtttttaatttcttttgcttatttatagtttcaaaaattttcaattttaatataaattaatgtgctctatttatagagacaatacatgaaatatacttaataaaaattcaaatgttatagaactgaaaaagatgaaaagtaaaaacaacctattccccagaggtagccactgtccatagtttctattttagattctttcctttatacaagattattatagcttctattttttggtgtatgaactgtagtcctagaggattttattagttatgagttctataactaagatccatcatcttagttgctaagaacgtagatactgagaacatcatttaaaaaaacatttttggctggcacctctatgatcactggagtctcgcgggtccctcaggctgcacagggacaagtaaaggctacatccagatgctgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccaccatcagcaggaacaggaggctgaaggggcggctgcccctgccgacccagagatggtcaccttacctctgcaacctagcagcaccatggggcaggtgggacggcagctcgccatcattggggacgacatcaaccgacgctatgactcagagttccagaccatgttgcagcacctgcagcccacggcagagaatgcctatgagtacttcaccaagattgcctccagcctgtttgagagtggcatcaattggggccgtgtggtggctcttctgggcttcagctaccgtctggccctacacatctaccagcgtggcctgactggcttcctgggccaggtgacccgctttgtggtggacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccagttcagacccctgcctggacttaagcgaagtctttgccttctctgctcccttgcaggggtcccccctcaagagtacagaagctttagcaagtgtgcactccagcttcggagggcccctgtgtgggggccagtcaggctgcagaggcacctcaacattccatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcatgtgtcagaagcctccaagcctgcctcccagggtcctctcagttctctcccttcctctctccttatagacacttgctcccaacccattcactacaggtgaaggctctcacccccatccctgggggccttgggtgagtggcctgctaaggcccctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgagagtgccttctctattgggcacagcctagggtcttgggggtcggggggagaagttcttgattcagccaaatgcagggaggggaggcagatggagcccataggccacctcctatcctctgagtgtttggaaataaactgtgcaatcccctcaaaaaaataaaaataaaaaaaataaaaataaaaaaacatttttttcaagcagggagtggtggctcccgcctgtaatcccagcactttgggaggccaaggcgggcagattgcttcagttcaggagttcaagaccagcctgggaaacatggtgaaaccccatctctactaaaaataaaaaattagccaggcatagtgtcgcgcacctgtactcccagctatttgggaggctgaggtaggagaattgcttgaacccaggaggtggaggttgcagtgagctgagatcaggccactgcactccaacgtaggtgacagagatagcctccttctaaaaaaacaaccttttttccagccaaaacaactgaacttcctccccactgaccacctcaattatttctagatgccttgttgctgtccagactgcggtgattccctgggctgatctgagcccgtggcctgagtcatttgcagttcctctagcaggtggtcccccatgtcatggcccctgtgaaaccagttccttaccatctctgttcatcgctgctccctaagttaggccctgcatgtcttgagggtaggttagattcagaaaagctttggtcgcatcactgctttcataaactcaaatgagagggagggagggaaggcaggaagaagggagggagtcctttctctcccacagtgtgcattacctcatgtaacacttcttgctaatgtggtagaatgtgtttgactttgaatgagacttgggtttatttttatttatttatttatttatttatttatttatttatttatttattttgagatggagtttcactcttgttgcccaggctggagtgtagtggcacgatctctactcattgcaccctccgccttccaggttcaaacgattctcctgcctcagcctcccaagtagctgggattacaggggcatgccaccatgcccagctaatttttgtatttttagtagggacggggtttcaccatgttgaccaggctggtctggaactcctgatctcaggtgatccacctgcctcggcctcccaaagtgttgggattacaggcgtgagccaccgtgcctggcctgagacttaaatccatctcttttttcttcttctttttgagacagagcctcattctgttccccatgctggagttcagtggcgtgattttggctcactgcaaccttggccatctgggtttgagcaattctcgtgcctcagcctcctgagtagctggcactatagtcacatgccaccacgcccggctaacttttttgtatttttagtagagacagggtttcactatgttagccaggctggtctcgaattcctgacctcaggtgatctgcccaccttggcctcccaaagtgctgggattacaggcatgagccaccgcgcccagcccaccacctcctttttttaaattaattaattaattttctaaagatagggtctcactctgtcactgaggctggagtgcagtggcacaatcataactcactgcagcctcgaactcctgggctcaagagctcctcccacctcagccaccagagtagctaggactacaggtgcacaccaccatgactggctaatttttaaattttttgcaatgatgaagtctcactctgttgtcccggctggtctcaaactcgggttcaagtgatcctcccgcctcagcctcccgaagtgttgggatgacaggcgtgagccaccatgctcgacctaaatccacctattattgtttatattcatggatgcaccagttcagtgagaatatgttagccgcccactgtgtaccagccctggtgctaagcagtgcgtaacctggaggcttgtgtcacctgtccatacctttgaggttcatctataaaatggagatagtgtatcctctgaaggtgattctgaggactgaatgcagtgcctgcttcagagttgtacatcatcacctctatcactcatcattgggtgcttagtactaagccatagtactgagtacttttggagaaaat

SEQ ID NO: 15016 - DNA, 19181 bp, Human
agagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagtaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaaccttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccgggcgtggtcctgcgcacctgtaatcccagctactcaggaggctgaggcaggagaattgctcggacctggcaggcagagtttgcagtgagccaagattgcaccactgcactccagcctgggtgacagagcaagactctgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggcttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaagtttggaagcttagactgtgctagactgcttttctcaccattgaagccaattgaacaatctctgtgcatatgtctcagattacatgtcatctcccaacaggaatatcaagtgctcctctttgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactggttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgtttatttatttattatttttatttttaacagggacaggatctccctatgtttcccaggctggtctcaaagtcctggactcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctcgctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccatgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcctaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgccctttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcaaactagctgagctcatactcagatctgtccctggcctgtcccagagaagtgccatgttagttactaaagcttccttcctaaatgaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgaggaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtctcccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcgcgacctcggcccactgcaacctctgcttcctgagttcaagcgattctcctgcctcagcctcctgagtagctgagattacagcatgccaccatgcccagctaatttttgtagttttagagatgggatttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacatggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaagacatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagacctcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagatctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctttattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtgaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggggcctccaataggtgttcatttattcagcaaacatcttttgagtggctcctgtgactaccagccctggcaaggagaaagagaaggtaaaaaacaaaaagagtaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggggttctattacttctttaggtttttccacccctgccatcatccaaaacagctttctttgctgttcctcatgtcacctgactccttgagttacagctctccaagagaaatcatattttattcccttttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgagcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaagttacccacctaaatcttttaagataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggctcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttgggtggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagacgcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgatgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaatt

SEQ ID NO: 15017 - DNA, 55927 bp, Human
  misc_feature (1)...(55927): n = A,T,C or G
ctatttaaatatatttttcagtgtacaaagtaagttgatttaaagaaaaatattgagcaaataataagtagtagattttatcattttcttatatattttatccagtaagtggatgtgtaaaagttgtttcagtgatactaacatttgggaaccatgggacaggatcaaccctaagcccctttgccataagattctctgacatgggggtgcccccaaacactagacagctgttaatcaaatgccccacaaaaattacagctatgatgggttatcataaaggaaagatacatgacatgctagagtaagagtcagggaaatcagggaaggctttcctgaagaggtgacatttgggtgaagatttaccgggtaaataagaattcattaggtgaaggtattcctccaagcaggaacagcatgtgcaaaggccctggggcagcagggagcgtgaaccataagaggctcgcaagcaaggctggagtggctggagcacagaagtgaggccagggaggtaggctggcaacaacctttattctttaaaaaacaggcaagggaaggaaatctgcacattgttcccaatctggaaagagttgctcaccctttgacagggggcagaccagtgcctgacccttgatctgaggatctggggttcaatgaggggtttctaatgactaggttaggtgtgaaagcaggagaggcttggcaaacaccaggtgcacgctgtggccctggagtgaccatgaccgccgagtgcaggctcagaattcagactgtcctaacttgcactttctgggtggggtgaccttgggcagctacttaagttcccagagcctgaggtccccatctgttggagatagccgcaggtctaatcttagagttggtatgagttactgactcctggatgtaaatcacctagcacagggccttgcctgtagggagaggtgaataaccactggcttatgagagtattttcaaacagctccaagagccatgtgtgtgtacacctgtccccgcagtgcatggatgtaggtgcccggttttgcaatatgtctgtggtgtgtatgccaatgtatgcccatagtttagcagtatgggggagcaggtgcagaaggcatgggtgtatgagagggtgtgaacatgtgttcagctgtgtgagtcagtgggagcattcaggtgtgctctgtgcgtgcatgtgtgtgtgtgtgcatgtgtacgtgtgtgtgcatgtgtacgtgtgtgtgagtgcctgcgtgtgtgtgtgtgtgtgtgtgagagagagagagagagagtatgaacacctctatatggaattcttctgcttgtggagatgcatttgctgtgagtgaaaacccacacaaattcaacatggttggtcacagtcacagggttaaagccttggcctgtcttcacagcttttttccaaatccttacagcccctgtgaatctgcctggggctcttgtatctgtctggagctgggctgaaatcctccgaaaacagacttttctttcattccctgttgccagatactggcacaaacgcatccctgccaccaccaccaccacacacacacacacacacacacacacacacacattctcccagaatgtctcaacttttttcaaggttccagctccaaaagtcccttcctcttccctctccccagccaattcccatggaagcaccctgggtttcaatgtgtatatctgactttccatagctgagtctaaaacagcaaaagcatcccaagttttggtaagcagttctctccttttcaccctggacccttaaccctcctcgccctgcactgcctggctggcctgggaggggactttaacccccaccaccactcttccccatccaaactccctgccgggacaatgtgcatatcacagtcagttccaaaacaaacatgcaaaaccaccccgtttcagccctcagcctcagggctgagattcaggctcaggtctaggggttggggaatattaaagtttacaagtacaatcttactccatccatacacacacatggagaagccaggagaggacgcggccagagatgggctcctgcccttgaacccctgctggggtggaagcaggtaagcacaaccctgccaaggcactgagggtcgtctcagtgtaaaaggccagggccacccggggctgttctgcagggaatggggagggctgtgcccactgaaagggggcagagcgaggtggtccaggccttggcgcgttaccatggtgacgggctgccagcggcgggcggcgcggctcctctcctgggcgcggggtctgtgggtccgcgggtccgtctgtctggggcagccctcggtcccgcctagccctggagccaggggagagggcaggcccggggcaccgaccccggcgtcatctcggaggagcggccggggaggacagggagagagactgagagagagacagagagggactgaggctggagacggcgagagacataagggagccgcgggcggcgcgggtcgggccaccagacggggggcggcagcagaggcggggcggggcggggcgcggcgggacagcggcccctttgtgcctgagccctttgtgcccagcccgcgcgccccgcccccaccgcccccccttccctccgtccaccccctcagcagccagctggaacccgaggaacccgagtccgccccgccaagttttcctccccgctcctcgctcttcccacggcgcacccggcccggacagccccattgtacagacccgcagagcgaggcctcgagccgcagcagccgggttaagcgcccgcggacctcgctggcaggcccaagttcgagtctcctcctcctacacttcccagggagtcacagactctcttaagcttcgatttcttcatctgtaaaatggggtgggaggaggatgatgatgatgatgatgatgatgatgatgatgatgatgatagtgcctgctgcttagatttggtgatgaggagtaagcatctgtcccagcgcccttgaattctcccacattatgccccatcatgacggcctaattcaaggctttgaggtgatgatggctgtgtgcgagttctgttcttgactctcagataatgaccttggccaagtcggtatttcctactgagcctcagctttggagtgagactaagaaactagatgaccgctagggtctatatgtgtgtgtcccctcccaaattcgtatgtccagacctaatcctcagtatgatggcattaggaggtggggcctttggaaagtgattgggtcatgagaggacagagccctcacgaatgggattagtgcctctctctatatatatatatacacctacatatatatacctatatatatacatatatacacctatatatatacatatatacacctatatatatacatatataggcactaatatgtataggcatatatacacacacatatatatacacacacatatatatacacacatatatacatatatatacacacacacgcacacacatatatatttgagatggagtctcactctgttgcccacccaagctggagtgcagtggcatgatctcagctcactgcaacctctacctcccaggttcaagcaattttcctgcctcagcctcccgagcagctgggattttaggcacccgccaccacacctggccaatttttgtatttttagtagagactgcatttcgccatgttggccaggctggtctcgaactcctgacctcaggtgatctgcccacctcaccctcctaaagtgctgggattacaggcgtgagccaccatgcccagcttagtgcccaagaggccccagagagctagctgccttgccccttccaccatggaaggacacagcgagaaggggctgtctatgaaccagaaaggcccagaaacataaggtccagaaagaaggctcttaccaaacacccaacttgcttgtgccttgatctagggcttcccagcctccagaactgtgagaagagaatttctgttgtgtataagcccctcagtctaaggtatgttgttatagcagcccagactaaaacagtgaccaaagttattcctggttagatggctcagggttttgtccatttatttatcaaacactgtgcactgagtcagcctgtctcccccactagactatacattacttgagagtcccggccctcaagtaatgtacagtctagtgggggagacaggcaaggagcagataaacaggaaaaataaaaaaataataactgtggtaactgctaagaaggaaacaaacaaatgttgacattgggaacagtagagggatcaacttatagctggtggtctaggaagcctgggtctgaaagcctagatctgaaaggggaggaattagaagagtggagatggggagacgcagaggaaccaagttctaagcagagagaaccgcatatgcaaaggctctgaggcaatattaagcttaaaggagctggggagtaagtgaagaactgaaaaagacgagtgtagttgtaagggttagagttcagacccaagccttattcacagcccatctcccaccccacataggttaatcagtcttttagcagagaaaacctgaattaggagccatcctatcccaacttttgataagttccttcacatccccgaccttcacttgcttatcactaatttgggactaataatcccctgcaatatttccacagcccagcaatcaagtaaactctctctacaggagatggtctggatggttttagtatcatgactccagatgtgaatttaggagagaacagacttgatgttcagtacagaattccactgagagttgtggggtcacagcttgaaggttttagagtcccaggttgccatgagacagaattgacatgacagccagcgttctggggttgcaggcaacagaagcggattctgagttaattaagcagaaaagaatggattggcagtcagagaatcaatgcgaaggctggggcctatcctctggaaagcactggagtaagtaggatgctctggggggtctcgttatcggaaagagttggaaacgtttgaacacatggaattacattaagacaaacaaacacaccaaagtagaactttatatgtgtcaggtagttttctaagtatataacagttatgaagtagattctattattgtcctcactttacaaatgaaaaactaaggcacagagagggtatgtagcctgcccaatgtcagatagctagtaaactgtggatttcagaattggacacagctatccaattccgtaagttatgttattaaccactttgctatgctacctgcataaatcctaaccattctctctgcccttgtgttcctcactgatggactcagaaccttaaaagagccaggcatggtggcatgctcctgtagtcccagctacttaggaggccaaggtgggaggatcacttgagcccaggagttcaaggctgcagtgagctatgattgcaccattgcactccaacctgggagacagagtgagaccccatctctaaaaaacaaacaaacaaaataaaacctttatagagaaattctaattgcgtcatgtgcccagggcctcactaagactgcacctacacatatcaggaatagttggtcacccaaaaggaaattaaattgcataagaaggagaagaaatgaatatgaaattgtccataaacaagtgcaattacagcctgggcacagtggctcatgcctgtaatcccagcactttgggaggccgaggtgggcagattgcctgagctcaggagtttgagaccagccggggcaacatggcaaaaccttgtctctactaaaaatgcaaaaaaataaccaggcatggtggcgcacacctgtaatcccggctactgggaggttgaggcaggagaatcacttgaacctgggaggtggaggttgcagtgagcagagatcacaccactacactccagcctgggtgacagagtgagactctgtctcaaaacaacaacaaccaccaccaccaccacaacaacaaaaaggtgcaattacggtctatccattgggcctctcaacatactttatatccttgttcacaggcatgttcttccaaaactcctctctactgatgtggtatagcagttccatatgcaaccaacaatgtgcacacacacatacacacacacacctctatggtttgtagtcatactgtgtgtgacctcagggaggttcacttttctgagcttcagaatcgtcttttgtaaaagatgggtaagattcgtcatggggaagaataaataagttaatgaatgtaaagtgctttgcactgtgtctggtacatagaattaacatgcgtcatataaaatagtgctgttattccaaaaaatagggaggagggaatacttccaaactcattctatgaggccagtattactccaataccaaaaccagacaaagacacatctaaaaaagaaaactacaggccaatatctctgatgaatatggatgcaaaacttcttaacaaaatactagcaaactgaattcaacaatacattaaaaagatcattcatcatgactaggtgggatttatctctgggatgcaaggatagttcaacatatgcaaatcaatccattctgttgtgatacatcacatcacatacatcacatcaacagaatgaaggacaaaaaccatatggtcatttcaatcgatattgaaaatgcatttgataaaagtcaacttccactcacgattaaaaaccctcaaaaaaccaggtatagaaggaacatacctcaacataataaaagccatatataacagacccacagctagtatcatatggaatgggaaaaaactgaaagcctttcctctaagatctggaacacaacaaggatgcccactttcgccactgttattcaacgtagtactggaagtcctagctagagcaatcaggcaacagaaagaaatacagcgcatccaaattggaaaggaagaagtcaaattatccttgtttgtcgatgatataatcttatatttgggaaaacctaaagactccaccacaaaactattagaactgataaacaaattcaataagattgcaggatacaaaatcaacatatgaaaatcagtagcatttctatatgccaacagtgaacaatctgaaaaagaaatttaaaaataatcccatttaaaatagctaaaaataaaattaaatatctaagaactaatttaaccaaagaaatacaagatctctataatgaaaactataaaatataaagtgaaagaaattgaagaggacaccaaataatggaaagatactcccaaagcaatatacagattcagtgcaatccctatcaaaatatcattgacattcttcacggaaatagaaaaaacaatcctaaaatttatgtggaaccacaaaagacccagaatagtcaaaactatcctaaacaaaaagaaccaaactggagtaatcacattacctgacttcaaattatactacagagctatagtaaccaaaacagcatgttactgacataaaaacaaatacatagaacaatggaacagaatagagaacccagaaacaaatctgcacacctacagtgaactcatttttgacaaaggtgccaagaacatacacaggggaaaagatagtccaataaatggtgatgggaaaactggatatccatatgcagaagaatgaaactagacccctatcttttgccatatacaaaaatcaaatttaaatgaattaaagacttgaatctaagactttaaactatgaaaccacagcaataaaacattggggaaactctccaggacttcggtctgggcaaaatttcttgagtaatacccaacaagcacaggcaaccaaagcaaaaatggacaaatgagatcacatcaagttaaaaagctcttgcacagcaaagcaaacaatcaacaaagtgaaaagacaacccacagaatgggagaaaatatttgcaaactatccatctgatgagggattaacaaccagaatatataagaagctaagacaactatatagaacaaaatctaataatttgattttaaaacatgcaaaaagatttgaatagacgtttctcaaaagaagatggcatacaaatggcaaacaggtatatgaaaattgctcaacatcattgatcatcagagaaatgcaaatcaaaactacaatgaggtatcatcccaccccagtgagcatggcttttatccaaaagacaggcaataacaaatgccagcgaggatgtggagaaaaaggaacccttttacgctgttggtgggaatgtgaattagtacaaccactatggagaacagttgggaggttcctcaaaaaactaaatatagatctaccatatgacccagcaatcccactactagatctatacccaaaagaaaggaagtcagtatatggaagagatcatctgcactcccatgtttgttgcaacactcttcacaatagccaaagtttggaagcagcctaagtgtccatcaacagatgagtggataaagaaaatgtggtacttacacacaatggaatactgctcagccataaaaaagaatgagatgttgttatctgcaacaacatagatggaactggaggtcagtatgcaaagggaaataagccagacacagaaagacaaacatcacatgctacacttatttgtgagatctaaaaatcaaaacaattcaacgaatggagacagagagtggaaggatgtttatcagaggctcagaagggtagtggtggggggtgggggtggggggggttggttaataggtacaaaaacatagtaagaatgaataagacctagtatttggtagcacaacaggataactatagcaaataataatgtaactgtgcacttcaaaataactaacggtataattggattgtttgtaacacaaaagacaaatgcttgaggggatggatactccattctccattatgtgattattatacattgcatgcctgtgtcaaaacatctgaagtgccccataaatatatacacctactatgtacccacaaaaattaaaatgaaaaataaaaatagaataaaatagtgttatgttaggggccgggagttgtggattcaccctccaaatacacaggcttaactgttggactggacttggttcatctctctgggactttccagtggatcttccaaggacttcaagcattcacttccttcctctctctctctggcaaatgaataactgaatcatgtgccaattgctacactaaattttgagaaataaccaaatccatcactagtcttacatatatggtggagtgagaaaatggggaagggctgtggaaatgggctctgttactggttcgctgtgcagctctctgcatggggccacagtttcctcagcataaaatggtgattatataatctctcctcatgaggctcttgtaagaatccagtgaaataatgcattgaaagggtttaacacagtgcttggcatataacaggttctcagcaaatggaagctctgcctgtgattttgagatttccaggcctaagtgccaggacacctcaccaggggacatgcttacttggaggaagggagttgcctaatttaagcaggatgtcatgggattcagaatgcattcattcaatcatttaatacatatttatttgctcctagtatgaggatgctaaatacttggcaggtgtgcatatactcatccctcccatacccatgacagatgtcactaatccatcatggaactttctgctgaacctagaaactgccccagagtcctcctcaatagaaagtgcaggcagctgctaccaatcaatacatgttgacatgaagacgatgcttattcaccatctgaagttcacaatgtatgaggaaatgggctccagaggcagaagcctccagagacagaaggcttgggtttgcattttgccataggtccttatgataatgtgtaggcactaaaggagcgtatcagccttggagtggaccactcagatctcccttcaagacagagtctgtgagctgcagatgtcttcaggatctgcttcagcttttgagctgaggccacctgcttcctgggcagcctgcagctaaacacactgtgaatgaggtttcgttatttctgcctaatataggatttctctatgaataatctttgtgccagagtcccctgttgggctggccaagaccttctcagagctgcgccacagtctgaagctcttgctacccaatccttcttcattccccctctcctttcctagtcagacctgcgtcaacatccaaaggctccccttttttctcctgctccctctccccattatcctttgcaggcattacccccatgcatctcttggcattcttaactctgtctttggcctctgtttctcagaggacacaggtgacctcagcactgagctgcagaagactgggctggaaaggagtggtcctcatcttctctgatggggagaataggggtggcacagaggttattgtgagtgctaggggcaaagagtgacccagaacagggaggctgaagggcacctccctcagcacgaaattggccttccctatcaagtactctttttttatttttgagacagaatttttgctcttgttgcccaggctagagtgcaatggtgcagtcttggctcactgcaacctccacctcccaggttcaagtgattctcctgcctcagcctcccaagtagctgtgattataggcgcccacgaccacgcccagctaatttttgtatttttagtagagacggggtttcaccatgttggccaggctggtctcaaactcctgacctcaggtgatccactcaccttggtctctcaaagtgctgggatgacaggcatgagccaccgtgcctggccaaggactcttgattgcaaatgacagaaactcaactcaatctcaaagtaaaaagggactttaagcgccttataatggagaagtggtgccggagctctgtcatcattctaatagcttcttccctatgactagagaagttggcctccaggcctataaggtctcaagctggcaataatagtataaagacatcatcaaaatagtaatctcagggaagaccctgattggctttgcttgggtcacatgtcaattcttgaaccaatcactgtgaccaaggtaatgaagatattctgattggctggaatagattctatgcccacccctgggtgggagcacatgatgatggctctaccagggctgcatagagagaggagaagctctccaaaacaaacagggggatgggaacacaaggtaaacaacaaaacctttggtgatcattatccacttcagaaacacggagaaggaaaaagacaaaaaagacagcttcttctctcaatgacctcctcttttcacaggggaaaatctgatgtttaaatgtttcctgatgaggtcctaggatgggctttggggagtgacctgtgggtaggttagggacctcaaacactgtctcaccctttcctaggatgcccacaatctcggtgggaaggatgagatggaaataacctatggaaataaaacctcttagagctcctaaaaaagactgaaaacttaccttgtttaactgtcctgatttatgccagggagcttcacccagggaggagtgactcacgttgtcacactgtccagccaggacaacaatctgttatacttcatctgtccttaaatcggcctcttgatggagcagcctgtgctgtataagcggagaccttgagttcaggcccctctctacccactaactccgtgaggcatcttgggggtttgcctgaattctcagaacctcagttttctacctgtaaaatggaacccataacctctgctttgcctgtttcccgtctgctgtgaggcaacaacacacgcatttgtcacgtctcactagggatggaggtcataagatgcatttattgagtgtccactctgtgccagagacagcgtgctggatgctggccatatcagggtgaacatgacagacagtccctgccttcatgtagctcacagtctagaagagagtcagatcttaataatgagtgccttatacaaatggtggtaaggtcttaaaggggaaaaaagagcacaaatcaatggaacccactggaggtccaggagggtggccctgagggcttaagctgggattcaaagagaaaacataagaagtcagggaaggctgggctcggtgggtcacacctgtaatcccagctctttgggaggctgaggcaggcaaatcacgaggtcaggagatcgagaccatcctggccaacatgatgaaaccccgtctctactaaaaatacaaaaattagctgggtgtggtggcgcatgcctgtaatcccggctacttgggaagctgaggcaggagaatcgcttgaaccagggagtcggaggttgcagtgagccgagattgcgctgcagcactccagcctggtgacagagcaagactccgtctcaaaaaaacagaagaagaaaaagtcagagaaaagcattaaagtcagagggaacaccacatgcaaaaggcctgtggcaggagagcatgttggaggcagaaaaaagccagagagtgatggggacagggacacaagaggaggtgggaggcatgggcaaggctccgtagaccagagagtttgaattttctccttagagccatgaaaacccatgggaaggaattcaggagggagtaatattatcagattaggtttttcttgaccacccccccgccggctgactcccttcaaaaggttcctccagtgcctgggtggaggagaccgtgggagggggcaggggctacagggagacccaccagcaagggggctgacatggggtgctggagaagagttgggctccaagggtggtggaagccaaaagccagggctctggggggacttggggctggatactccaagtcaggggacatagagggctgtgtagctccccccagcacatccctgagcctctggagaagtccttcatctctggagtttctctttcccttccagtccagccctttcttgttattgtaggacagactccatcgatgactcattcaggacttgggtttcttgttccagcagtctcccttcccctgattactttgggctcctctgggcctgcaggcctcgcccctcatcatctggggaggcagccaagaaccttgctggctgggtgagctctacggaggaaggagccgggaccctcctagcttcaggccccacccatgctttcctgcctctggttttgctctcctctttcccccgccaggggacccctgttctgcaagtcctgctcctccttccaggaccacctcccctgggaagccctgctaggtggccccgcacaatcttctccaccctgctcagtggcacctgtctttttattcaacccccaggagcccaccttctggtgagtgaggcaggggtgtattgatggaactacagacacaaatatggtaggaacctagaggagggaaccaataacaccccctagagattgggtcagatgaggtttcccagagaaagggacatttacacctgggttttgaaggaggaatagaagttcatcatggggagaaaaataagaaggcattccaagccaaagaaacagtgtgtgcaagttatttctgtaatgcgtgaaaggggcccagtgcatgtaaatgtttgttgaatgaatcaatgtttgggggaacattgagaaatttggtgtggctgcatcagagcttgcaaactgtcagtggataggccaaatcaggcaaagagaaggttaaaaaaaaaagtgaaaatggaattaattctcaacatctaaaaactgggaggcttcacagacactccggagctgggcagcatcctctgcctttaggcgcatgctatccagctcaccagagtccccacctggctcagtttactcattcatgctactccttgggccctgtggacatttgaatttgcacccctacctacttgttatactcctcaaggttctggactgtgagctactcacagggccaggcacacagcaggtgcctaatacatctttgttggctaagtggatagatggtgtgatgattttaaaatatgtccccaaatttcttaacactctggagcccccttcagtgtgggctgaacttagagactcccctgtagacagccaaatgtagaagaagtaatagcttgtgatttcagaaactaggtcacaaaagacactgtggcttctgcctggctgtttcttggattgcttgctatggggaaagccagctgccattttgttaggatactcaaacagccctgtggaaacacccaggtggcgaggaactgaggcttcttcttgccaatggccggcaccaacttgccagccatgtgagtgagtcaccttggaagcagcttctccagcccagtctagccttagatgattgcagcccaagctgacagcttgactgcaacctcatgagagaccctgagttacaaccacccagtgaggctgcttccaaacacctgatctacagaaactgtgtgaaacaataaatgtttattgttgtctcagatgctgagttatgaaataatttgttatgttacgcatcaatagataactaatatggatggatggctgggtatctggatggctggatagatttatatagagcgcattaggtaatggaggaagtcccattgggaaagagggtcagagcctggagagccagaagaagtttgtaatccctggtcatctctaagctttagggaggttattcaggcagccagaggaggagagagttagtgagttttgaagccaagaggtcatcagaggctagaccactcatcctggggagacagcctgccctgtgtctccaaatccagcttcctcaagcagcagttcatactagtccttcctaccctgaggtcctggctccatcattcctcggccccagctggccctcagaattgtggaggaggtcaagacttcagcatttttcagaagccaagtcatcctcctcactcagagtcttctttgtgtggaggaagcagtttctcgactggtgggggactcagggcagggtcagtagccttcaggaaccagaggagggtattgagaagctgggaccctctgtggagaccctgctggccccaaaggcatggtggagagccacagccaccaaacatccataggattaggtcagccctaagatccagtatattggtattgtttgaaatgacccaacacatgtcctcgggaaacatatgtacaatgggcctggcacatatgagaattttttaagtaaatcaaaactgcactgaaatgccatttttcatctatcacattggcaaaatttcaaaagcttgacaatacctgctggtgaggctttgagcaaatagctactcttataaattgtcaataatgcctgttggcaataaaacttctaggaaggaatttgtaatatagaacaaaacaggatatgcatttactctttgatccaggatatttacttctaggatttatcctaaagatataattccacaaatatgaaaaatgtgtatgcaaggttatttattgaggaattatttataatacaaaatgttgaaaatacacaaatgcccatctgtagaaaactggatgaataaactatggtaccacatgagagaatgttatgcagccatgaaggcaagaaggaagatctctgtaaacctacagggagtgatttccagcatatattgttaaacaacaaaataaggtaaaagcaaaataaaggactacctatactatgcaaacttttaagaaaataaaaaagaaaacatttatttatttacatacatatttaaataattatgcaaaagaaacccaggaaggataaatcggaaacttattgcaaatggttactcataagaagttagtgggaatatcaatggagaagaaagagatgggagtgagattcctctgaatatatttgtacaggatttttgactttttaaccatgcaaatattttacattctcaaaaataaaattaaataaaaagataaaaatgtaaactgtaaacttataaacaaagagtaaagagatgagcttaactaaatgtcaaataataatatagccacacaaagaaaataatttaagtaagtgtaaccacaggagtctaggtatttagtgttataattctaaaactactatctctgtgttgtatgatggaagaaatgagtaaatgtgctgatgttttgggactcagcgttctcactatgggaaaaggaagtcaaaaatatggagtggaggaaggatctgtggctatggctatgagtgttaactggagacattgatatgagcagaccagggaaaagcaacatacctatagcaattagcacacccagggcccagatcttgtctcctaaatgccatcattccctactaaacagaactagtgtccttagaaaaatggctgattccaggattgggcagggaaagtgaatggtgaacctgaagcatctcatgtcaaaatgcaaggaaacactcaatgaatgatgaggccaagtctaaaggagccaacttaaaggggctcccactagccaaagtccagacaatttgattctcaagagaagaacgatgaggtttctcactgttggagtgagagattaccaacaagcaagggactagaatgatccatgtggcaatggatttgacttggagacagtagcttcccaatgcagataggtaagttgatagatagttgcatacagaaatgtttataggtatgtgtatataaagaagttcatatatacatatattttcttgttctatcagctgagaacacttagaagcactgacattgcagtagcaacaagcacacttaacatccaggttttggtgtctaattccattctccagtaaaagaaaacagggatccctggagaaatggctgattcaggctggacatggtggcttatgcctgtaatcccaacacatcgggagtctgaggcaggtggattgcttgagcccaggagttcaggccagcctgatcaacatggcgaaactctgtctctacaaaaaatacaaaaatcagttgggcgtggtggcatgtgcctgtagtcccagctactcaggaagatgacgtgggaggatggcttgagtctgggaggcagaggttgcagtgagctgagatcacaccactgcactccagcctgggcaacagagcaagattctgtcttagagagagaaagagagagagagagagagagagagagagagaaatgggtgattcaagcaaggactggggtagaaaatgtacaatgtacaagatgagcctggagcatcataagaaaatgccttaaaaaaacaaagaaatccacaatgatggaaggatgtgaaagggacacagaaaacaactgaaagagcttctaatgaccaaagctggatggaacaacttgaacaagaaaataaagcatacactgatataaataaatgagtgcataaataaacagtcacttgtcccttattgacagggatgctttctgataaatgcattgttacagggatatgttctgataaatgcactgttaggcagtttcgtcattgtgtgaacgtcagtgtacttacacaaacctaggtggtatagccagctacacatctaggctatatggtatagcctagtgctcctaggctacaaacctgtacactgtgttattgtactgaatactgcaggcaattgtaacataatggtaagtatttgtgtatctaaatatacaaaaggaaccattaacatacacttaccatgaatgaagcttgcaaaacaggaagttgctctgggtgagtcagtgagtgagtcgtgagtgaatgtgaaggcctaggacattactgtaccctactgtagactttataaacattgtacacttagattacatggaatttatacaaatatttttctttttctttttttttttgagacagagtttcgctcttgtcacccaggttggtgtgcagtggcacaacctcggctcactgcaacctccgtctcctgggttcaagagattctcctgcctcagcctcccgagtagctggaattacaaatgcccgccaccatgcctgactaatttttgtatttttagtagaggtgaggtgtcaccatgttggccaggcttgtcttgaactcatgacctcagatgatccactcgcctcggcctcccagagtgttgggattacaggcgtgagccaccgtgccaggccctaaaaatatttttctttctttaataataaattaaacttagccgtaaatttttttactttctaaactttttaatttttaaaacttttgactcttttgtaatagcaacttaaaacaccaacacattaaaccagtgtacaaaaaatattttctttctttatatctttattccataagcttttttctatttttaaatttgttttaatttttaaacatttttgttaaaaactaaaatggaaggccagatgcagtggctggtgcctataatcccagcactttgggaggcagaggcaggaggatagtttgagggcaggaggatagtttgaggccaggagttcaagaccagcctgggtaacatagcaagactatctattaaaagaaaaattagctgggcatggtgatgcatgcctgtagtctcagctaatctggaggctgatataggaggatggcttcaacccaggaagtcaagactgcagtgagctaggatccctccactgccttccagcctgggccacagagtgacaccttgttgctaaaaattaaaacaaaaaataaaaataactaaactgcaaacacaggccgggtgcggtggctcacacctgtaatcccagcactttgggaggccaaggctggtggattacctgaggtcaggagttcaagaccagcctggccaacatggggaaactccatctctactaaaaatacaaaaattagccaggtgtggtggcacaggcctgtaatcccagctgcttgggaggctgaggcaggagagtcgcttgaacccaggaggcgaaggttgcagtgagccgagattgtaccactgcactccagcctgggcgacaagagcaaaactccatgtcaaaaaaaaaaaaaatgcaaacacacatattagcctaggcctacactggatcatgatcatcagtaccactacctatcacctccacatcttgtcctaccggaaggtctaggcaatgggaatttctcagctccattataatcttacgggaccaccatcgttgttgaccgaagtgttattatgcagcacatggctgtaagtgtgagagattaggcaaatttcctgtgcagaagaattccaaatagtttatgtagatacttcacccccaagaagacacagcataaataaataacttccactcctaaagtgtggactgcacatagtgacttccttccaaaagttacagtatgggaaagaggagaaagagtaactttaccgtggagaaatctgacaaatatgacctcggccaggtgatcaaggccaatatcaacagtaataaattgtgttaatgctacatactcttgatatgctgtgtaaggatggggcgcttcagatacaggctgccttagacatctctattctgcccccacctgccttgcaaagatgtcctcagggagagagtaactgtcttctccagggccacacagcatgctgggaggggcaaatacctgactggcctcttcacagcatcaacagagttaccacacctatttcacagagaaggtaagggggaccctgagggcttgtacaatttgcccacatccccttacagtggtccagctgcaaaaaaaaaaaaaaatagtagaggggctccccaaaccacacacaccccaaatagccacagcttagctcagcttcctcccatccctggattctcagcactgagatgtctccctccccgacattctagcttcctctccctcttttcccacagggacggcccctttccctctatggccccacttcagagctctggggctacccaaggacaccccaggcctcttccttacggtatgaacaaaactgggcagatgctatggcggtggcgccacggagggggccggggtcatgttgcggcctcacgcaacaggcggctgggagcttaagtcatggtgaaagggctaaattgtcctgtgcagctgtgcttgtttttcttccccgtttcagtccgcagccctgataggggagggggtaagctggaggcggtcactttttttcctgcctgtgttcccccatcccagggagtcctccaagactgtcctccaggagcctacacgtgctgctttcacctggtttcttataaagcagagtctcgggtctgcggagtgggaatgggtcttcatggatctagctgttgaaacatcagaatgatccatgggggtgcaatccaggcagacatctgcctcccccaataggattagaaccccaggggctaggagcagaattgcagtgttaataaacacagatggttagttagacccagcttgactatacagattgagaaaaactggggcccagagagggacagagattgctcagggtcactgaataagacctatggctaaacctaagctaactccattcattcattcattcattcattcattcattcataaaaacattcactcagcattgactacttccggccctttgccaagggtttagcagggcgggagttggctcacaagatgctcacaataagcaagcatgtatacaacaaacatccttcaaaagtgcagtgacaagtactgcaattgagatgtctgagataccacaggagcccaggaagggtacttgaccaggcagaggggaagtggtcagggagggatgcctaggggagctgataacacaagcagaatcctaaaggagccatagaatatatctatgcaaatggccaggcactgtggctcatgcctataatctcagtactttgggaggctgaggctgcaggttgtttgggaggccagaagtttgaaaccagcctgaggaaggagttggttgaacttgtttgtttgagaccagagaagcaagacgtcatctctacagaaaatacaaaattagctgggcatggtggtgtgcacctagctacttggaaggctgaggtgggaggatggcttgagtctaggtggttgaggcttcagtgagctatgattgtgcccctgcacttcagcctgggcaacagagtgagactccatctctggaaaatatgtgtacaaataatttttttaattaaatgaaaatttgaaaaacaaaggaggaaggaccctccaggcaggaggatcagcatgagcagaggtttggaggtaagagcggtgtgggtgggcagcaaaaagcagttcagtgttgcaggagcccagatttgtgtggcaggaagaggcaagaagtttattgcacctgctgagtgcttactatatgcagggccctattcaggcactgggtttaggcaccatgagcaaatgtacacaaagcccctgccctcatggctcttccattctaggggaaagacaagaaaaaaaccaaaccaataagcaaaccaaggcataatattcatgaggaggtaagtgctgaggggggaaataatgcagagtaaggggctcctatttcatgacaggtagccagaaaaggcgtcttgatgaacacatccttagcggagacctgaaggaggcaaggtagtgagtggcgaagcatttgggtaaagcatgttcaaggaggagggagcagtgagcacaaaggtcctgaggcctgagcaaggtgaggctggagaaggttggcaggagccagttcaaaaaaggaccttacatgacatgctaagaagtcactttcctcttcttctagtaaagtataagaagccagtgttggggctttgtgttagtccattctcacactgctataaaaaaatccccagctgggtgcagtgactcatgtctgtaatcctagcacttcgggaggccaaggcaggcagatcacttgaggtcagaagttcaagacaagcctggccaacgtggcaaaaccccatctctactaaaaatacaaaaattagccaggcatcatgtcacaggcctgtaatcccagctacttgagaggctgaggcagaagaatcgcttgaacctggaaggaggttacagtgagctgagatcgtgccactgcactccagcctggtgatagagcaagactccatctcaaaaaaaaaaaaaagaagaagaagaagaagtagaaatacctgagactggtaatttatacaagaaagaggtttattaactcatagttttacattgctggagaggactcaggaaatttacaatcatggtggaaggcaaaggagaagcaggcaccttctttacagggtgacaggatgaagtgagtgccaagcgaagcgggaagagcccccttataaaaccatcaggcacacactcactatcacaagaacagcatgggggaaactgcctgcatgatccaattacctccacctggtcctgctcttgaaatatgggtattatggggattataattcaagatgaaattttgggtagggacacagccaaaccatatcattctacccctggccccttccaaattttatatcctcacatttcaaagcacaatcgtgtcttcccaacagtcccccaaagtcttaattcattccagcattaacccaaaagtccaagtccaaagtctcatctgagacaaggcaaggcccttctgcctatgagcctgtaaaatcaaaaccaagttagttacttcctagatacaatgggggtccaggcattgggcaaatacacccattccaaatgggagaaatcggccaaaaagaggggctacaggccccatacaagtctgaaatccaatagggtagtcattaaaccttaaagtttactatgtaaactttaagtaaaccaaaatgatctcctttgactccatgtctcacatctaggtcatactgatgcaaggggtgggcttccaaagccttgggcagctctgcccctgtggcttcagaaggtacagcccccttctcagctgctttagttgactgtcattgagtgcctgtggcttttccatgtgcatggtgcaagctgtcagtggatctaccattctaggatctggaggacagtggccctcttctcacagctccactaggtggtgccctagtgggaactctatgtaggggctccaaccccacatttcccttccacactgccctagcagaggctctccatgagggttccaaccctgcagcagacttctgcctggacatccaggcatttccatacttcctctgaaatctaggcagaggctcccaaacctcaattcttgacttctgtgtacccacaggctcaacactacatggaagccaccaaagcttggggctttcagcctctgaagcaatggcgtgagtggtaacttggcccattttagccacgactggaactgaagcagctgggaagcagggacgcaccatgcctcaaggcttcacagagcagcgggggcctgggcccagcccacaaaaccgttttcccccctaggccttgggacctgtgatgagagtggctgccatgaaggtctctgacatgccctggagacattttccccattgtcttggtgattaacatttggctccaggttacttatgcaaatttctgccgtaggcttaaatttctccccagaaaatggatttttctttttctattgcatcctcagtctgcaaattttccaaacttttatgctctgcattcttttgaatgctttgccacttagaaatttcttctgtcagatactctaaatcatctctttgaagttcaaagttccacaggtctctagggcaggggcaaaatgccaccagtctctttgctaaagcatagcaagagtgacctttactccatttcccaaaaagttcctcatctccatctgagaccacctcagcctggacttcattgtccatatcactatcagcattttggtcaaagccactcaacaagtctctagatagttccaaactttcccatatcttcctgtcttcttctaagccctccaaactgttccaacctctgcctgttacccagttcaaaagtcaattccacattttttagtatctttatagcagtgccccactcttggtaccaatttaccgtattagtctgttctcacactgctgtgaagaaatatccaagactgggtaatttataaaggaatgagatttaaattggctcacagttccacattgctgggtaggcctcaggaaacttacagtcatggtggagggcaaaagagaagcaggcactttcttcacagggtggcaagatggagtgagtgccaagcaaagggggaagagccccttataaaaccatcagatctcgtgagactcactcactgtcatgagaacagcatgggggaaccctccacctggtcccccctttgacacttggggattatgaggattataattcaagatgagattttgggggggacacggccaaaccatatcagacttagaaaacaataccccaaaatgaaggcctcagaagtgagtttcttctctgaccccctcctgccctcctagctctcagtcctattcctgaaggctagccatagaaactagcatgtgctatagaaaccagaacctcttctccccaaagctagtcataaaacctaaaaatactactctaattttccctccaactttctgtataaaaactggccataaagaaatgatctttcctttgactgtaggtcataagaccccccattccagaaaaggtcctgccccatccccagaaggaaggagcactgctcagagaggccaagaataatctagataggcgggtcatgctgggttcccactcattctatcagcattcgatcagacctttttgtccagtcgtatttctacatggctgtttatacttcatggaacctaagcataaaaatgaacaatttcctctgtatctttgggtcttcattctaaagactcccgtgaatacacattaaatacatttgtgtaccttttctccagttaatgtgccttttgcaaggtgatttttcagagaacctttagggggctctcccttggccccatgccagcaaaaggtttaaacagagaggtgggggcatgccccaggttagattttcaagttcctctgacttccatgtggagaatggaccaggtggcagcaggagggccagtgaggcatctgttacatggaccgggctggaagtgatggtggcctggatggtggacggagggcatggggggctgaggaggagaaatggggtgctgaactaactagcaaaggggcaaacccatagggctaggctggttgctgttgctgggttggtcagggtgatggcaggtcatgggaggaaggcaggcccacctcttagacagaggcaagcagggatgagcaaggctggggaaaagacacatttagttttgaacgcctgagcctgaggctcctatgggacatcccttctcagggatgatgatctggggctccagagagatctgagctggagaggaggttgaggagttgtcatcatgatggggggttgggagtactgcctgacccacttgtcatttgccttggctcatgactattgaactgggagataagggggcccaggacagaaccccagaacccaggaaacccccagggttaaaagatggaatagaagctcacaaggaagggaaccaaggagttgtctaggccccaaggagaatgaggggagtgccaaaggatgcttcagtgggaaagagacaggcaatgttaaagttgtccccagacctactaaatcaaggacgaaaatatgtccctggaatgttggcaggcagtaaacagaatgacactgctctcaacagactgatgtggatctatctgcaaggttggcatgtgtctgtagtcccagctactcaggaggctgaggtgggaggatcgcttgagcccaggggtttgaggttacagtaagctatgatcgcaccactgcactctagcctgagtgacagaatgtgaccctatctctaaaagtaaaaatttaaaaatgccaggcacggtggctcatacctgtaatcccaacactctgggaggccaaggcaggcaaatcatttgagcccaggcgttcaagaccagtctgggcaacatgacgaaaccccgtctctacaaaacatacaaaaatttgctaggcgtggtggcacatgcctgtagccccagctactcaggaggctgagatgggatgatcacctgggcctgggaagtggaggctgcagtgagccaagattgcaccactgcattccagactgggtgatgaaacaagatccccccatctctaaaaataaaaattaaaagaggccaggtgcagtggcttatgcctgtaatcccagtactttgggaggccaaggtaggcagatcacttgagcccaggagttcaagaccagcctgggcaacatggtgaaaccccatctctacaaaaaatacaaaaattagccaagcatggtggtgcatgcctgtagtcccagctactggggagtctgaggtgggaagatcacctgagcctgggaagtcgaggctgcagtgcatggagatcacagcactgcactccagcctgggtgacagaacaagaccctgtctcaaaaaataaaattaaattaaaagaaaggttgtatttgttccctactgctaggtaccaaatgactccacagcctaggggcttaaagtggcaatgaacagtttctgtggtccaggaattccggaatggcttagctgggtggctctggctcagagcctctcatgaggttgcagtcacaatgctgctggccagggctgcagtcatctgaaggctcaacaggggctgacggatccacttccaagatggctcactcacatggctgatgagctggtgctggtgttgccaggaggcctcagttcctcatcctgtagacctctccacagggctgcctgagtgtcctcacagcatggtctcccccagatcgagtgatcccagagggagcaccatgggccaccgtgtctcatgacctaacctcagaagtcacacactatttccacaatgtcctagcacggtcagccctatccagtgtgggaggggatattcatgaaggcagggattcctggggaccatctgaggctggcatccccaagacaaagaaagtgtaaacatgaagttctcagcagtatgtttcattcacaaagatttgtggaagctttttaaaggccccccaactacataacacacgatagctgatatggtttggatctctgttcccaccaaatctcatgtagaattgtaatccccagggttggaggtggggcctggtgggaggtgatcggatcatgggggcagagtttccatgaatgattatcaccatccccccttggtactgtataatgagtgagttctcacaagatctggttaagtgtgtggcacctccctgctctttctcttcctcctgctccagccatgtgaagtgctggcttccccttcgccttccaccatgattgtaagtttcctgaggcctccccaggagccaagcagatgccagcatcctgcttcctgtccaccctgtggaatcgtgagccaaatatctcttctttataaattatgcagtctcaagtattcctttatagcagtgcaagaatggactaatacaaaatcttgtgcttatactgtcctagaacatctctggaaggatgtactgttcactaactttttgaatctcacatttttctattcctctaataaatatatgttttaaaaataattagcggataatcaaaaggagtgtccactgagtttggaaatacgttttttcatatatccaacccacagatatttgcgaagctgctactgtgcatcaagctttgttcttggcactggaaatggtgaagggaacagagcttcgccaccctcatgggctgggttcttttcctagggctgccataacaaaatgctacagatggagtcacataagcaagagaaatgtattgtctcaccattctgggggctagaagtttgaaatcaaggtgtcaacggggtcggttatgttgagggctgtgaggggaggctctgttgcaggctggcttcttaacttgcgggcggccgtcttcatgttcacgtggcatctttgccatatgtacgagtgcccacatttcccctttttataaggacaccaggctattggattagggcctaccctaatgacctcattttaatgtgggttcctttgtaaagactatttattcaaataaggtcacattctgtgatattgtgggggttgggaattcaacataggaattttcagaggagggacataatttaactcgtaacattggccttacgtcgagtgagggagatgataagcaaaggggtctatagggcctcaggagcccagggagctggagagggagaaagcagccccgggggaggtccacaatgggcaaaggcagggttggcctgtgggtagaaagtgggtgggagcagaagaagtggatggagggtggagagtcaccaggagacacgtgcagctttgaggagctttggctgagcagggagtccagagtggtggctggagggaaacctgggatctagagggagtcttatctgattttatgatgaaaaatcttgtaagctgaaaagacaaaaaaaaatgcagaaaaggagggcaaggccgcaggttgagggttgggcctcttctgggtgcggagaggaagagagggagggaggagaggcaggtgtgtgtgcatggtgtggggtaggagatctgctgagtaaggaggtgccaggctgcaagggccctgaggagggagaaagctcagggtttggctgagggacacaggaagcttgcagggagtgggggctcccaagccctctctcagccctcagacctccctcccaatccccgacccaccccggcagcttctatccttccgtttccttcccatctctcccagggtccctcctacggcccgtggatctgtccctccccacagctgtcctgctgatcaatggatgctctgttctctctggctcccctccacgtgtccccgcctagcaggggccatggcctcaccccgggggtgcacaggcctgtggtcaaagcaatctccatctggccacagggaagttccgcctccacaactatgacaatatttgaaattcttcagaagttgcattttatgttatcacacccattgggtcctgcccaccttttgaaaaccctccagggacccccgactgctcagagaacaaaacccaaacactttaaagtgacctccaaggctctgcatgcttcagcttctgcattgctttgtagcagcgttttatcttgaaataattttagctttacagaagagttgcaaagacgtatgaaaaattccagtattccttttctccggttcccctcatgttaacatcttacatcaccataggacatttatcaaaactaagacattaacattggtacaatgatgtgttacttttgtaggaaatgatagtaattatggatttttttcatttttattgtggaacatgccatagagacaaaggcatatatgtacagtctgaagaataacaataaatacccttgaactcaccaatccatttaagaaatagaatactgctgttacccccgacactctgcatgctccttcctgatcaaaccccccagcctcaatgattgaagcagggatgttaatttatgggggtgactgatgacatagaaagaaagaattgattacttacaattccaagacaaggcatcacacagtgccacagagggccacggaggcagcaccaggaagccgtgcagatgcctgcgtcatgcttcctgcacaccctgtggagtgtacacccttgggtgaggaggtagaagcaggggcaaagacagcactgggccagaggctttattggagtttccaggacaaatgcaaggcaaggcagactaaacatcgtgctctcagaacggcacacaatttaaaactcattaattgtttatttctggaacttttcaattattttcggaccgaggttgaccacgggtaactgaaaccacagaaagtggaaccgcagataagcgggggctgctgtatagcatatgatcatcttcatgttacaacgcttctattttcttttttgagacagagtcttgctctgtcacccaggctggagtgcagtggcgcaatctcagctcactgcaacctccacctcctgggttcatgcgattcttctgcctcagcctcctgactatctgggattataggtgtgagccaccaaacccagctaatttttgtatttttagtagagacagggtttcaccatgttggccaggctgatcttgaactcctgacttcaagtgatccgcccggcctcggcttcccaaagtgctggaattacaggcgtgagccaccgcccccagccaatgtttctatgttcgattgttaatggcgatctggtttctctccaggtgcacaatgcttctttgagtatctccgtgtctgtggctgatatccagatgcaaggcttcttccgggcatccctgggaatgggagtgcatagacatactggtcaaattacagcacagcctctacacctttactgaagatggaaaactgttttccaaagttgacttgcctaacatgatgtaactatcatgcaaaaataaaaataaaattaagaataaaaatttaaaaatgaaagtttacgtgttcaccagctccctccagacgctcatctgcctttggtgctgtctgactttgtttgtttatttatttatagagatgggggctccctatgttgcccaggctggtctcaaactcctggacccaagccatcctcccaaagtgctgggattacaagtgtgagccaccacgccaagcctgactttaagatttttgccaatccagtgggtatgtaaagatatctcagtggatcttaatccacacttctttgattgataatgagattgagcatttttctcatgtttttaaatcacttatgcttcttttatgaaattcctgttcttttgttccccaatttctattgtgttatttatcaatctttttcttatcgttcataggcgtttttctatattatggatgctactcctcggttagtcatgtgtgtttcaaatcttgctaattgtgactcgtcttttcattctctgaatggggtcttttcatgaaagggccctctaaattttaatgcagtcaaatttgtcaactatttactttatgggttaaactttttaatctcatttttttaagtttcattaaagaatcttttcataaagatgctctcctatattttattagaaagttgtaaagttttaccatttatatttaaatccttaatccatctggaatggatttttaatgtgtgggatgacatacggaatcattttcattttcttccatatgaatagcgagttattctggcaccatttcctgggaagaccatccttttctcctggattcgcgatgcaggctgtgttatcaccttttcatatatgcatgagaaaaaaaaatgttaaggaaaaagccaagtgaaataaaatggtaggcaacactttggcccagcaagtccatgtctaagcatttatcctaaagaaataactgtaaatgcaaaaaaaaaaaaaaaaaaaaaaagatttgtcgcaaagatgtggtttataagagccaaaaattagcaaacaatctcattgcatatgcaacaaaagaaattgtttaaataaatttttgtacatctatacaatggaacattatgcagtaatctaaaaagatatggtagattttaaggaggtgacatggaaagaaaaattgaaaagcgcagactatggaaccacatacagatacagtataatcctcactatgtaatctagaggcatgttcttagacaaattacaaaagagggatgtataaccaactgcaagcagttgatctatattatctgactttaaaaaaaatttgtcatcctagcatcccagtatattatctgaatttttatagtgatatcaggcaatcataaataaaacatagttcactttctccatgttaaaaaaaaatgatgttgcatatgcttaggataataccataagacccagcaacccattcctaggtattttcttaagaatctaagaacatttatgttcacacgaaagccagtatgtgaatattcatcataagcccattcacccaaaactggaggcaacccagatgtccctcaaccagtgcatggataaataagctgtggttcatccacacgatggaatattactcggcaacaaaaagaaacattactgatggatgcgacaccatggataaacttcagaacactgtgctaagtgaaaggagccagacccaaaaggccacatacattataattccatttatatggacattctggaaaaggcacacttataggagagcaaaacatcagtggttgccaggggcggggatggtgggagagatttactataaaggggcacggggacattttgggggtgaaggaactgttctctatcttgattatggtgatgattacatgactatgggtttgtcaaaactcataaacctactaactacaaactacccactagaaagggaaaactttacaatatgtaaattacacctcaataaagaatcgcaagctataaaaggtgttgcaggttatacctttgtaaattaaaatacaccaacaatgtgaaagctaaagaaaaatatgtgatgtaagaacatttaatgatatggaaaaacattcacagtatcgtcaaatgaatatccatgttgcacaacgctgtaatacacaagtctatgtacacaaaggcatgcatacatgcacacaccggtagaaagaaaaaactgctggataaacgccgcaaatggtgtccacaggtctctctgagtggaggggtcactgctggtctttattttctttcgctccctgggtttgctgttttcccacgacgtttcccacaatgtgtccccgctggagtccatggctgactcagggaggctgggaggaggtggccactccacagctgggaaaaccgcagcctcccgatgaaccctggctgacgacctgtctatgtttactttttctccctgggcagacaagacaggagactggaagaaggggccagaaattcagactcagaagccccctccagaggccacaaggcagcctggtcctctctgaaccagtggctcccactcactggccccttgtctctgcctggactcctgcggatgagtggaaggccaagagggcgccctctggtgcccactagatcgactcccaattaatcacttaactgtgtgaccctgggccaactactcaacctctctgtgcctcgggtcctcctctgaacatggggataaagacagtgcttgcctcgtggggatgttgtgtgtgtatacatgcatacacacgtgtgcaaagagcttagagccacgcctggtaccatttacatgctcagtaaatgtttaggaggattgttgtgataacccagcagactgatgtgtaagcctatggtcccatctcagggcatgtgggtgtcacaggatcgtagtcctaacagcccaaaaataatgttaaaatgactcaaggacttcacttatgcttctgagcatcctgaaggaaataggcacagtctacagaactacttcctaatgctccccttagttcaactgtccacttcctcagcacagtccctgtatgtctttggaggtcccccttctccagacctccttcattcagccaacagcgtttattgagcacctgctctgtgccagccagctgctgttctaggctcttagaataaatcagaaaaccaaatagatgaaaaattctcattgttcacaagtagattctagacttctccccagagcaaagcccaggcccttggccttcctctcccctgcctctttcttcctcattctgcacccagaacccaagaaaacgctgcagcccttcctgggagggcaggagagaggaaagatctgagttggccaagccaggctctccagcaggcagggctccagcagaggctgggcaccttcagccatcagcaactgtgtcccattacctgtggaaagcaccagccctggcctggaaaacagtaggagttcatcaagagtggctttgttgtacagtggttgtcttgtacccagttggattggcagcagcttcggggcacgaggagcgactgttcactccttggggagcttgcagcacagggcaaggtgcacagtaggcacttggtggctggcagggccctctggggcatcctatgggtgaatatcttgctgagcccatggaaggcccatgtcagaatccagtaatgtgctggggaggcgagctggggtggggttggaagtggtgctcaccagcccagccagggttcctcttaaaagtcacagtgctcgaagccagtacagtgcctcacccctttttatgccctcacctggctcatctcccatccattagtcctcaaggtacatctgtgagtcccatgggtcaggtagtgggtgcaatgggaggagatgagggtgtggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactatcaggcacctggggacagaccccaggacactgccttttgtggctcttgccacccatggtcacctcagttactcaagccacacatgcatgttcgtgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaataataatgaaagcatgtcttatggtgtgacacctctgctcaaaatcctttcatagatccaattgtctaccatggaaacccggcctctgggctgtggatacttgtgatgggagaggtggtgcgggctccgaattctttccaatagtctgcaaacccgcagagccatgaagcattgtctgtaggccagcactcatcctccacccctctgcctgcttctccgctctcctagttccttctccctcctctaggaattcagcattgccactctgattggctggattttgggacattgattgagccttgttttctagtgggcaggaggctctgtgtcttaaaggccactggcccagctgccaatgaatcagtactttgtttccccaggtagagtgggggcagggggcagggaacgggcagggcaagtttggggcattctgctccgaggtccctctagccaaacgttatcaaatctcatccaacatgctcctggctctccatttcagatgtctgtaaactggggactacaaaatgcaaatatgtttaagagttgctaaatttgcagtgactttttctcaatcagtgttttgcaaatctaactactatcataggaagacctttatacttgaaaaacttggcgggtcactcaccacccagatcaagaccaaagcatggctgtcagtgccttcgcttaaacagttctctccacctggcctgcccttctgccatgcccctcctaggccatcacagatgccagctcagaggggcagttcctgctggctgcatggtgtcccacctggactgtgtcaccagcctcttcacagcctctagccttcggtgctccctacctgaccacccatacgtctagcaggcagacggacgggtccagaaatgcacacctggtcaccttgattgcactgagccctgccctgcagtcagttacctgggttttccaccaggcatccatttagcttagtcatcttcctctgggacagtggccgtttgatggtgacagacctaggcccaggtttctaagaatcaggaagatgaagcaacagggaaagcaggttgaccctcgcttccttccccttccacaggacggtcctgccccggctgacagaggaggggtgagtcctgctgcttcctggcctgtaagatgcccctcaaggtcgggcgtggtggctcacacctgtaatcccaacactttgggaggccaaggcgggcagatcacctgaggtcagaagtttgagaccagcctaaccaatatggtaaaatctcatctttaccaaaacgacgacgacaacaacaacaacaacaacaaaattagctggatgtggtggtgtgtgcctgtaatcctactcaggaggctgaggtgggagaattgcttgaacctgggaggtagaggttgcagtgagctgggactgcaccactgcactccagcctgggcggcagagggagacccagccaaaaaaaatgccccttaagtttcccagcctgaatatattcagtcacctgagccactgagaggctcccccgtggctccagtcagtggcaggagctggaagtctcaggagagaaggaaaacggaacccaaacctttgcaaacactcagaccggctgctaagtgccacgcacgcgtttgatcacactgactcctccggcgagccctgtaaggctggcgttactatcccactttacagatgaaggaactgaaggtggctgaggtagcgacccttcctaatgggtgggagtgggattgaactgagccacacagtcagcatttatccccccaacaaagagtaataactgcccccgtggcccaggcctggcttgccaaaggctgtacattctgtgtggaataaacctaagatgctgtgggagggagggagttcagggaaggcttcctggaggacacggtgctgcatgccaggcaatgggaaatgcatcttcaaaggcatggaggtgtgacaaagtttcacatgttcaaggttatttctctaagttagtgtttctcgaggggtggcatcaactgggagctttccaagccttgtcacctaccctgtactcaggatcagggcgtggggcttgcttttggaaatctgcgtggtcataagctcctgggtggttgtacttgaaagtggcagtgcgagaaccaatggggtgggatgtggagggccctgtgagcctgttaaggaagtgggccttgccccttggtgatgtgaagcagaggggggatggtgctggtgtcggcttcagagagatctctttggcaggtgtaggtgaccagcttggagcctgggcacctgagacaaggccggagcagccatcaggaggccagacagcaggaatcaaggtctggacttcagagtggtcaagaggatagaaagaatagagaaagagagaaggcaggcttgaggagggcttccaggttccagctttatggaggaggcgagagggggctgggtttggagaattggtagagccgagacagcagtgcagcccttacacccgggcaggtcaggaccccacaggccctatgcctcagggtgccccacaccttagagtgccttcctcagaactttctaggtcccacctggcacctagaaccagctaggcatggcagtgtcatccgtgtgggcaccccaggcccagggtcaggccccgatctgctgtctcattcctcatttattctctatgggacactttacagccctggaccctgaggaaggggtctgccaggtgccctgagagctctgggactcatcctatgaagtgtcctggggccctgaggccaggtcccagtttcaggagggtgcctggagagctgatcatccctgctggccagcgcaatgttactttggtggggtcatgtgaaattgggctgccagaatggtcctcaaatgctgatttgaggtgactccaaatatttgcctgcccagggctctgcctaaggacagccgtgggtgcagggacacttgctgctggttggtatctagacactgccctgatatccctgggtgccttcctgctaccctggccaccccagatggggtgactcaggtgaggtccttggggaggccaccctggcacccactggccagtgactcccacctgctggcctctcctcatgtattacacctccaccttaatcacacggccaaccgcaatatccccagcaatagggccatttgatgtcgcatgatctgctgcactgagaagaacgcagcgtcgcttctgtggtttccctgctcagagggcacgacctgaatccagtcccaaggaaacaacagccaaacccaaaccgacagacattctgcaaagcagctgggttgtcctctccaaaaatgtcaagtcatgaaaacactgagaaactgttccagcttaaaagagaccaagagcctgggcacagtggcttacacctgtaatcccaacactttgggaggctgaggtgggcggatcatgaggtcaggagttcgagaccagcctgaccaacgtggtgaaaccctgtctctactaaaaatacaaaaattagccaggcatggtggcgcttgcctgtaatcccagctgctcgggagacgaaggcaggagaattgcttgaacccaggaggtggaggttgcagtgagccgagatctcaccactgcactccagcctgggtagtaagagtgaaactccatctcaaaaaaaaaaaaaaaaaaagaccaagagacatgagaagaaactgcaacaggaggtcctatattggaccctagacccattcacatcattattggtaccattggtgaaatgggaatggggtcagtggattagctggtaatactgtatgaatgtttgtgctgtgataggccgggcacagtggctcacacctgcaatcccagcactttagaggccgaggcgggtggatcacaaggtcaggaaatcgagaccatcctggccaacgtggtgaaacgccgtttttactaaaaatacaaatattagctgggcatggtggcacgtgcctgtaatcccaactacttgacaggctgaggcaggagaatcacttaaacccgggaggcggaggaggttgcagtgagctgagatcgcgccactacactccagcctggtgacagagtgagattctgtctcaaaaaaaaaaaaaaaaagtgctgtttgtgctgtgattatgcaggaaagcatccttgtttttaggaaatacaaactaaaatattatgcgtgcacttacacccaaataattctggaaaaatatttacatatatatatgtatacacatatatattcatatatagatacatctgtaaagataagtgtagtaaaacattactaacttggacaatctgtgtgagataaatataggaatttttgtacgatttttgaaactgttctgtaagtttggtattatttcaaaataaaaaattgaaagcaattttacagtctcaacaaccacaaattataatagacatggctaccataattgagcatctagtatggactccaatgcattggctcatttaatctaacattaacaacacaaggtagatattattcgtcctgttttacaaaaaacgaaagatctcagagtggttagtgactttcccgaggtcatacagcttgaaagcagcagaggccagaattgaacccaggccatactggcttaagaatccgtgctgtcaacctctgagaaatggagaaatgagcaagtaaacagacgacaattacacagggtggcaattatggagacagactctgaagggagcccagataacctggaaggctccatgtaggaggcgatatttgaactgggccttgaagcatgtatagaagttttccacttatggaaagaaagtctccaggtagaagaaatggcatagtcaagggcgcagaagcttgaaaggataggtccctggaggttgtttttctgggcctcaccaccctgtgggtaaaaacgtggttacattaagtgtcactggctttttgtcattgcctacaaagtgcccctcatgcttctccatgagtccacaatccacattcacctccgtcacataacacaacaggaggtgccccttcccctcattttgaaaccttcagcatccctttgccacttttctgcttgtgtggccttaggcaagttacataacttctctaagcctcaattttctcatctgtgaaatggagccaatgatacctactttcagggctagataaggattaaaagagaatgtcagccaagggtttggcttggtttctgatatggattaagcccatcaaagatggtggctgttcttatgaatgaggaccctagatcccagagaggggcaaagactggtccaggttcacacagccaagcagaggcaaaaccaaggctccaccccaggccctggtccccactaacctcccccgaaccccagcctgccaatgttcccagctcgtgctctccctagcatagggcagagccaggccacgagcagctctctagcagccgaggttctctcggggctcagcctgttggggcttggctgggcacatacgtatttcctaatgtggccgaggggaaacagccccaagtgtcagaggctgttgcacatttggcaacagccaactgccggtattgcttttcttcccgtgatcctccctcgggctggaggaggccaggcctgccgtgagccaacattgtgacacaggcgcagctctccagtttcctgagcaaaagaagccagagaggcaccctcccttccacccacccctggagagctgctctatcttgttttcctttctctcagccttcagcttgtcccagaaactgccctttgtgcagggctcaggccttcagtctgagaaaccaccctccttccatcagcccccaggcaccgatgcagatgcctccccccggaagcgttgggggtttgccaggccagactgagcttgtccttagtctccaagcacttagggtctagaactatgctctgactcttcttttaatttattcactattgagtaaatcttgtgtcccactctgggattgctgtgataataataattaatattagtattaataataatgaggaagctcagcccctaccctgtgccccttggaggctcatatctttctgaccagattactcaaaggagcccttttatgagacgtgaagctgggaaggagacagacagtgttttttagcataacaaagcaggggagacaccctcttaagagtttatgccataatacaaaattaatacaaattgtacaaaatgtctgattctcttttttttttttttttttttttgagacagagtctcgctctgtcacccaggctggagtgcagatcacagctcactgcaaactccgcctcccaggctcaagtgatgctcccacctcaacctcccaagcagctgggactacaggcgtgggctaccatgctggctaatttttgtattttttgtagagacggggtttcgccatgttgcccaggctggtctcaaactcctggactcaagcgatctgcccacctcggcctcccaccatgctggcctgattgtcttttccacactgcaccttgaggctggatctccaggtgggcctgcttctctcctccccttcaccctccagcatctaccacaagctcctccttcacctgcaaccccctctcaggatgaaagaatggctggcagcatagcctggaagccggacacacagaggaagggggaccctggtgggtgagggagggaaagggctagaaaatcagagctgaggggagggagagtacagggcctcaggtgaccacagaggtgacctcatgttaaacccaggcaagacctgtgcctgaggatggagcgtggggacaaacgaggaaacaggttcagcaagtttaagcagcaagctcacagtcacagagcgaggaagtggcagagctgggatctgggcccaggtttgtcaggttccaaaccatgcccttaacagccttgctgtgctgcgggggctcacataaggcagggagtggctgcttctcctccaagcccctggcggagtggaaggctcacagaggcaatgtaagccacagattcctctatctttgcccctatccagtccaaacccagaggccagagggccaagagctcagtttccagtgcccctggcttgttttcctgggggctctgaggctctccagccagctagtgatgaaggttgacttacgattatttactgagcaccttctctgtgcaaatcgattcacacctattatctcatttcatcctcaggaacaactgccatgatgagcactgtttcctcatctttaaatgaggaaccccaatttcagaaaggtggaggaacttggccaggctcacagaatagggtagcatggctgggactatgaacccaggactgcctggctctaaacccaattcactttcttctggaaaaagtcgtcagcctaaggacggaagagcaggaaaatagacagatccagcccttgaactgaccaactcttgatccaccccatctgtgaatttctactgagaagaatatattttccctatgatttaagctgcatcaaattgaaatagcaggagaagagttttgggggatgacaggattcttctatatcctgattgtggtcctggttacaacacatagctatacatgtatcaaaattcctagaactaaaaggaactctaggaagcaaatatggcagaatgttaaggttttataaacctatgtggtctattcttttcttaggtttgaaatattttataataattttagggaaaagaaaaaaacaaaaagcaggaggaggaggaagaggaaaaggatatttggggaaagtctgtttagatgggatggctggagctgctgcggccatcttgcaaccatgaaagaagccagtgtaagagcaaatctgagacacggggatgggagagcagagagatggaaagatgatcctgcagatgtcggtcagttgctgaatcaatcagaatctcaaacctgtcctcctccctctggacttcctctctgccataataaatttgtttatcgttgaagcaatgtgagttgatggtttctgatacttgggttgaagacactgttactgatacaggatacggggtcagatctgaagcagtggggcagccccatggccagcagcagtgctgacaaggagactgtggaaagtcactgatgtggctcatctagatgtggctgggcatgagacatcggggaagccagtggggttgcttgttcagaaacttgccagctgggttttttttttttttggtgggaggttgtggggggacagagtcttgttctaccatccaggcttgagtgcaatggtgtgatcttgactcactgcaacttctgcctcatgggttcaagagagtctcatgccttggcctcctgagtagctgggattacaggtgaacaccaccatgcctggctaatttttgtatttttagtagagacagggtttcaccatgttggcctgcctggtctcgaactcctggcctcaagtgatccacctgccttggcttcccaaagtgctgggattacaggtgtgagccaccacccccggccgtcagctggttttaagattctaattttatagcaatgtaggtcattgtcatgtgatttcatcttaatgttcctttcctagctgacaccctcacggataccacatctacctgggccttggggaactcaggaacttcgagcaactaagagctggaagtgttcaaaaatgtgcaagataatttttcaaaaatctaatttttgtgacaagtcatcaatctatgtgttctggctgctacttagagcaatcttcctggtacagatgcagacatctgagtctgggggctcaaatcacttggaaaaagggagagctggggtgagggcctacagtcatgagtcctcctggcacctgcctcaggtaagggaaaatcttctctgcgtgaaaggaggaatgaccatgacagtgatgtgatcgctgcatctcagtttccttgtttccaaaatggtgaagaggtcaggcacggtgtggctcggccttaatcccaacactttgagaggctgaggcaggaggattgcttgagctcaggagttcaagaccagcctggacaacatagtaagacctcatctcaataataataataataataataataataataataataataataataataaaacaaaatggggaagaatcatccctctctcagggttgttttttggcttggagatgatgcatatgaagcatctggcacacagtggatgcttcacacacggccactgctttcattctgaagcaagccagaagaattctagttgctgcagatggaagcaggaggggagactcttttagaaccaaacgaagagaggaagaaaaaaacttttaagaaaaaaagaagaaaacttcagaaggtctcacgtcctccgagctcagcggacttcattagactttcataaagtccaaagtcggggagacagggcactagggggctgatgaggacccagcgggagagaagctggctgccccttctgcagccccgcccctcctctcatcaccatggagacggagcaggctgcccagtggggttcctgcccacccgaggcctgaggctgctgcagagggaggggcaggggctgagcagacagggacctgtctggaaagctgggttggcggtggggagtgtctacatccccccaactcccaaggcgctgagggattcgggctggtgtgggatgcatctggagggctgtgttttgatcctcgctctgctagcagcttgctgagtgaccgtgggaagaacgcttcccctggtgaagcctcaggttctacatctgccaaaggaaggagtaaaaatgtacaaaaacagaagcttggataagaaagctgtgggatgaggaagcaatgaaatatttaatgctggagaagaacatttgctacctattgtttctcgaaaaaagggaactttaccaaactgaccaggtgatcccatattggttaacaaacaaacatggactctctacctatgcttaccaacaaaagagggagaaaagaaatactctaaaatacactttggcttgtctccggaagagggagttatatgtaatttgtattctcttgtttctttctcaaattttggccaataaacatgggttacttttaaaatcaggataacattaatagctagcatttggatatttattttgcacgggcagtatgctaaatgctttacgtggttttaagctcattttatcttctccacaatccagagagggagcagtactatgtatttctcttctgcagaagagaaaaccgaggttcagagaggttaaagggcttgcctgaggtcggaccactagagaatgacagggctaagatttaaaaccatagccaagatactagactctaaaatgtgagcattgaatcattaccactactgcctctcaggacaagaaaacacgaaagcatctgttttcttaaatgttttactatcaaaaatacaaaagaaatcaaaagtagaaagaaaaatatgaatccttatgtctgtgccacccaccttcaagggagtctgtaggtgggggcatttgggtggggacacagagcggggaatggggtgcctagggaggggaaccaatctacacacacacatacacacacgcacgcccgcgcacacacacgcatgcatacatggacatgcgagcctcccaggctgcacttctccctgcctgtggggccctaaccacaatggaaaaccacagcggccctccctctttcccaccctcaccaggttccttcctcctttccacattctactgacttgcatttccccacccgactcttttatagctccctggttcaacctcaaggccttgaggttttggcagctctggaggatgagagagaacatggccaggggcccttgcaacgcgccgagatgggtgtccctgatggtgctcgtcgccataggcaccgccgtgacagcggccgtcaaccctggcgtcgtggtcaggatctcccagaagggcctggactacggtaactggatgcctcccttccctcctctccacccctgaggagcacttacttagcatctactgtgtgcacccctttagatccagcacctggcacactcatagcacctcagggcaggtccccttgcccccattttatatatgaagaaactgaggcaaagcgagttgcctaagattgcagggctgggatggcagagctgggattggagcactggtctagaggactccaagtccagtgctcagacccctgagggtcctcatggtcccctccttccctctatgtaacctccacctttgacttgtaagcccttctcttctttccaaagccagttctcagccttgccatttgcctctcgttgctgaggaggctgagcagggtcagagggagagtgtgggaggacctccccaccccgtgctctccccactgcaggggctggcggccatactgtgcacagtgctccactgggtgacacaaagagggtccccccagaccactcaccccagcccaggcagaggagagaaagacctgctctaacctgtgccaggcattgagctaggaactttacacacacagtctcttttaccctcacttcagccttgtgtaagacaaactgctgctatccacatttacacgtgagaagtgggcagcctggatttgagctctggtcttgcctgatgccccagcacggggttgctcgatgctgcctcccgatggcagagagatgacctgcaaaacagtgggtgacacccagccccagggaaatcagaccaaggggaaggcagagcctcaccagttggggtgcgttgggaaaacagacaggactcaggggacctggtatcccacccctgaattcccaccccagcccagcaggacatcagtgaatcctagagctgcagacagaaggccacagaagacagaagagctagggggaaggagtatggccctgaagcctgtcgacacagaggctcagtcagggtctttaagttcagtggtcttcatgctccgtcatagcagcctgagtttccccttctacccaggccccttgtgccaatcggagtgagttttctgaaatgcagcaaatccctacacatcctcccctggctcacattctccatggctccctactgccttcagaagctatcctgaccctttggcatggcatttgagacccttcgaggcctggcccctgtcaacttacagatcctggccactgcacatttttttttccctccacacagtgaccagttatgtgtcatttacttttgaacccccagaaagccttctctagggcatgggctctgggaccagaaggcctgggttcaaattctgccccttgtccgctgtgtggcccctagcaagtcacctcagctttctgagcctcagcttccttatctgtgaaatgggggtagtgacaggacctacttcctaggattgtacaaattcatacatatacggagcctagaacagtgcttggcacagagtaaagctcgatacatttcattgatattattatttcctaactggctccgagaaaacccaaagtctgggctccctcatcttactacttactccttttcaggtaatgtgtctgccttttaattggttctttgatgctgttagccacatcataactggtggtagaattcctgccattaggacattatttattcatctaataaatctttttttgttttgttttgagaccgagtctcgctctgtggcccaggctggagtgcaatggtgccatctcagctcactgcaacctctgcctccggggttcaagtgattctcctgcctcaacctcccaagtagctgggattacaggcgtgcaccatcacacccagctaattttttgtatttttagtagagacggggtttcaccatgttggccaggctgaactcttgaactcttgacctaaagtgatccacttgccttggctttccaaagtgctgggattacaggcgtgagccaccgcacccagcctcatctaacaaatcttaagtgccttcaaagtgtcaggcacaatgggaatgtaagggacacacgagtaaataaaacagattgctgctgacttcagggggcttacatgtaataggggagagacattcgtcagagtcacgtgaataaatgcataattacaaatggtaacaggggctccgaaagagcagtccacagcatcatgagaataacacagggcgttgctctgatctactaagccagggagggttcccagaggaagtgatgaatgagctgactagaagctgaccgggtgaatatgggagggaagaatttcttagggagcaagaatagcatgtgcaaaggccctggggagacagtccaaaacccagagaggtgggagatctgtgggggtgtagcatagagcaaataacaaattaagtatccaacaaaaactagcaggaggcataactgggtgtttcaggggtgatattttagaccaggggtcagcaaactacagccctccgtttttgtatggcttataagacaaaaatggccttaatgtctttaaatgatgggaaaaaaatcaaaagggccggtcatggtggctcatgcctgtaactccagcactttgggaggctgaggtgagaggatcacttgagcccaggagttcgaaaccagctgggcaacatggtgaaaccccagatctctgcaaaaatgttaaaaaaaaatttttaaaaagttagcctggtgtggtggcgaacacctgtgatcccagctgctagggaggctgaggtgggagaatgacctaagtgcagcgggtcgaggttgcagtgagccgtgatcatgcctctgcactccagcctgggcgacacagcgagaccctgtctcaaaacaacaacaaaagaagaaaaatactatctcacaacatgtgaaaattatatgaaattctcatttcaatgccaacaaataaagtgttattggaatacaggcacatataagaacatgatattgtctatggctgttttgtgcagtaatggcagagctgagtatttgtgacagaggcaatatggtttcctataaagggtcagtttactatttggccttttctaggaaaccttaattgatccctgtttttgacccttccagtgccactgtccatgctacgaacaggggcccagggtccagagcctgccctgcccctctgtcccctgctccaggctgtgcctctcactgtcacccctgccttctcccttcagccagccagcaggggacggccgctctgcagaaggagctgaagaggatcaagattcctgactactcagacagctttaagatcaagcatcttgggaaggggcattatagcttctacaggtgaggcctatcagagctcaatcctcgatttgcaggacttgtagtgttctggggacaccaagagctagaatgcagagccacaaactcctcaactcacagagtttcatatcccaaagcctgcatttacatcatcccaaggggaggcaacctcccagctgagcgtggaggaagccacaaaaaccacgactcccaggaagtgtgtcatgaacccccaaactctgcgccatatgtcaattagaatgtgcaagttttcaaggtcagaaaatcttttctaaaatggcttaaggcagaatgcattggctcacatggccggaaagtctctggaagagtctggcttcaggttcagcttgaggcaggcttacatgtcactgggccctgtttctctcttgccacctctcagcatcacttccttggacaggcctaattcgcaggcagtgtgtcccctccagaggcaagacagccaccagtaagtctctctagatctcctgctcagcactctgaacaaagagccctaagactcactctgactggcccacctcagattatatacacagccctgagccaatcactgtagccagggaatgaaatacactacttggccgagcctaagttgcaagctccacccccgaagatggacgtgaggtcaactttctttggagtggcatggaacagatatggggaggggcttcccctaaataatctagtagttctgttatcacaagaagggggctgtgcactgggcagaaaacccataaaagtcctctacagttttatacacccattcattcacagatattttgagcacccactgtgtgtctgacacagcaggctttggggctgcaatagtgaaacaagacagagctatacagagctcttctgtacagagcttccagtgaaagggccttctattttatcttcattgattgccacacaccctgcaaaatagcaatcactgtgcccattttacagatgaggaaactgaggctggggtaattatgcccaaggtaacccaagagtatattaaagagcaggatttaaatgcaagttttttctgacttcaaaacctaagccactccagttgcctacatatctgccaagcctgctttcttagctttgggctcctcctggaatggatggagtgaaggaccaggtggtgggggacaagtctgcattaaccattaacgaagtcctcatgtgtgcacctaggagtatatgaaattatatgacattcacatttctcctttgcagcatggacatccgtgaattccagcttcccagttcccagataagcatggtgcccaatgtgggccttaagttctccatcagcaacgccaatatcaagatcagcgggaaatggaaggcacaaaagagattcttgtgcgtttccatgcttgcggtttgttgggtgtgctcttggtgatatttggacgggattagagagtcagcgtctctggaatgcccaatttttgccttgcctattaccacctatagccacagcgttcctcaggaaattcttcacatgagaagattcaacataacccttgattaatagctgagaatttatccacatctcagtgcaggatactggcgaggctgagttggtgtatgtggcttagggtggaaatctaagtggaacctttaatttatcccgtttatcagttagctattgctgtgtaacaaaccatcccaaattctgtggcttaaaacaacaatcggctgtcatcacttatgtatctgtcggctggggcttagctgatctgggttgggcttagcagaggaggcttggctccacctgtgactcctcctccttggaccagtgggttatgcagagcatattcttggtgatagcagaggtgcaaaaagggaaagcaggaacacacaggtcctcttaaggcccaggctcagaatttatataccatggccaaatcatttcacgtggccaagcccaaagtcaagggcaagcaaaggcaccttcctcaaccctgccatgataggcaatggcaagggtatgaatgcagggcagggtgaaaaataggggcaaataacccaaactacaactccaaatctaagtcctgggatctctccacagctaccctgcccattagcaatagtggttcagactgaccatcgctttaggaaggtctcctttctggggaatctagggaggaaaatggaggagaaaccaccctggcggatgaaaggggcgtgagtctgcccgcccttacaagaactgctggatgtgtctcctccccacaataagaatcacttaactctctccctgggctgttttgcatctgtcttttcccttaatgatcacacacaaaaacaaaagaatgtccactgtctcaaccaaaacccatttcatccctgaaggaggagttattaacctcattactgaattaatgggggcattaatgaatgaaagtcattggccccaaacacccagctttttagtagcaaagctgagacacacactctggtgtctgactgctgatccagggtctgagggaggaaatggaagctcagagaggtaagaaacatgcccaaggccacacagctagggcagcagctgaagcagtggttaagagcaggtttctgccaggcaaacatgagttccgaattcaggttggattcctgactctcccactcggctgctatgtgatcttgggcaagctgcctcttctctctgaacgtacctcctcacctggagtggggataataacaaaacccgccttccagcactggggcaaagtttgaatgtcagtgggaagaaaggacttgtcccacattcctctttgttcttcttcagaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtatggactcccgggactgtggctgggaggagggacttaaagaagaactctcccaatcatccctgtattccgaaaacacatccagagtgccacctgcatgccaggccttgctcagaggcctcaggcatggtacgggggccaggggcccacagatgaaccagacactgtctctttctcaaggcatcatttgttcattccatactcatccagcagactttactgagcacttactatgtcccaggctcatactaagcactttacatatgcactaaattatatcctcatcacaaatctgtaggcattcatctatccatccattcaacaaatacctagtgagaatcagctctgcaccaggctcgtgcaacatggtcaggaaacaggagtgacaaatgaaaacttagcaagagctaatattggtcagaggctgactgtgcccagcactgatttgatcacactcattatctcattcaagccacaccatgactctgtgaggtcggtctattattaccccattttctggggagaaaaccaaagcatggagagataggcaataacttaagttgctacagctaatgagtgttcaagtccaggtctatttcaccccagactcagccacacagtcctgttctcttaaagttttcagcccagtggggaagacaatcattaaccaaagcattgcatgaatgaatggcccacacagaattacaaaaggagacaagaattaagaaaaagaggtacaaacttctatgaacgcagagaaccagaggctctgaccgcatctgggagcaggccaattcttccttggtgaaatgacatttgaactgagatgaaaggataagtaggcattagttagggaggtgttggggaggggggtgttttaagcagagggaacagcatgtgcaaaggcacggtaatgggaggacacacaggagagaggacatggcaggccagtgtggctagtgtgcagcaagggaggggactggtaaggaatgagactgggacgggggcccagccatgcagggattcaggaaatagcctcatgaacaggtcactaaatcggggagaagtgtctgatggggtgtgtgcagttagagctcagaggagagggtgccaaaacctgtttctaggagggaagaaagcttttgagatgaggcagcctcctgaatccagcccagggacaatcaaaaagcctcatctatgtccctacttgttcatctctaggtggctgatccaactcttccacaaaaaaattgagtctgcgcttcgaaacaagatgaacagccaggtaggaggggctcagagccccatcagcaaacagaggagaagggcccttagtaaccacacacctcccccttctacggacactctgctgtcactccagaccccttggtagtccttatggccctttgaaaccacaaccccagctctaaaatcctgtcatgtatgttttgctgaagagtccaccaagagaccaagagacaatcacttcccacactcccagcaaactttccctcatgccaagcttgggccacctctgcttttccccagccttcctccctgctgagaaaatgccattctctttctgcctccctctcttcccatagccctgctagcctccctccaccccacccaccccaagttccttccttgatgctccccattcagaacaaatgccattgatgaagctgcaattctggcctttggccaaaccccagccatagcccattccctgaggctggaactagtacaagagacgggtatcagccagcacttcccgaaccatgcccatagcctaaacccgcaacccacatacttcagttacgggatgaggccattcatttggctggttttccattaacaaattatcagtttttaagaatcatctgagcctgtctcaaaaagcaaagagttttgcctctctccagagggcaatggaagccactgaaggttttatgcaaatgggtgacttggccagatctgtgctttacaacaatttccctgtccactgtgggaatgactggaggggccaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15018 - DNA, 17922 bp, Human
tgactttttaatgatcgccattctaactggtgtgagatggtatctcatcgtggttttgatttgcatttctcagacctaaaaccataaaaaccctagaagaaaacctaggcaataccattcaggacataggcatgggcaaggacttcatgtctaaaacaccaaaagcaatggcaacaaaaaccaaaattgacaaatgggatctaattaaactaaagagcttctgcacagcaaaagaaactaccatcagagtgaacaggcaacctacaaaaatgggagaaaatttttgcaatctactcatctgacaaagggctaatatccagaatctacaatgaactcaaacaaatttacaagaaaaaaaaacagacaaccccatcaacaagtgggcgaaggataggaacagacacttctcaaaagaagacatttatgcagccaaaagacacatgaaaaaatgctcatcatcactggaagctcctcttttacctgctttatatactgattttcctcttatctacagaaaaaagtattctgatgcaaacacacacacaaaaaaaattttaaagctactattggttgaccagtttcagtgactcaagcctgtaatctcagcacattgagaggccgaggtgggcagatcacttgaccccaaagtttgagaccagcctaggcaaaatggtgaaaccacatccctacaaaaaaattagccaggcgtgctggtgtgcgcctatagtcccagctactcaggaggctgagacaggaggattgcttgagcccaaaagatcgaggctgcagtgagctgtgatcatgccactgtactccagcttaggcaacagaacgggaccatttctctaaacaaacaaacaaacaaacaaacaaaagccactatcttagacgatttctaaagtcctttctagctttaactttctaatatcctcgtgattgcctcgtctttatgatgaagatgccatttagtgaaaacacagaccacggatatctcataggaggctatgccacggccgtctttgtgaaattactgcaaccttcttgacagtgaaatattctatccttcaacaattgctttgtgggcaggtaaccaaagggctaatatctgatgtgaaggctggatcatgaacctcccggttgggttctacatgtaccttacctcaacatccgggtcaacatgagtggaaggggcttggtgcctcagtttcctcatctataacatgaagaattggtcttcacatctctgaacctcttgtcagcttttcaatgccataatttatatcagtccctggtgcttgatcaaatttaaacggtgtgaattccagacaaagaaaaattagacctccaaagaaaatatgggtctacagagacatatcaagatgttataaatataatgtgatgatgataaatatgcactgctgtatcaaattcttaaatagaaaaggataataacaaagtaaatcaaaactttttagagaaaacttcgtttcctaggatagatggagtgacaggtcccaagtgatgtgccaaccttttttctcccaagcttctttgaagagattatctaagtatcgtttcagacacccatcacccttatttttagctctgagttctcttcacgagtgtggtgacctgtggctctaagttccagaggctcccagatatggcacatgactcatttgcaggtaccctgcaatgatttccaggaaggtcagtggggtgggggcctggagaaatgatttttgatgttaaacccttagctcttgttcctgttccaaccacttgatcagaaatgacacacttcataaattgatcccttggtgccataagcaattggcagtgcaaatagaacccaagtgattcggttctccaagaggctcacagctggctggggggttgggggagacaaaactcagggctttggtcacagtctattttcagcccctgatagcagttgtgttactcacgtctcattcaccctctcccttggcctccctcctgcccttcccccagcaggccaaggctggtgacagccttcatatatttaaagaggacaagagcccctcagactcagttgagctgaacggagtccacacaggcaggtgagtggagcaaggcagacatttgagctggaggtgggttggttctgtggctggtttggactataaagggtcccatagagtaagagcacattttacgtctcaagtgccagcaccctctctggttctgtgcaaggaggctcaagttgtacttgactctggtgtggatctagcaggtattaaaaaattcctgcaaggatggttaatatttagggggcttaagggacctcataggcagataaatgagtaaagaattatcctcattataaaactacttacgtggtggaattacatttcctgtcatcttagttggaacaactggaaagcgggaggaaataatggaaagtctgctgaccttctagtcttacaaccaccatataattcatggatgacagactttgagaaggttcctgccctcaggggcttggtctcctcttctgcaaggatcaatataaattggcgacattttttccaaactgtaaagtactgcacagatacaaagcgataagcgattgtactagatgcaatatataagacagctttcccatgctcaatttacctggaatggtgttattcaaaaggtcgtggtgaatgactgagattttgggcttgttgattttaaatagacttttgtatcccaaagatattcagcaacaagtttgcttttaatcttttgaaattaatcaaaactggaccccaaaaagacattgctatgttgaaatatattaaaagctctattaaatgggaggataatttatccagtggttaggattcccactgtttcctctaggttttagtcaaggactttttaaaatatcccagtgaatgacagacataggtgtgattgagaataagaagaggttttaagcaatggtctgagtggaaatgctgctgaaagatccaagctgccgactctaatttctgccctgttcctgagccaaggtggtgactcctccaagaaggaggagttgagttactggtctgaggaaccttgtctctgcaatacgattcaatgtaatttaataagcatgtatggaccatctcctatgtcagggctggagggaggtagaggcagctctatgcagggaagggtataagtgaacagcacgaagagtgggaaattggggatggcctgtgtcctcagtttacatctgggattaaatctcaatgctgggtacatacaattcatcacaatgcatgtagaactgctttatgatccagaaaatgtgagggagtcttatgacttggctttgttccctttctgaacaactcagtcgtttgtggtcagtggcaatgagcccaggctattgggcaggaggtgtagctgagccccagggctttgtgtcctccctggggttcaggcagacaggtgctctgcagcccagacacacgtgtcatccatcagaaacaggagacacagggcaaggggcctcctccttcgaaggagagaaggggggaaggaaagagagaaggagggagggaggaagggaggaagagaggaatgaaggaagagggagctgcagcagcattcagccagcaaatagccaaaattcccttggaggaagtggagacagaatcttgatagaatagaaactcagaaatcctgggatattcaagaagaaaataaagataatcagttatagagcccgttcaaattatagctctgaatatcacttaacttatctgagtttccattttctgaacaataaaactaagggtagcctacctctatcaaagggacttgtgagaattgaatgagataaagtataggaaagtacttttgtaaagtttaatataaccgtacaaatatgtgagaacgttgagaaaaggcatacagccaaacccagtgggttttgggggggtttcctgctaagtacaagcgtgctgataaaagtccagaggtcagagtgggtaagaagctgaccaggagttagaagataattaatttgttttacaagaggaaagacccagggctaggaatataacacacaggaaatacaagtcttgaggcagacagatttccagttacaagtgtgctgttcagatatctgtgaataaatactgtatagagggttgggcttcatgcacaaagagaaatgtgatgcctgcaaatgtgaaaaactgcagttattcatcccagtgaagaatggcaggaagggagacagtaatggtcttaaagggcattgaggatggagccttttctgagctttactgtgggaaagggttgatcatgatttgatggtcgtttatggcctaggcaggcatggaacgagtactagcttatttaagggtcacaaaaagttatgcaaaactcatttttcagaggaagaaactaaagttctagaaagcttaggaattgcccagcatcacatggctgagaaagcggcagagccaggaggtaaactgggatatgatgtggtctttagaaataaattgtagaggtcaaaatagaacaaagagtgagttttgggaagtaaaagctggccacgcttcagatataatttcacaaaaggtgtaagatgcccatgttctacagccttcatttaatgtatgtctaccatgtctgagtttaaaaggggctgagagccaacactcaggtttatttccatgctggcaatgagcaacctgttcttcctgggctctgtgaaagggcctctggccggaggacgtcatatatctgggttcagaagctcaggaggaagcagccactgaccttgaatgtcctacaccgagaactgaagggcatgagctccccagactacagggcccctggctaggcatgctgcctccaacccaatccaacaacgcaaggggaccgactctcaccccgacctgggcacacctgtcctggggcaccgcacactccaaaggctgaaaaacaaagctgattcacagtctgaaccagaagggccatggaaaacaagcagggagtgagttgtttgttctaaaagaacagacttgaaaactggagataatgtaataacaacaataatagtcatgatgcaagtaactacaattattcaattcctgctatgtattaagtaattctatatggtgtcttagctattattatcttctttaacctgaaaacaaccttcccagacaagccttctcatattgtctttacatgaggacatgcattgaggacactgggtcagagaatttgagcaacttgcccagtgttcaacagttagtgtttctgaacttaagcttggttcttccaaagccatggttttcactgtggctatgtcatctttcttacccaaattaagagtgaataaaggagagggtttgagagggcaccccattgggcagcttttctgcaaagtgaggtttcaatcacttttcagatccttaaatctgtctcagggcttaaaggacccttgaagggacttcactgtatagcagccacttggacatccgtccccacctcagctgaaaatcaatagtgcagaagaaatctccagttccaaggaagccctttccatgttgaacagccgtaactcagaaagtcattgatttcagtgaatgaattcagtttccctgttagtcccacccttgaataccctctgtgtcccatggagagacaatggattggtcacgtctcaattcccatcaactgggaagtctgggtgatggaggtgctgacccttgtcctctctccagtgttataaacaggagcatgagatacagaaccagcttaacggggggttaaatggcagctcttccaattactagctgtgtgaccttggaaaagctacttaagctcttcagttctcttatccataaaaatggaaataaaatttgctctgggcagctgttgtaagtattaaaaaataatatatgtaaagcaactgacataaaataatatatgtaaagctttggagtcagagaaacgtaagttccaatctattcatgtgacacatatcagtcccatgaacttggactaatgtaatttcccaaagcctccatttcctcatctgtaaagtaaatgttataatagtacctaccttgaagggttgttgtgaagattaaacgatacccaagggcagtgctccaggcatgttaacttcaataataaagttagaaatgactattactatcgcttagattccatatatatatatatatgttcctatgatccaaaatctttgcttcagccagtgtagacaattgaactcactgcaggaaatcaggcatctagtaggatgaccaactgagctagcactgagctgaaaacggtggcattgtggcactgtggcttgaggtctctgcccaaagtcatggcctaaagttccctcctgggtgctcattttatgtacccaccacttttgccctaactcatcattgctcagctttatagttggtagtgaaagaagaaagaaagaaagaaagaaagaaagaaagaaagaaagaaagaaagaaagaaagaaagaaagaaagaaagaaagaggaaaagagggagagaaagagatggagagaggaagggagggaaggaaaggaaaaaggatggaaagaaggagggaaggaaggaaggaaggaaggaaggaaggaaggaaggaagggagggagggagggagggagggagggagggagggagggagggagggagggagaaatagttggattaggaagaatgtgcccaaaatacacagtttagttattcttttgaaaattcagattgatgaataacaacttaaaattgtgggagaacctaattggttctcacattttatattactctacaatttacagaatgatatgacagtacttgaactaataggttcctctcagcaatagtgaaatcaaaaggattattgccctcattctagtgaagacactgaagttcagagagattgaacggttttcccagatcacacagcttcgaagaggcaaaatggaactagaactccagcctctggcacctgatccagtgtttttcccactgccccactgaagcacattcctagtataatctcttctatggtattagttacatcttagtttaaaagtgggcacaaggtagtctctcaccgggatctgagtatccaaatctggagtccaacctcttccaagttgatgtcacagggctgtccattctatctcatcctcgtaaattccagactgtcccccatttcaatcttgacccacgatttgtctttgacaacatagtcatctcagggactggcccagagagtcgtgccaggtggtatgatggagattgtgacccaggttacacacagggccgagtgacgggcaagcctataattgtatcccaccttcaatgacccttgccagtaccaggcaacgctgataaacaaatggcccatcccttggtaccttgccagggtaagctcacattctgggagtgtctaggggagtgttgggacacaagaattccaaagcaatgcgggaagctgaaaaggttatgttcataagccaggacctaactgggatttcaaatcatagctccttaattagcacattggtgccatttgagtaacctaaagtgaagtgggaaaaaataatttctcaatactgctttaaattccatcatatttccatgaccttcacaatggtcctgcccaggagatactattatcaacattttttacccgagttcaaggtcgagattagaatccatgtctctggattccgaatgcctttttatttatttatttacttattttttcagatggagtctcactctgtcgccaggctggagtgcagtggcgcaatctcagctcactgcaacttccacctcctgggttcaagtgattctcctgcctcagtctcctgagtagctgggactacaggtgcatgccaccacgcccagctgatttttgtatttttagtagagatggggtttcaccatgctggccaggatgttcttgatctcttgacctcatgatccattcgcctcggcctcagtcctgggattacaggcgtgagccaccatgcctggcctggattcaggatgctttaaaatatcctctaccttttggcctgtgagacatcttctgtttagcctccatggttacattcccatcttcagaaatggaactgagcatcattaatagagtacttacagatttatattttaaatttcaagtcctgatgatatatgtcagatatttatgatcgcttaaaaacaaccagtgctaggatacattagtttgtgaaggaggtattatctgtaatcctattctcattttgaaaagtatgcctaggcaatgaatccacacacacacacacacacacagatatatatgtatttttatcccccaagaggtatctctgtctcctattaacttgcaagacatgccaatgaaatctccactgcaaatctgaaatgagaaatttgacctaaggttgttttcattgaaaatttctatatcattaattttacaagtgtcgctgccatgttcctggaggaaatttattatatttctcctctattttgtatcatgctgaaactcaggatcaaaatgaacatgagcaaaattatgtgagtctattcttttctagaaaatgtaacatctttaatgagagaagaatggattgtataaaaagaagttggctaagaaaaatatccctaaatgcttacttttaaatacaccttggttataaatgagagggtccagcaatcttaaaaatctattccagccctgaaagtctgtagtttaaatggagtccaaaataaacaaatttgggctattttagaggctatttaggcctctacgcctttctgcttgctcttttctctgcatgacttcattagcattattccttcccacttttctgtatctggtgaactcctattcacccttcaaacccccatttgaatgtgatctcttctgtgaccctccaacagttcactgcctttatccccagactaaatgtggggagccagtccgtcatttgagtttctgtagcatgtctcacaagactcttctctggtacagagcattctgaatcttgtctatttttctcactacaacatgggcttctcaatgccaggggtcacaaactactcatttttataagttttcccccttttgtcactgagtacttagtgcagtacttgacacatgataggcaggtagtaaatgcagggtgaatgaatgaatgaacgaatgaatgtgagttttaattctaagtctttcaactcaaaatccattactctttctagtttcctaaacaacccgaactacagaaatagaaaaaccacatgcttccattttttaagaaattcttatttatttattttagaggcagggcctcactctgtcacttaggctgaagtagagtggtgtgatcatagctcattgaagcctagaactcctgagttcaagtgattctcctgcctcaacctgctgagtagctaggactgactacaggagcatgccaccacaccagggtaattttttggggggtggggtagagacaggggcctcactatgttgcccaggctggtctcaaactcctgggctagtgatcctcctgccttggcctcccaaagtcctgggattgtaagtgtgagccaccatgcccagcccaatgtttccttttttaaagttcttttctaaaattttactgaattagcagaagatcctacttctgtgagaggaaggataggatgttcctggctaacctcacagtttttctaagcaggaaaagctctttgggggaatatttagatagaaacattccttctagacctagtatcaggttcagtggtctgtttgctatttactttctgtttcttagcaaaaaactgcctttgttatgagactgtgagatacaatccggaccagttgacccaggagggcttagtgttaatcgccaactattataagaaggtgactggcttcccagaagggaaagtgaaggtcacaagcagccactcagaatggctggatagtgctccatgtcatgacacactaggcttcttagaaaccagaggatcccagtgaaaatgcagctcccctgggcagctgaatttcagaagtttcatttaacatcaatggcttattttagttctgctttgaggaaactgaaaacttggattcatactaaaaacatatgcagatgaggacaattattattactattttatttatttatttattttttgagacggagtctcgctctgttgcccaggctggagtgcagtggtacaatcttggttccctgcaacctccgcctcctgggttcaagtgattctctttcctcagcctctcaagcagctgggattacaggtgcccaccaccacacctggctaatttttgtttaggccgggcacggtggctcaagcctgtaattccagcactttggaaggccaaggcgggcagatcacttgaggtcaggagtttgagaccagcctggccaacatggtgaaaccccgtctctactaaaaatacagaggacaattatttttttaaataattttctttggttaatatctcttaaatgtaatcctgtggtgaggagacaatgacagtcctggggctgtggctattagcagctccttgtagctgaatgtctccaatggtgcaggaggacatgtcagcaccatggtctggctcctgttgagcactgtgaactctgtgggaccttcctgcacatcatgtcatttgattttctaaaggacactaaagcagcagggaaaagaataactgtataggtgggaaaacaggtataaagttaagctatgtagttcatcctgatatgaacagctggtagagggtagccctgaaagcagaaagcaagtttccaactactgacctagtgtagtgccaatatatcttatagcctaggtgattatattcttaaaaaggaatgtatggatatgaggaataacttggaataggagattttatatattattaatatgcttttctatcagcaagataagctaagattttgctacccaaaatgtagtccactgccagcagcatcaatattgcctggagtctgttagaaatgcagaatttcctgcctctccccagatctaccaaaccagaatctgcatttagcaaggtctaaggtgatttgagaagctcttagctagacaagaagaaaataccatcttcacagatgattcccagttctgatgggataattttttaaacttgagatgaaaaaaaaaacgatctttgtatatacttttatgtacatgaaattagcctattcattccttccgggagccctgtgagatacataggaatagatgttactgaaatttaacaggagaagaaactgagttcccaagtggtaaagtgattacccaaagccatctaagtgtctgagcttatttaatgactagcacacagtagctgtttgctaaatgaatgaataaatgaaacactaaaaaaaaattgggctggatcctggtcttcagaccactgcactcttagagattggttcactcctggggccacttcaatgtagggtatttgctttatgtccccttagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcagtgagttgggtggacaccctgggggcccctcagcatccggacagcatcacaaaattcacattgaatcacaaacactgtatgccagtggttctcatagtgtggtcctgggacaagcagcatcagcactacctgggaactggttagaaatttaactcttgggctccaccaagaaaagatggtgctctcctgaatacccttgcttcaactgcttgcccagctcagaggccattcattttcctgtagctcaacgtcagaacaagctagcctgtcactgctccctgtagggaaaactttgaccccatggcgacattgacaacatgtgacttggcagagaaaggaacccagcacttatctgaagccaggatggatttggctgtctatgttgccccttctggtcagctgtgactgaagccagctgtgactggtcttgtctgagagagaacctatgtcaggcaggggggcaacacatgccaactctgtatgtaagagtcagagagggaagcatttcagggcctgggcaccagtaactgcatgaaagaaatcctgaccattacccgccagacactgactcacacatgtcaaaaatagggagaaccttgagaccttgtggcttgaaccttgagaaccttgagaaccttgagaccttgtgagtctggtcctgcctgactcacgtgactttcgataagtcatttctcacatctaagcccgggtcatgtgcatctgcgatagagtcttatacatgaacctctacctttagactccatgtccagtgctctttgacatgactgcattctatactgtttcctggcagctagtcctgtttgggagaaaattggccttggttttaaaatggccacttaccttctctgcttctgtccaggaggtctggcttaagggctagctctgctggatatttggcgagccccctccccgactagtccccacagccatgccagcacccccatgcttcagcccggtagctgcaaggcatccatgcaattgaaaagaactccaagggctggactccatctgttggggcttttgtccaaagagagctagcattctttaaaaaacaggattaggaatattagaaagaattctagaattagagtacaagggattcgggtttgagtctgggctctgccatgtactcactgagattttgggcaggtcatttcaccatggtgaacctcaatttctccacttataaaacaaagatgattatacctactgcacaggttgttacaaggagaaaactggggggtcttgatatggaaatccagccttctaggcctgtattctcctttgatcaactttggtaactgcgtgggaacaggaaattgtagggaagctttccttagtagagggtgtcttgtctttcccaggtagcaggaagatgccctgttcaaaggagttatagtagaagagatttgagcattttttggtacatcccttttaaccctttgatatttcctgagaaccctttgatgggatgaggatttgagcagcatacatttcaggaacgatgggtagaagagccccagagaggagcacacttttctatattattaccacaagataatcacctgtccgtccgcaggcaactctgtagctgctggaaaaggcgttcagagacgcagggtctaccttacattgtgcccaggccagtgttcccctgacttctagataaatcttcacaattaaatctctagactaatcatgaaatctagaaagtaagtttgctgtccaaaagaaataaatataatgcagcaacatatgtaaatttaaatgttctagtaaccatagtttaaaaatggtacaaataaacagatgaaattaatcttaaaacattttatttaactcaatatatccaaaacattataatttcaatgtatacttcaatatacaaatgatcagtgggatattttacatgatttttgcgtttgtactgagtgtttgaaatctgatgtgcattttgtgcttacagcacagcatgtggctgtggccacagcactggacagcacagttctcctttgtctgttcacaaaagctcatcagaagccagggagtggctacagaattggccagggcaccttagggtataggcagtcttggagtgatgggaatgagcactggactaggagtcaaaagagctgaggtaagccgtggctctgcaacttactattgtataattgtgaacaactcactgatttacattgacacattcattcattcattcattcatgtactcaataaatgtttacagaggactaattctggcccaggccttgtgctaaattctcggaatattaagacaaaacaggcttgccctcaaggaactcagagtctagaccatcagcaaatatgcaagcagttgttgtggaggttggtaactgacagtaacaagaagggtagagacaagtgtatacaccttctatgtctcaatataaggcattctccccccaaattcatcttcataaaaaagatatgccttgtgtttaaagccttataaagtctctcctgctgtaagacattcttccaattattttatttactgatttaaacttttttttggtacagatattttttaacacatacaatgttgacagaatagtcaaataaagtcccagaataaactcccttgccccacactcatcagcccctggctaatcctacctcatctacaaccttatcttcttcctccactcccatattcaattactttatcttttaaaaaagataatatcatttgaagaaggcatattagcctgaaataacctcattcaatgctggattgcttatagggatcatttgatggaaatgtttttttaaaaggcaaatacatttaatgcacacatattattattcctggggatattatctccctattataagcactgagcatcactataaacaacctttaagaatcattgttgcaaagcaatgtagcaagtcattacatggtggaaattctatatcttttaaaaaatctgccctaatgctatgctaataggtccttcttgttgagatgcaatttctaggtgacaacctcctactcaggtataaaacagggctgcctctttaaacgtacagttagaagtgaaggtgagctgctcagaaaagctgggccagctgcccccagaaatgattctggtggtgagggagatgccgatgttgaagatgcaaagacagaattggagataattattccccaaatttatgtgggattagaaaaaagtaacctttccaaatcaatatattgttgatttatattactaaattaaaattataagtagatatttgacatttttatttatatctttaaaagtttccttttaaatttgcaaaataaatctttctataaatcctctctttggaaaaatgagggcttgattgccttatactggaggatactttacattaggtaatatacagtaaccagggggcttgagccaatagaagcctaaggagttaataaggcaggtctacccccttccccacctcctctgcttccagaatttgaccaaaattagcctcaatggcaattgtctgcttgaatatcacagtgtccttcaaaggctgtggtaagtacagaaagtgctcaatcctgattcttttatgattaagaaaaaagtaagtttctctcctgccttaacccaccccctgccaacgcgcgcgcccacaaacacacacacacacacacacacacacacacacacacacacttccctgatgtcatttgggaagactcagggatgcagtccttagcaggtctgagactatatatctcgttctaatgctagcttccacccttttccagctgggaaccactgaacccaattttgtcatctgtgagatcgggactgtcttggagtgcacaactcagggcagatactctggtcaggaatcaacattgtattcttggctcaggggcccctcatgctgggtctctggccccgagcatggcattgggagtgcaaagaaggggagaaggatttcaattccaatcccatgacccttccttttcctggcagtggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtgagttactgccctgctcccccttgcctgttaaagtctccaattatcaggacagttcatttcgttcccatagcaacgttttctggaagtgggagaatggactctattgttgacttgccaacaataggaatactcagtctgaccaagtttgaacaatgtgtcatctctccaaagactctctttaaattatttgccattctaaagggcaattacttttacaccatggctcttggtttgcatgtcaagagaaaacccaggatgtacagatgttccattgtttgacctttgcaaaactgcatggagtctcctttcttccccgttgagagtttctgtgtaaatcacacaaatatggcagggcagcaatggccattctttgtgtgcctgtcatgaaaagatttcttcccttggattgtaagatgacaaacgtccacatggcagggggagtgtgtctgcaaggatgggctgtgcctcagagtaaacaatcaatcatgatttttctgggggttccctggctgcctgttgccaatacagtgctagagttcccgccacattatcctagggaagctgggacatcactctggccacctccatccaccagtctggtcccctgggtccactttcttgataaccacattgacctccagcccagaattgaggaaagtctgatggccactggcctgacactactctctggccagctggcctccaggctgagctctgcactgcgactggccagaaaggcccagcccaaccaaggaagtgtcccatggagggcctcccccagagagcacttcagccatctgaggaatcagctgatcccttcaaaagagagtaagccacaggagagcatggaaacgtggagagatgtgtgattagtcatcttagagagaagacttctttttgttagtttgtcttattactcaatctcaaatggagactcttgttaaggaagaaaacataccactgcattctctgcctcacattgactgaagttcacttttcaacattagggcttcctagtgatgctgcacaaagagtaacaaggtctgaagacctaggatttcctcctagttccatcattcatgagctgcctggccttgggcagtcacgctctgatcctcactctcctccaaccagccctgcctaccttatagggttgtggtacagctcaagtgatataatatacaagcaaacaccaaaagataccaacacatgagaggctattattatgtctctattttggacattgttctcctgggacaggtgacccttggaggcaggacgacagcctggcttgtgataaggaatgcatcagctcatggactgtggttcatcaggaactgattagcacccattgtcaaaatcccaccttgctctgtaattttcacaactctctttagaaaggaaagaagtggccttgcaaatggtccagaaaaacacaaataagcacagtagtaataacaacacaacaacaacaataacacaagctaacataactagaacatttgctaagtgcttcacaacaaaaaggaaagctctaaacccattttagcaaacatttattagcccttactacatgccaggcgggcactgttctaagtgctttacaaatgtcgcctcatttaaccctctcaacaacgctatgagaaagacaccatcattatccccattttccagatgaggagtctgagacacacggaagtgaggtcactttctcaaggccacacagctcttctactctttgccaagggaaatctacgtttcattcattcgtctatttccaacaggtccccaaagccggcacgctcagttaccaccagcaacccttccaaattcactgcgaagtttggagagtccgagaagtgccctcgatgtggcaagtcagtctatgctgctgagaaggttatgggaggtggcaaggtaagaccttctgtatgagccagacagaatttgctcatctccaccaggccatttgggaggaatgagagaaaaattgggagctg

SEQ ID NO: 15019 - DNA, 57507 bp, Human
tatttatttatttatttttatttttattttagacggagtcttgctctgtcgcccaggctggagtacagtggcgcgatctcggcttactgcagcctctgcctcccgagttccagtgattcccctacctcagccccctgggtagctgggattacaggtgcatgccaccaagcccggctaatttttgtatttttagtagagacggggtttcaccatgttggccaggctggcctctaactcctgacctcgtgatctgcctgcctcggcctcccaaagtgctgggattacaggcatgagccactgcgcccggccatttatttttaatgtaaacatttttttgtagagatgagatcttgttatgttacccagtctggcctcaaactcttgggctcaagcactcttccagccttgactccccagagtgctgggattgcaagagtaagccaccagtgcctggctgaatatttaaatttaagatgcttcctgatgcagtggctcgcacctttgtttaaatgtctgccttctccatgaagcctacctgagtagtttatttgcattccagcccatgcttgatttttctccaaatactcaacaccttggaatatacaatactacctattttttacttttatgtatatttttgagacaggatttcgcttctggagtgcattggtgtgatcacagctcactgcagactggaactcctgggctcaagtgatgtcccttcctcagcctcctgagtagctgggactacaggtgcacacagccatgcccagtgaatttttacatttcttgtagagacaggttcttgttatgttgcctaggctggccttgaactcttgggctcaagccatcctcccgcctcagcttcccaaagtgctgggattacaggtgtgagcccctgtgcctgtctacatattttttaaaattttgagtgttgaggccaggcgcagtggctcatgcctgtaagcccagcactttgggaggccgaggtgggcggatcacctgaggtcgggagtttgagaccagcctgaccaacatggagaaaccccgtctctactaaaaatacaaaattagccaggagtggtggcacatgcctgtgatcccagctactcgggaggctgaggcaggagaatagcttgaacctgggaggcggaggttgcagtgagcccagatcacgccattgcactccagcctgggcaacaagagcgaaactccgtctcaaaaaaaaaaatttgtgtgttggttgggcgcggtggctcacgcctgtaattccagcactttgggaggctgaggcgggaggatcgcttgagctcaagagttcaagaccagcctggccaacatggtgaaaccccgtctctactaaaaaaatacaaaaattagccgggtgtggtggagcatgcctgtgttcccagctactcgggaggctgaggcaggagaattgcttgaatccgggaggcggaggttgcagtgagccgagatcgcgccactgcactccagcctgggagacagagcgagactccgtctcaaaaaataataaaaataaaagtagatttgtgtgtatgtggcttcctttactagaaggtagtttcatgaaagttgggatttttttctgtttttagtgcctgcgtaaaacatagtctggcacagaataggtgttcaataaatatttgttgaatttgtgtcgctgaatgggaacccggtgcagtgcattccaagcctgagctggttcaggtccgatggcggggcctgcccttatgaatcattcatgatctggccccgcccatacgcgaacgacgcgcgcgttcacgccggagagggggcgcggctcgcccccgggctgagtcgggcggccaggaagcgggactctgcgcaggcgccaagctccggagcgcggccttggtgccttttctggtttggcaggcgcgcgcgcgcgggagggcggcaacctcggcgctgtgcgcaggcgcggcgggcagtgcgcaggcgcgggcggagggcgggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaaggtgcgcggcccgcgggccggacgggctggaggggcttttctgagggggcccggggaggggtgggaggtcctgaaaggtaactggagcgtctgtgatgggaacgggggggtcccgagaaggaattggcgggtccgggaagggaattggagtcctgaggaggaatcgccgagctagaggaaggaattgggaatctgaaaagagaattggcggctgggtggggaatatgggagtcaaataaaaggaatcgggaaggctgatgaaggatttggagggtctgggcgtgccattaggggaaaccgaggagatgactgggcaggctgaaatggaactgggatccgaggcgggcttgaagggtcggagcatgggttgggggtgctgggaggagaatcaggggaggctgggaagggaatttctgggtctgggaagtgtgaggaggagcttgagtgtggaggggttggttatttggagagcagaaagatctgaaggagattggaattgggggagcctcaggttgggggagttataaaggggatgaagaatcaagtgtgaggatggagtggagattgtggggtctgaagacgggtgggaagactagggaggctgggaagatgaaaacaggggctaagggtagaattgagcatgaaaagacatgggcttagggtgtgaggagggtagaggtgccaggactgggggtctgaggagggtggggtgcggaaggaagaagttaaggggcccgtgaatcagacgtttttgaagggggtgagatttatttgtggtgccctgttccaaaggggagaagattaagagataggaggaataataagaggaattgatgagggatggagaagccgaagtagaggggatacggagagtggggataatttggggagggatttctaaagaattgatgggaagctgaaaagctaaagcgttggagagaatgaggaagtgtagagggagaaggtgagatcggtgggagggagggtgagctggaatggtggataatgggagagaggttcgtttaggaaaatgaaagtctcattagaaagggaatgcgtaatggatagactgagaaaggaatttgaggagggggtgctggctcctggaggtgcagtcccgggactggagagcgtgtgtgtgtcgtgcaggcagaatgagtttggggaggaagcgttgagagtgtccaggaagaattgtgtcttttttggagagaccggaggtaggtgaagggatcctgaagcagagactgtgttcaggtggcactgtttttttggggggcggggggggcaacttggtagggccccacagcagtgaaaaggtgatcagaagtggagtgggatccccgagcgaggtgtcagtgtctgtgggggggggataaatccagtgtggttgaggggggagctctgagtgtgtgcaggaagagctaaagaaaggagcgtggtgagtgggtgtgtgtggggggaaggggttgttcagaagttttgtgcgtgaaatgggtgggaggtacttgaagttggaagcatttcgtgggatctggagatctggattttctttccagatttgttactgattcgctctgtggccttggacaagacccttgaactctccgggcagttttgttatctgcaaaatgcaaagggatccgagggttccctgcggtgattctgttaataaagagggatgtgtgtagagttgggactttggacagggctctgaaggtttgggagagtgagtttggtggagatttttcaggaacaggctacagggctttgagtggtgacctggcagagtggggagtgactggaagcctctcgagggcgcgagttggtggccaggagcttggcacaggcagcctagcccaggctggaggggaaagggtgggaagggtggaaggagcagctgttccaaggcagcctgaggtggggccgggcataaccttgggtccattaccagcgttgcttgaatttcctcatccgtagtaactgaggggcatggcagtggcttggtgggaggggtgtccttatccgtggccccacctactgcaggatggacaggttgcgatagttggcataaattcactttttgaggggaaggtgagatctgttctggagtctcaacaataatttattgcctgaggcagtgccaggttggaaaaggttgccaagagacctggaaagttgggagggagcaggggccacagtggtggttttgagaatgtctaggctttgtcttctgcagctgaaggtgctggagaaaataaacccctcccccttttttctcaggtgataagggtggggggaccttccttttctctcccttcctgtcttctgccactcctcaagtgactccttttgcgagccgggtttcactccctcccgagagttagggtgtgggctttgttcgtggttatagtgtcccttgcctacagggtgaggctggggcaccattcaggccctgggtggaaaccaggactccccagaacctccaggccttgctgccatgtgtcattctcttacctcccagctcccttcctctggggccgggcaggtttgagggaaaagggtggctcacagagtccgctaataccatctgctttcgtgtctcagccagagccagattctagtacctcctgctttacacctcctccagcaaatatttacccttagctgctctgtgggggaaactactgcttcacctctgtgccctttcctgttatggggtagggattctttttgaaatgggggaaggagtaatggaaaggaatacaccaatctgtgtggctctctaccttcctactaagaaacatccctgcactcccaggctggctgggttgtttgtttgtttgtttgtttgtttttggagacggagttttgctcttgttgcccgggcgtgatcttggctcaccgcaacctccgtctcccgggttcaagcgattctcctgcctcagcctcccgagtagctgggaatacgggcatgcgccaccacgcctggctttttgtatttttagtagagacggggtttctccatgttggtcgggctggtctcaaactcccgaccccaggagatccgcccgcctcggtctcccaaagtgctgggattacaggagtgagccactgcacccagactggctgggttttttctacattgcagtgttgctttagtgaatgacagattgcccttcttgcctctccaaggctgagccactgggcacgggaagaatgacagtcctgggggttctgtacatgcatactccaaaaaaatatgcatccagaacagctgtaggccctcaaagtgggtagaattgaattcttctaggaattaagcaagagttggcccaaatcagaggggacgtgtgtctcacttctgcttggaagccctttgctctgacttctagggacccctgtaacccgtaagtaggttatgcaacggtttttacatgagagggccatgagtgttctcctggcgggatggagaagcattgttctggtctttgagcaaattcttgagcaattacagttctgggccacagttccctctcccaatttctaaaagtggcctgggtaacctcatcaccctctgttgtcctggaagggtgagatctcttgaaggttatgccaaatctcattacagcaagaagaaatgactcacttgctaagttttcgtgttcattgaaacatcactatttcaggggcctcaatgtttcaaccctgaccgttggctttttttttggagacggagttttgctcttgttgcccatgtggctgtattaggtatgagttaactatttgaaagtttttgtttgttttttgtatttgttttttttgttttgttttgttttgttttttttgagacagagcctcactctgtcaccaggctggagtgcagtggtgtgatcttggctcaccacaacctcttccaggttcaaggaattctcctgcctcagcctcctgagtagctgggactacaggcgtgtgctaccgtgcctggctaatttttgtgtttttagtagagacagagagtttcaccatgttggccaggctggtctgaaactcctgaccccaagtgatccgcctgcctcggcctcccaaagtgctgggattacaggcgtgagccactgtgccctgccttgtttttcttgaagtagatctttttttctttttaaaggctgataatggaggccccaaagtagccatctgttactttgttccattactctaattgcttgcctcttaggatctggctaggactaacagttttcaaaattgagtaacacacttgacaaaaaaaaaggaaccaaactcaaactcaactgttatctagaaaaaagactgtgtaaatatgtgtgagaggcaagtatactctgtttgccctcttgtaagagggataggggaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaagaccaacagggaggctactttggtggcagggagctgactcaccctccagttggaactggtgctaaaagcctccatttaacggcagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctcaaaaaaaaaaaaaaaaatcagatgacagaggggagcggggacaagttttaagtctaagcctcctgggtggggagttctgctgtttcaacatatgctccagtcatggcagactttggccagacagcgccctttttcagagtgaactgagtgtagcacaagttatctgccagtgctagttagcaaacagaatggagccaaaaaagaattgatttgggaaggcccaaggaatttgaaaccgttgagatgaacactttccgtttttgctacactgatttatgttgtgctgggaattgtacaagcctttgaccagaccttagggttgttctttaaaaaaaaaaaaaaaagattcccttgctgctgcttttacttttttgaagggcagaagggaagggcaaatataattagtgaacagctgtttgctctagtatcacttgctcgttcaggttttctgaatagctgaaatatcaacatgtttatctcttcccttgccttagtatatcctagagcagtgttttccccggctttatctttattccttcatttaatgaactccgtgttttcatcactcacattttgttcccttccctcagtttccttcctttgccttcatttatgtatttagtttacagaataacaaaagcactcgtgttacttttaaacaaggtaaaacttaaacagttttttcctccgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcacaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcgaacatggtgaaaccccatctctactaaaatgcaaaaaattagccgggcacggtggtgcacccctgtaatcccagctactggggaggctgaggcaggataatcactcaaacctggaaggtggaggttgcagtcagctgagatcacgccactgcactccagcctggacgacagagtaaggctccgtctcaaaaaaaaaaaaaaaagaaaaagaaaaggagttaaatctttgcatatatttaactggcaagagcatccttacatcagtgcatgggaagttttatccaagtagcagtttccctgggattataaaaatccccgaggcatttgtcttggtgttgtgcctttttttggttgtgttttttcacgtccctcccctcccctttctccataaacaagagaggcattaacttggaatgtccgtggaaagtcttagaagctgattggtgtaatttgcctgccttccctttagtttgaacagcgtttactctggaagaggtcagtggcctttttcttggttgtgatttatgcaagtgttatctgaaggcgagtggagtgagtttacgtgggatttgctgtttgccacctgttgttgtgctggctccttccttcctgggatgagttccattctctccccctcccccaggagtgaggctccccagccagagcagtccccctgtgcttatccccttccttcgtaaactgcagccatttgtgattttccataaccacttttatagacacataataatttcctttgaatcagtttgcattttaaattaagttttgaaaggaaaactgacaagagtatggcaactggaaaacccagctcccctggccataaatataatagaaggaaactgcaaaaataaacacattgaaaacaaaacagtgttgtttccaggtggttaccactcgggctgaaggccccccaggcttgaggcctgctccctttgttagaaagggattggcaagtgttggtgaggtgttaaagacccaccagcaccaagcagagactttctctttgaagtcatcaggtttacaagagaatcaaaggaaataactttctcaatgtgattcagggtgtaatgtaaggtgtagataacccttaaaattttccatgtgtgtatgtcacacttgggaaaaaaacttgatctcatctggtcgaggtgggcagggcagcaccttgtccaggagcacacagcccctcttggctctgtgtgtcatccggccatactagactcgaacatatggctcatgactggatgatgcttgattcatcttcagtttcaagtgttagtgcttttgaggttttgtaagaaaccaggacacattgaaaatacagtcatttctcagtatctgtgggggattggttccaggaacccccttatataccaaaatccacagatgctcaagttccttatgtaagataaaacgatgtgtaatttgcattttaactatgcacatcctcctgaatactttaaatcatctctagattacttataacctaatgctaaatgctacgtaaatggttgttacactgtgctgtttaggaaataatgacaaaaatatgtacatgttcagtgcagatgcaaccattcattttttttcttccagtattttcgatccattgttggttgaattcacagatagagaacccatggatacagagggctagctgtaagaaatgtgggtttatcatttgttcctcacacaacttttttctttcttcgtttttcttgcctttgttccttttttttgagacagggtgtcactctttttaccaaggctggagtgcagtggaacaatcttggctcactgaagctttgacctcgggctcaagccatccccccacctcagcttcccaagtagctgggactagaggtgcacaccaccacgcctgactgatttttgtgtttttgtagagatggggttttgctgtgttgcccagtctggtctcagcctcccaaagtcttgggattacaggtgtgagtcaccacgcccagccaactttttctcttaaggctccagttttcttcttagagttgggcccctcccacgaagaaagcacactgccaccccttcatcggatttgaaccctacattttgaaaggaaagcagtgccctcctgctgagttaacaaggcttatttaaatgtttttcttccaaatatcagagcagaacagattctttgtcttccagtggaactatccacatggggcagaagtagttggaagcggcagttactaccctgcagaacacaatgaagtcatcttgggaaatatcgtggatggtgttgcaatgattgaatgggatgctagaacaccagcaatacaatagcatttgtgtcttcagcttcaggcaggaataaagaagactttgtggtttgttttatgttttttaaagtttcccccccaaaggtgtggggctgagtgatgtctgtcactagctttctagtgggtttttcttttcatcttttcccctccctgatgtcttttgagagtgggtggaagccacagtctaggtggatcagaggaagcacagaaggcaggcagtataccccactttgtgttttccatgtctgaagggaacacatttggtttttgttctgttttgattttttagagacagggtttcactgtcacccaggctggagtgcagtggcctaatcataactcactgcagccttgaactcttgggctcaagggatctttcagcctcagcctccctagtagctgggattatgtgtgcaccaccatggccagctaattttaattttttttttttttgagatggagtctcactctgtcacccaggctggagtgcagtagcacgatctcagctcactgcaacctctgcctccccggttcaagtgattctcctgcctcagcttcccaagtagctgggattacaggcgcgcgccacgacgcccagctaatttttgtatttttagtagagacagggtttcaccatgttggccaggctggtcttgagctcctgaccttaagcgatccacccaccttggcccaacaaagtgctggggttacaggcatgagccactgtgcccgaactaatttttaaattttttgtaaagactgggtctcactatgttgcccaggcttttaatctgcaaaaagcccaagataaagagttttaatatcttacctcctgagtagtaatgactgattccagttctaataatgtcttaattacagctatacagattgaggggactgcaggaagtgaaatagatgcatttcttttttctttctttcttttccttttttaaatacacacttcgtttcggtggtgaaggccagtttgaggttaggagaggcatcttggaaggaagctcgcaggtggttcggcatctggacatgctgggaagttgcctgagggggacgtcacaataagaggactgtgggtctacagcctgccttagcaaaatgacaggccttcttttaccaaggccaagggcagtggtggaagctgacttcagttggtgtcatcaaggcctcagtatgtgtaacggttaacaaattactattctatgatcaatctccatctgggtgtgagtaaaaggtatttagttgctatcaccatggaaaccaagttgcttacttactgttttggggagtgccctcataccagaggcagtgctaatggtggagtgttaggccccgggcagaaaaaaagatcctgccacttggtatcacaggaaaatacctacaggcacagcagccttgccaggtaggggatgaaggccctctgtcctcggggcaggagttgggccagttgattgtgttgatgaggagtgtgcatttgtgcatgagagagggagaagaaaaaggagagcactccatgaaatccgctgctggctttgtagcctagaagagtgctttttttctctaggagtttggaactggaatctcagctatgtgacttcttaataataggacaaaatatgcctgtatcttttgcctacttccacaaacactgataaattaaaaagaactctaaatttcccacaaatcccaagcacaagtaactttttttttaaatccacatcctccctaatccaaatctaacagcaaatccttttctctctgtcactccctgcttttctttaagaaaatgagtaccttgccttaaactatatattggatgaaaatattaaacactttcacaaagtgcttctttggctgttactggtatgccttgcatttggaagggtcagagatttgaagacttctgtgatcttccagttctggcctatgaaatacagtcagtttcaaaattcaaaatgtctggaagagccaacttgccaggccggttcaagggcagtcagatgaatcgacccttcttacaggctgtctacgaaccagtcatgattcagatattcaagtcctggaaggtatccagacggtaaacatcaccaggattgtgaggcagttacttttttttttggatcgtttgagctacactgccaagactgtggtaggacttgtctgtgtaaaacagaaagggctgtctctaaatgtctttttcaagaatgtcggctataatcacccgacactgtgtctcatggtggggtgagatgaaatacctagaccggttaggggagggccttcttggccattttttgaactaattttccctttccctttgtaacttttttttcttcttttcttttctttttttttttttgagacggagtcttactctgtcacccaggctggagtgtagtggtgcaatctcggctcattgcaacctccgcatcctgggttcaagtgattctcctgccttaggctcccgagtagctgggactacaggcatgcattccacgcccagctagttttggtattttttaggagagacggagtttcaccatgttggccaggctggtcttgaacccttgacctcgtaatgcccacctaggcctcccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctaccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattggttgtggctaccaaggaaatcagatgatcaaatgcaaaacttcctccatcttatttctatatgatcttttttttttttttttgagttggagtcttgctctgttgcccaggctggagtgcagtggcaggatctcagctcactgcagcctctgtctcccagattcaagctattattctcctgcctcagccttccaaatagctgggactacaggcgtggccatcatgtccggctaatttttgtatttttagtagagacagggttttgccatgttggccaggctggtctccaactcctgacctcaggtcatccacccgctttggcctcccagagtgctgggattacaggcatgggccaccgcccccagccttatttctacacgttcttgatctatcacaggctggtgggggagacagcatgcatatagataatgaacaaggtaacttcagataggattatgtgcaataaattaaataacagctagcattttaccttgtgctagacactattctaagtgcttcccatggactgactggtttttgtttttttttctttcctttgagactgagtttcgctcttgttgcccaggctggagtgcaatggcgtgttcttggctcactgcaacctccgtctcctgggttcaagcaattctcctgcctcagcctcccgagtagctgggattacaggcacgtgccaccatgcctggctaatttttgtatttttagtagagacggggtttctccttgttggtcaggctggccttgaactcccaacctcaggtgacccacccgcctcagccaccccaagtgctgggattacaggcgcgagccaccatgcccgacccatggactcacttgtataatcttgtgaagcaggtgttgttacccttacatgcagaaatggatccatgggcctttaagccacttgcccctgtgacagtgccaggatttgaatgtagaagttgaggctttcaagtttatgctgttatttctacactacactgaagtctagtgattgggaatggctttgcgagcgggtggtgaggggaggagtgtgcagtgcaggtacttcagatggagaggaaggtctcaaagaggtggcatttcagctgttccttaacggatgagaaagagagaaccaagagagcaccagaggaacgcgcttccaacagagaaaaccaagcaagggggcccccgaggagcagaaaggcccgagtggtcagagcggagcccgtggaagagatgggcacagccagattgcttagagctgtgttgttagaagtgctgatgagtctacattcaacttgcgcctgcaaactcagtccctcttagatgccagtaggtcaggaacctcatgcttccaggactctggcgctcctaccctttcctcccaggcctcctggacaggccaaaccagaactgacttctaaagtgggaaccccaagacggcagaacatgaatcagccaaacaaaagctgcagttatctctgtgatgatttcggcagtcggcacgtgtatttgattaaagcgttggtaactttgaatctggagttttatggcactgtgtactactcataatggctttgtagtgtggctctcttagggagcttaacttttacaacatgaacaagttccagcctcctttggtcccatcaagaggccatttctacctggtgggatgccacttgctttacaaagcatcttttgtaaaatgttgagtctccttctttgaagttggaagccaggaagcctgattttttttccaataagtattgtagaagatggcagcctgatttatttttatttatttatttattttgagacggagtctcactctgttgcccaggctggagtgcagtggcacaatctcggctcactgcaagctccacctcccaggttcacgccattctcctgcctcagcctcccgagtagctgggactacaggcgcccgccaccatgcccggctaattttttgtattttttgtagagacggggtttcaccgtgttaaccaggatggtcttgatctcctgacctcgtgatccgcccgcctcggcttcccaaagtgctgggattacaggcgtgagccaccgcgcccggcctggcagcctgatttttaaactggcttttctcctaggtcctttccttctctataaatccctctttcacttagtatttcctccttgtttcctttggtcagttggagtgagggtggttctagttcagagaaagagacaggcatacaggctgattcagtctgaggtgcttagctttctgtacctcactggaaaccagtccaggaatatgacaggtttcagtaggtttcattggacccacaactccccatttgaaggcagagcttgtcaaacgagttatgtggcttttactcaaggagggaggaacagcaacagggagctctgggctattgatagacactcctgcctctgaacacacagcacccagcaagaagttaccttcatgggttgtctagagtgaacatgggctgggattctctcagccttagcactgatgatttgacaacaaaaatcgccccgtgggtagagtataacggagcaaatgattatggtggcctgtgatggtgcagccagcccagctgcttcagctggaaagaagatggcgaggtttccattctcctggcagcatagccatgtgaacttgttaaatcttttaagtagctgtataggaggggagataagtgtgtgtgtgtttattcttatccccttaaatacaaaaacaaaacttccactttataaaatcaattcagagtgggaagaggtgcatggcacatggaaaatgtgtcggattaggttgagtcctaccccacgtttgggacacagctgtaagtttccatggtgggtggcttattatgcatttatgctgagctgaacctgctccaagctgctgcagataggaaagtctgtcttggagggggagctgcctctttctatcacactataaagacataaaaggtcctttgaaagactccagcagtcaccacttgggtaacagaattaggggctgctgagcaaagtgggtctgtttttttttttttttaaagacagagtttccctcttgttgttcaggagtggagtgcaatgtcacaatcttggctcactgcaacttccgcctcctgggttcaagtgattcttctgcttcagcctcccaagtagctgggattacaggtgccggccaccacgcctagctagttttttgtatttttagtagagacggggtttcatcatgttggccgggctggttgtgaactgctgacctcaggtgatccacccgcctcagcctcccaaagtgctgggattacgggtgtgagccactgcgcccggccacattttatagccaaccggcttcttgtgtaacatgagttggggcttcttgggccccagagtccagcactcaggtagaaatatgaccgccatggccagacagcagccctcgctgggcccctcttcagagcagagctctgtgccgagcctttaggggtatgagagaaaccggagacctggtccgtgctctcaaagagctcgcggtgtagctggggagagagcaaggccacatgagacctcagaaggacactaaacggcacaccgacaagctcacagcactctagctgtgtcccgggagaggaaaggggtgaatcagggcaggtggggtcagtcatggaaactttcataaaggaggtgagtgtgcaggaggggcgggcctttgcccccgctgcgggcaggttgccgagggcaagtattagggggtccggcgtgcaatcgaacatttcttagctgcctctttggagtagcgctaccagttcctgtccccatgagcatcgtcttcggggagctgctggtttgaaggatgaggtaccatgctcatcttggccatgtcttagaacctgtgatagccagacctgtcgttctgggtccgtatccattcatgcgtcctgtcactgtcacagatatcgtgagtgggccagactcttctccccaggtgggagggggtgccttctgaggcatatgttttcagcctgctgatggcctcttcagaattagcacaggtttcgacaaaaagaatggagagactcccttctcatgtccaagggtctccccaagccctgtgtctcagcccctcagggcgtgtggtgctgcacactgccgcccagatgaccacgcgcagccggaacggccgccctgtattgagaagtgggatcggctcccagtctgctggcgaggctgggttgccacagctcctctgttgccctgcaacgcgggtggcctaggagtgtgctgccttcagtttattcctgcctgccaagctacgcttccaggtgctattcttttctttaaataactgccttagtgctgcttgtggaacttagcgttcccatcccaggaaatactccagtgttgtgtttttttttttaaactcattcagatgctcatggccaaatgtgtgacttaaataccgcagtgtccttgatattgccttccccacaccgacaaaccgagttgcattctggtcccactgtgggataaggttagggtagcggcgcttgcctctttgtgtggtttcagatgtgtttctccccacttcagataacacatgacagctgtaatatagctcagttcgtgcaagtaaggtaggggcagaaatcatccaggagaactccagcctccatcctaaaggattagactgcctagcatcagtaggtttaccatagaaggattcagtggagatagcgagggtggtgagtgttgctggattgagcccgtccctgcagcctgggcacgggagcactgcagtgccatgaaggagagggctgggggatattagcacagccggttcctatttccttttccacctggttaagacttccggggaggccctgcccagcagtccttatgagatgctgccttcctcttttttgaaaggcatagatgataaggaggtggacatgttttgagaagagaacctagagctcattacttgtatttgaggcatgtattgcttcactcccactttgggagagttttttctggggaagttaaaggctattcaggatcagagagtttcctgcatggtcccaggggctgggaggagccacctgctcagctggtggttagctgatagcacccagcctacccaccaagataggaggcagctcagatgtcactgggattcgcagtaccacaggctgtccctgggcccaagcagttagctagctgcaccccgggagggggtgttgagagcactgaagctcctgtgggagagtgcctttgacatcccccactccccactgcccagaactaggaggtagtgaaaggtgtcagtggcaagaaggctgggccagagcatggagggaggccgacctgggctccacacccacctcctccaccaccggctggctgtgcgaccctgggcaggtggcgggggttaagcctcagtgtccttctttgaaaaggggcatcatcctatcctcagtttgaggattagacgtgatagtgcgcaggaagcactctggtgcctggtacattgtaagtgctcaataaatgcagcttcccaaaatgatttcaatggcacatggtcctgcatccaggtgggatctgctacttgagtctccccctcaaaggggcctgctgaaatacgcagctcagtgggaaaccaaaacatacacccctttcctccagtgctccccaggaagcgccaagtcctgagcccagccagcaacttcgaagaagtgccctccaacaagtggcagtgggcacttgagcaagtgacttaacgcagccctctccccagcccctgcatccatctgggcctcattatctgggaggtggcttcttgtttcagagttacaggccctgaacaattttgtgttgggatgtgccataggcagtgccaggaaggttctttcatgagtaatttaacttgttactaagtttgctatcagccggggggctctttccccgggttcccttctttccctgggtccccttccccgcaaagcaaagtccaactcaagttagaaacatcccacagcctggagtcaggctgccctctcttcagttggtgtgtgatgtagaagcaggaagggcttcccactgataaccctaaaaataactgcccagaaatgctgtcagatggggccaagaggtgcacaggagcctgtgcccagctgccgacctggaacgtgggactttctagagggcttggaggagccctgccccttccaggcctcttcccaacagtgcttctcacgcctgctgctccattcccttttcctccttcctcccgcgcccccccctttcctggggtcacttcctgatgccattcttcaacttcgcccctgtcccccccaaaagcaatcaaatccacaacctaataaggcaaaagaatgaggagaatgtccgcctcccagcctctcccctaacagggtgcaggcctgaagcaaatttggaaaatgttacaacggagtgacaaccgatgggggctgggggtggggcggtgcagccttgttcaggagctgcccattgttggcctgaggcaggaccctaagggaaggccacccggtttgcgctttcctgatcaggctgttgacacccttctagcacaagaaaatgtatggaaagtaactgcctgagtcagctgcatctccagttgtgggatccacgtgccaggagaacacgaagtacacacaggtccgcagtgggagcccgctcggagacacctccccgccatcacggctgggactgtgcatatccaaacacttcttgcctctgagatgagcagttttcttccccttgactgtgccagggttcaattagcctgggcattaattaaaacttgtcaacacttagagtggggcccccagaaatctgtcacccctcctagatcattatcccaggctaatcaaccctctctaaggcagtttccattcttgacttagtgggagggaggaacaagcccctcggtgctggggagctctgggggaggtagggactgactgggcccaacccactttgttttggaaggtcaagcttagtaattaacctgaatgcttgggggagggggtgaaggagaaagaactgagtctagggatgtgccaggtctttcaaattgctaattatcagcgagcatgaggtcatccgtaaatatatctaattctttagcttgtaattaaggtgctcattaaaagtgcagggaagtcttgttttcctaaaaggggaaaaaaacaacaacacaaaaagtctttgttttgacctgacacgatggctcagaacagggggaggactcaaggcacaggactagtttcctgccttaaagagcctttacaggaaattgactgcaaacagtattggtgaccctgccaaggaggcaaacctagggtgatgtcattgttcgaagctgtcaccgccaagcctctggccttggggcgaggagagttggtgggattaaaaaatgagtgtgtgtatgtgtgtgtgtgtttagcagtctctaaagaggcgagtcaagggaaaatcctagcgggagaaaaatcacaaggggtggggggtgtctcagaaatattcttagctgggttcaactttcctcgtttttctaagtttaaaaaatcctctcttactatttttgctcatcaaaatgctgctgctttttcagagacagccttttttgagccattccctatttagtgttttgggtaattggctgttacagtatggaatttgtggcccaaaggcagcgtggtaagttagacactaggtgcacggtgccccattgttatgaagtgtggaaactgagacgctggactagtctgatgtatctgtttcttccaccaaaaaaaaaaaaaaaccattttggagaactacccaatgccagtgacttggcatctctgagtcgctaatcttcccatgtgcctccaggaaccgtctggagcgtccctgaaaaaaggacaaggtttgtatcttgtcatttttcctctggctggaagtctaagaggtataaacacagtcttaaaatgaaagcaacaaaaataaactcaaagcagccctgcgtgaaggcattaatgcaaaatatgcaagctggcttcctatttatacggcggaaggcagtcagaagagccaggcctggttaaggaaggagttatgtctctggaggtgcctgttccttagaattacaaataaaccctgggtgattactcagatgaggttgtaatgtggtgtctcatttcatgctttgcacagtccagtttcttgatggaaccaacggcctctgaaatgctaatgcaggatcaggatacagttagagtgccccccttcctgtgcccctcctaacatcctaacagctttagaaggaagtttgaagattaaacaggagagccatgtaagtttcctgtgatcctagatcctgtgatttgttaatattctttctcttcaatccacctgacatttacccagataccatattaggcttggagatacaacaagaaagaaaaccaacccaaccctgtccttaaagaaaagatggacgatgaagggccaggcgcagtggctcactcctgtaatcccagcactttgggaggccaaggcgcacagatcacgaggtcgggagtttgagaccatcctggccaacatggtgataccccgtctctactaaaatacaaaacattagctgggcatggtggtgcgcgcctgtagtcccagctactcaggaggctgaggcaggggaattgcttgaacctgagaggcggaggttgcagtgagccgaggtcgtgccactgcactccagcctggcaagagagtgagactccatcgcaaaaaaagaaaaaagaaaaaaagaaaagatggacaatgaattgcatgatggaagtgaacagtgttagggcgatatgcagatgtaaatgtggtcttgttttactgctcactgacttactgaagtaaacccattgacttcgccttcatgggtttgaaaagggtttttccaatgtgctctgtgtgtctcggagctcaggtgttcagagctgcctcccttataaatcgacctccaggagagttgtgtgtttggttcttggtgtatggtttcgtaggctccccagggctgaggagtcaccttgggatccagctttttttcttttttcgagacagtctctccctgtcgcccaggctgaaatgcagtggtatgcacttggctcactgcaacctctgtctcctgggttcaagcgattctcctacctcagcctcccaactagctgggattacagacgcctgccaccgtgcccagctaatttttgtatttttagtagagacggggtttcaccatgttggccagattggtctcgaattcctgacctcaggtgatccactgccttggcctcccaaagtgctgggattacaggcgtgagtcaccgcgcccagccaaaatccagctttttcttagttcctggcttggggcatgttgctggaaaggaatgacagattgaggcaagaaggaggcaagaaggatgcatctcctggccaaggaaactagagtttggaggtgtcccctgtcaatggcatctgaagaatttctacattggaaaggcataggtgacccagtctggtttggagtagatgggactgggtaggggactagtcttgaagctgcaagcatgctgtttttacttagagcacaggtagctggggaggagatcactgtggtgtgggtggcagaagccatccctagccatcacctaggaagatggtggcccttgggttgcccgagctgctgcttgttttagtagctgcatttggtgccacatttttgtggtaactgccaggaagcggagcccagcgtggcctcaggaagttggtgaggtttgcaccactttttaacaggctggtaacagtgccggagctgacaccctcatggttgcagccctgggattttgttatttggggacactttggaatatgtcactcagaatgctggctcactagctccacaagcaaaagactccttgggtagctggaagcaagcgttgggggaaggagggagaggcaattgcagtccagccaagaatctcaaggctcagtcttcaatgtatggaaacttcagtccttttctgatctttagtggaaatagctgttcactcttagcgccaattggaaagtgttggcagctgaagggggtcgttcctcaggggtccccagagccagtgtatctggtatttctaacattttcctagccacccctttctcctccatatgcccctcccagccccaccattcagatagggtggctggaaagaacatctcctaggtcctctaggaaacttggtgtttccactcaagggagttggggatcacgtaacaccctccacttccacctgggatttcaggccatctgtgggagtgcaagagcatggtggggtggaggtcacaggaaggtggaagcaaagccagggcagctccacatgcagccccctttcaggaacagcaaggataggccggcctgtatcttgttgctcagagcaggtgatcctgtcatttggacccttgtgaggagaatggatgtgagtgtgcacctggttctcttctcctggggctgagggactgtggtcttggattatcacatggtaggtgaggtgacaaaatggagggaagtagcctgggtggggactggggtggccactgcagagctctagctgatggtggccaggtgggaatggggacctgggacttcacgaagctggaaatggagagttttatggggcatttcattcaacttaaaaacctggccgggtacagtggctcacgcctgtaatcccagcactttgggaggctgaggagggtggatcacgaggtcaggagattgagaccatcctggccaacatggtgaaaccccatctctactaaaaatacaaaaattagctgagcgtggtggcttgtgcttgtaatcccagctactcgggaggctgaggcaggagaatcccttgaaccagggcgtcggaggttgcagtgagctgagatgtcgccattgcactccagcctggtgacagagcaatactccaacttaaaaaaaaaaaaaaaaacctgcaggccatacaaaatagggcctattgggtgtgaagagctacccatttgtgacccctaaccttgcatggtcttgaccctgtctctgcctctcctctagtctcccctttcctcttgtctgaattgctgctgcttaatcctctcactaggagcgagaaaattgtactttgccccttagtgacagctctgataaaaggtggttgaagtggatggtagtaaaaagggtttgctttagctgtggttttccagcctccggactcctccccctttcccatcaccatagataattaagagttgactcctcaaaattcctcccaccatattgcatatttttaggcttcaggtttttgtgaaccaaaatagtggaaagtttttttgtttgtttgttttgggtagcccaaagcaacacttttctacagaggcagccattctgcacgcacaataacctggtgaacaatgccagctttctattaataaatgaactgccagttcagaatttgtacccatgtggcagatggacagaaatagtttctttaggattgatctcttaaatttgactttgggaagatactggcagtccaggttttgtgacagagatccatcctgagatctttgtaaatggaaaagcctgaatgcagcgtttcttattgataggagagttgatggatttcaggaaaatgggatatagtagatgtgcaatgaatttgttgacttggaaacaaatttggacacttatccctgaaaacttcaggccattttttcctaaactctaattgagtccctgtgattggagtactagccccacagtccttatcaaacttcgcatttggagcaggcagtctgtctgggaaaagccaggaagctcgccatgaaggcatcgccctctgcttttaacttttttaggctctgttacctctgcactggcttgagtatttcctggctcaattgtttctcaggctggccttgagtccttagatgttatttgtgtgcctagaaatagctggaagaaaaatggttgtaatgctttgcattgctcactgctctccatggatggaaattctgtgagggaaagagggctttccacccagaaaaagagctgggcagcgtagacttcattgtcctgctggcctgtcatgttattctgctatactacagcgattaggatgagagagtttctcgctctccctgggtgtgccacctaaggtacattagggtagggacgaacatggcgggagttctcatagtgggctttcctgccagacgtatggcccacacagcagtatttcttacatgtggttcttttttttttttttttttttgagacggagtctttctctgtcgcctaggctggagtacagtggcgtgatatcggcttactgcaacctccacctcccaggttcaagcaattctcctgcctcagcctcctgagtagctgggaccacagatgcatgccaccacacctggctaatttttgtatttttagtagagacgtggtttctccatgttggccaggctggtcttgaactcctgacctcaagtgacccactcgccttggcttcccaaagtgttgggattacaggtgtgagctaccacaccctgccaaggttctattatttgatctatgttctttgtttgtttgtttgtttgttttgagatggagtttcgctcttgttgcccaggctggagtgtaatggcacgatctcggctcaccgcaacctctgtctcccgggttcaagcaattctcctgcctcagcctcctgagtagctgggataacaggcatgtgccaccacacccggctaattttgtatttttagtagagacggggtttctccatgttggtcaggctggtctcaaactcctgaactcaagtgatccacctgccttggcctcccaaagtgttgggattacaggcgtgagccaccatgcccggcccctgtaaccatttttaagtgattgatcatctcagcatgattgatggagatgatggggttggccatccattcttttttttttttttttttggagacagtctcactctgtctccaaggctggagtgcagtggcacaatcttggctcactacaacctctgcctcctgggttcaagcgattcttctgcctcagcttcccaattagctgagattacatgcatgcaccaccatgcctggccagtttttgtgtttttaatagagacagggttttatcatgttggccaggctggtctcaagcccctgacctcaggtgatccccccacctcagcctcccaaagtgctaggattacaggcatgagccaccacacccggcctattcatcatttattgagcatttatttatacccactatgtgccgtaaacaaggtgctgagtaatgagatgtgaacagaatagtccttcttcttgtcctcatggagcacacagcctagtcggggacaataggcattaaaaaataccaacaatgaaaacccaagacatacatagagtgttccaaattgtggttttattttttatatatatatattcatatatatttatatatatttatatatatattcatatatatttatatatatgaatatatatttatatatatgaatatatatttatatatatgaatatatatttatatatattcatatatacttatatatatttatatatacttatatatatttatatatattcatatatatttatatatattcatatatattcatttatatttatatatattcatatatatttatatatatttatatatttatatatattatatatatttatatatttatatatattatatatatttatatatttatatatttatatatacttatatatatttatatatttatatatatttttatatatatatatttatatatgtataattttttttttttttttttttgtgatggagtctctatcacccaggctggagtgcagtagcgtgatctcagctcactgcaacctctgcctcccaggttcaagcaattctctgcctcagcctcctgagtagctgggattacaggtgcctgccaccacgtccggctaatttttgtatttttagtagagatgggatttcaccatcttggccaggctggtcttgaactcctgaccttgtgatctacccgcctcggcctcccaaagtgctgggattacaggcgtgagccactgcgcccggtgtgattatttttatgaaggaaaagaccagagtcctttaagaggggacagtgggggacttgcaatagattgtgtgggagctgtcaggggagactttccaagatgatgacagtgaagtgaggcctggagggagagttagagccaacctcagagaagggaacactgttctaggcaggaggacccagggttgtgggaagagagaaataaaatgagaccaagacagtggggagagcagtgtgagttgaagtcagaggggtgacagcagccagaatgtgccggtagcgaggatcttggattttattctagctgcaatgagagctttgattctacaaatatttattgcgtgctagtcactgttttaggtactgggtgtacaacagtgaaaaaagaacttcccagccgagtggaatgccgtggagcatatctgtttcgatgctgggacagatccctaacacagctcattaaagcagatagcaccattccgtctctttcttcagcttcactttacgtcagtcccagcatttttatccctacccttacagatgagagaactaaagttcagagaggtgacgtgacttgccccaggcccctcagtcagtaaaagacagaactgagaatccaaccagactcttccctttttaggttatttctctaacattagggccgagtatcgattctctttacctctgacttcgtgtccctggtattaagactcagggcccacagtgcctcttggaattcaggcatatggtgacatcagtgtgcctaccattcaggtcttggagaatagggtatggcgaaaggagagaactcgtgatatcgctgattcagtagcccagagttgtacgagtccttgggtgtttcaccttcatccaggcatctgagattggagacaagcatgtggctgaatgacgtatctgggggaagctgtctaaacagccgtgtggagttggagagttgaattagctctgtggccaaacctctgggctcagtctgcctatatatggcttgatctcaaagaacaggtgatagcagtaggagttgttttctgtgttgctggtgggagatgcccaggcacattcctttgtagacaagcacaaactagatatttttgaaatcggaggtctgaaaccagccgaagaattaatcctggcctggaaagcatatgggagagtacagccaacctggcttgggtgttgctttcttggttttgttgcatttttgaggcagggtcttgctctgtcacccaagtgggatcacagtggtacaatcatggctcattgcagccttaacctcctgggctcaagtgattctcctgccttattttttgattttttttgtagaggtgaggtctcaccatgttgcccaggctggtcttgagctcctgggctcaagtgatcctccaccttggtctcccaaagtgttaggattacaggcgtgagccgctgcccctggtgactttgttgctttttaataagcccagaaatttctttcaagagggaggatctttgtgaacatcttgagccgcgttcttgatcgctggctgtggaagcctccacctatcaggctcaagtccatgttgctatcatgtgcactttggctggtgaggtgctgagcagaggtttcagcctctaccacaaggtttcctgatgaaaggtcagctgggtgggcccagcttctccttacccaactgagaggcctcatagagcacaaggcctgggtacggaggttcctggggctcctgccatacccagccaggccaagcagagggccccagtgtgttgttgggtgctgagaggctgcccgcagctctcgcctgtgttggaaggctgtagacttggcttctcccaaacgtaagctgtgaagccatggactcagattctcagcctggccctgctacttactgtgggaccttgggcaaggaagtctccattttctcttttacaaaatggggccaataatctgactaccacagggctgtcaggatgcagcgggatggagcctttatagggtcttgttctgtgggatctggagtcccatatgggagttattagttgagggacgaggcatctgggaatctttattcaactaggaaacttcagccaaagaactaatgccatagagatgtcttatggtgtctgcatttgaagccagcggttctttgaaaatttatcctgagttccagaaagccaactgctagataagtaagcattgagcatttaaggggtcctggaagtaagattcctggaaagaagcagcaatctcttactcatccccgattatctcagacacagagtggtggatggaacctttgtggtttaggggctgactcttggtattgctggataaggaatatgagccagtagagacgagtgtgttgtatagcagtgtcctgcgactgggctggagacgtggctgagggaggccagggggcctcagagtgcacgggaggaggcttacagaggtcttttgcatcctgcagaacaccacatgtgtccttccctctgggaaacctcccacccgggcagggcctctggggccggatgtggaaggtaaacaggctgcctttctgctctctaccacagacaggcccggaaaggcctgagtaggagcttttcatctcaggaagccctgaggtcccacagcttctcctgaagcagcctcattgtccctttgtaagagcatgaccaggtgctctagctcctggagcaccagtggagaactagagtggcccaggtgctgatgccaagttcgagcaacagctcctggcgggtttccctgcatccccccactcactcccatctattcttcacataggggccaaagaacatcctgcttgacatcttgatcagtgtcccttgccctcaggatcaaacctgcaagtccccaaggccctgcaggatctgttttctcctctctgtgctccgggcgcatgccagctgcctctctgctccatgctcattcctgcctcctgagggacttcacacggggcccttgcctctgcccctttcgcctcagctcgccacctacctcctcctcattcttcagatggcagtttatgcttcactatttgtagggccgtcgcacctgacacctccagcctaggttaggagcatgtccatcacctctacttctccttttaactccaaccatccttggctctccctctcgagggtcacgagagcagagagagaatctattttgttcaccactgtgtccctaccatgtgggacattgtcaaggcaaatgtaagtgtgcactaaataaatatgtattgaatgaatagatagccaaacagacagaatggatctgccacaacacaaacaggatgcttttcaagtgggcagaagatggagacatcacttgtcgagacactcaaacaagtggctggatggatgagtggcagatccattctgtctttctgcttggctttaggagtagagggatcacccatggtccatcctctgaggacaagggtatcatgaccgcccaggccccactcacccctgccaggctcattgcatcccatctaaaagtgtgctctggaaggtcataagaagtcctcacctgggacacttctaggcccagtgttcagccagctgtcctgagttctgcatcagtccctgctagatatgaaacacaaacaggatgcgatgcttttcttttttttctttttcttttttgagacggagtctcgctgtgttgcccaggctggagtgcagtgggtgcaacccctacctcccgggttgaagtgattctcctgcctcagcctcccaagtagctgggattacaggtgcacaccaccatacccggctaatttttgtatttttggtagagacaatgtttcaccatgttggccaggctggtctcaaactcctggcctcaagtcatctgcctgtctcagcctcccaaagtgctgggattacaggtgtgagccaccgcgcctggccaaacaggatgctttgcaagtaggcagaagagggagacatcactgtcccatggagaggtgggaaaatcatcgttagcacaggataattcatcctattttgtgctcatgtttactgagctaggattgacctgtgtccgggcagcagggacacagaggtgagtaagacaaagagaaggcccttgcccttaaaaatgatacgtgtggctaaaacgctgtagacctttttgttttttcctttttgagacttcctttttatacagaaattgctacctgcaggtaaaattaacttacatcgtgaaagcgacagtaaagtgtttctagggatagctaaagacctaagaacacagccctgtggtttgactggctggccaccttcctgcagctgggtttactatggtgctgtgttctgggacagcccactcgtctccatttattgggctgagcctcgagacctgcaataccagggaaggaagggaagtctaggctgtctttggtggccattgttatttatggggcatcggcagagaagtcagtaccatggaaaatctagagaaagatagaggatacgcagtgtggttgagcagaatctgatagctccctggctctctccgggccatgggacccagggcgacacagccaccctttttctctctgctgtctggcttgggcttgggctttgtctcctgtgtccctccacaccttcttcgctgtcagtggtgaccaatcccgtggaatcagccactgtgtgttaccccaagtccttgcccctgggacctcgctctgttcggagacaaaacccgggactgtttctccttttaaatgcaaccttgttccacaggagaggagaaaagcaagaaagaggtggcttgtttatctgatggtagtggggtgtgctctgatatgcctttgaaaggggcccagctttgctttgcccagcggcctttgcaggataatgagagaaggaaaacacagggaacttagtgggaatttgaaactggagtgtgggagtgggaaagttcagcttttaccttggagcaatccagtctttctcctgtaggaaaacagaatggtgctgtatggcctccaagctgggttacatcctgggaaaaagacacgtgcttggctattggcctgggcgcagtttatgtgtaagcctttccttgtggattccattttcttatttcccgaatacttctcagccccacaagtccactgagtcttctgtctccagagactgcctggtttccatccccgagggcatctgcgcatcacttaccatggtgtaccatgcacctccagtgtgcccggcactgtgtcaggagctggggatacaggtgctggtccccacctcactcccctcaacctctgcaatatatgatacataacccacacacacagaccatatgcaaaagtggtgggactcctttgtacctgtcacctgcatcagtgattatcagcattttgccagacttgtttcatcagtgtctcccaacacactccccccagacattacccatacgtgctcaaatagatttgggtgtgcgtgtgtgtgtgtgtgtgtgtgtgtgtgtgtgtatttttttagagacagggtctcgccctgtcacccaggctggagtacagtggtgagatcatagctcactgcggcctctgaactcctgggcttgctttgttgcccaggctggtctcagaactcctggcctcaagcgattctgccaccttagcctcccaaaatgctgggattacaagtgtgagccaccgcacccggccaatgtatgtatttttaaacataaccacatactgttatatttaatgcttctgaccatgtcttaagaaaaaaacaaaaactccctttggcttccttgacatcacagtctctctgtttctctgactcttcttcctcatctcctatggctaaattctctccctctgtccactgcttacacatgggcatttcacaatgtcctttttccctgaaggaacttaccccctcccctcagccttaagtaccccatctgtggggatgatgcccatgcctgtagtcctgactcactcaccacgctctatcgcagttatttactgatgcatctctctcccctatcagacgctgaggtctttgatggagcaaccttgtatttgtccgtgtatccccagcaccacacctgtccatagctggagctcaggaagttttttttttttttttttttttaaagtcagagtctcactcagtcgcccaggctagagtgcagtggcacaatcttggctcactgcaacctccacctcctgggttcaagcaagcacgtctgggtaatttttgtatttttagtagagatggggtttcaccatttggccaggctggtctcgaagtcctgactgcaagtgatctggccgcctttggctcccagattgctgggattacagacaggcatgagccactgcgcccggcctcaggaagtagttgaatgagtgactgaatgaatgcccacgtgagcaaatgacctgtttgctgaactttagactgacgttgcctgatgcccactgcttgtgcagtacgtacttcagtctcagcgtgtctgagaccaaactcattttcaagtcccacttcttgggcttggcattgcccatttgtcagccatccgagtcagaaaccttggagtcagcttttgacttctcatcctgtaacaggcaccaagtttgatttctttcccttgaatatctcttagaaccctcaccttcctccttctctttattcctaccattgtccttactcaggaccatatagtgagggtttaaaagtgcagagtcttggccgggtgcggtggctcacacctgtaatcccagcactttgggaggccaaggcgggtagatcacctgaggtcaggagttcgagaccagcctggccaacatggtgaaaccccgtctctactaaaaatacaaaacttagctggatgtggtggtatgtgcctgtaatcccagctactcaggaggctgaggcaggagaattacttgaacccgggaggtggaggttgcagtgagctgagattgcgccactgtactctagcctgggtgacagagtgagactccaatctctagaaaaaaaaaaaaaaaaaaaaaaaagcagattctaaactcacagtgctgctgctggctgcctgagcttgtgtggctttggacagatgacttaaccactctgtgaagatggtatctgatgcacaggaaatgctccaacgttggctcttgtcgtcatctgtgcccatgtctccctcagcagcctcctgactggccttctccagtctcctggtttggattgaggctccctagaccctacctttctgagactggtatctagtcaggttactctgggagatctccaccccccactgcccagagagcaggttctgagctcttcagtctctccaccttctggccccggctgacaccatccctgccacttctcctggggtccccaaacatctgtggtacttttgtctttcttgcccttggtgttcccactctgcagaacaaccttctctccaggtcaccactgatcgcaatcgcgctctcctttcaaggcccagatcaggtgtcacctgacctttgctgtcctcagatcacacctccctgtagcgactggctcgccagtgtccctctctgaccgagctgtgcactcctccagggcagcactgtcagggtctcccccagacccttggttgtgattctctctccttgtcctgaatctcagttttcctgatacatgggatgctacctgaaggcaggtttcaactttcaatctttttttttgttttttgggtgagatggagtcttgctctgttggtcaggctggagtgcagtagcgccatctcggcttactgcagcctccgcctcctgggttcaagggattctcgtgcttcagcctcctgagtagctgggaccacaggggcctaccaccacacctggctaatttttgtatttttagtagagacggggttttgccatgttgaccaggctggtatcaagctcctggcctcaagtgatccacccacctcagcctcccaaagtgttgggattacaggcgtgagccaccgctcctggcctggaggatttcagatttaaagcaaagaggatattttccaacaaagcaactgcttttcttttttctttttaaattttgtttatttatttttaataaagatgggatcttgcatcttgcccaggctggtctcaaacttctggcctcaagtgatctgcctgcctcagcctcccgaagtgctgggattacgggtgtgagctaccatgccctgtctctttttttgtttgttttttttccaaattgaaacagggtctcactatgttgcccaggctggattgaactcctggcctcaagcagtcctctcgccttggcctcccaaagtgttgagattagaggtgtgagccaccatacctggccctgtagaggggaggcattgatgaaggtcaagaagtcctgttagctctgccttcagaatctaccccaggtccttttagttctctccagcctcactgctggaaccctcacccaagccaccaccttgcagtccacacacggccactgggattggggcggcgttctccgcgcgaaatctggctgtgctcctcccccatgaggccctccaaaggcttcctcttcttaggatgaaacccacactgccagccgaagctcctcaggctcccaccctctacaagctccttctgctccagccacactcaccaggcccgagttcccacctagcaccttccctgggaatgatctccccctggttggctctttctacttattcagcctcaaatgtcatctccactgagaggcctttcctgacctgctgagcttgattccctcccctccccagtcacattactccgtgttatggtacccatccctgtctccttagcttgtttttgtctgtattggctcttccactagactgtaagttgcatgagggcagggatgtctgtttaatcccagtgctcaggatagtgtatggctcgtgatagatgcctagtacattttaaaatgagaacgaatgaagtttgggagaggctcagagcagtgagtctcccccttgttgggggactggggagtgcctgggaggggctatctggtgccagcggtttggagtggctgggatgactctggaatcctgtgaggcccagtcagtttctttggttctcatgcagtgcagtgccctcagacctaaccattttgttccgtgctggcttgaaagggtctgcctccctcccagtgcagcccctgcctctcctctttctcgccccccgccctcctccagagaaagcaggtggtgagggctctctaacccagacaggacttgctgttcagccccagcttgaaattgatttcctccagccctccttgagccaggccccgtgaacagaggaggggtctgagccaggcctcctaggccattggtgggagggagaatgagacagccatttggcccacaggccaccaacttttcccccccttctctaaaagacacacaatggcagttgggctgcacctttgtgagtcaccggtgatagcccatcataaattgttatttcctatatttccagagcagctttatcgggcgttgcctgtgcagtccgggaaccgatttgatatggggtcagttaacatgctgtcttgttgaaatctgtcatcatgcccatataaggcaaactccttgggttactttttaccttggcagaatcacaggaatgtcaaggtaaccaggccacctcagcatagctctgattctcacccggtcacctgacttgcccgccctcccccatgactcacccagtggctcagcatggggcctgctgcactgtggctgctggaatctgccaaggacctcctgggactgcccttggttttgtgtcttccttagagtagatcaaatgagaggaaccatgtgaagtagctcacacagggcctaacagagcaaacacaagacgtggaaagcagacttggtgaggcttgagtttagtttgggggttgcgggggtcccagctctgctgcttaacagccctgtggccatgggtatatcccccagcattcagagccttatctgtaaaattagagcacgcagaacaaaccctggtacacactaagtgctcaataaatgtgagtcatttgtgtaattatagtagggtaggccttatgccccacccagtcataaaaatgcctcttgctgttgttggttcaggctcagccccttagtggctttcatggggcaggttgacatggtacccagagtcctcctcggtcctcttcccatggtgtagtgagagcactcaggaccacctaggcctttcctagaaaactgaacccacaccttcccagtgctgccccaccctggtcccccaccccctgcaggacaaaccactcctcccttgttttggggccaggagtcagatctgcccctgagagcagcaggggcccctttgtcctttgacgtcatacccacaccgctcctggagacagccaccccttcatgccagccccaggaaggcttgtaggtggggcgagccagggtgagagtgtagccctgttcctcggccagggcagatgtttcaccatttttaatggagcaattatgagtcagaggtttcagtctctactggttcctcccgatcctataattactctttggctatagaatcctattttgatctcttcttttcttttctcttctttctctctctgtggtcatggtcaggtttttctttttttaaatcctcccaagacactgctaatgttgtctgtctcatgcatccaaggaatctgagatggactgaatattgtcaagggaaaaaaaaagagacccccaaatccagagtgatttcttaacccacccaaatggctttttgtttgtttgtttgtttgtttgagacggaatctcgctctttagccagggtggaaggcagtggcgtgatctcagctcactgcaacctctgcctcctgggttcaagcgattctcctgcctcagactcccaagtagctgtgattacaggcacatgccaccaagcccagctaatttttgtatttttagtagagatagggtttcaccatgttgaccgggatggtctcgaactcctgacctcgtgatccacccaccttggcctcccaaagtgctaggattacaggtgtgagccaccgtgcttggccaacccacccaaattgtgtaccctacaccatcctagtgcttgggagccaacacccactcacaggaggctaagggcaagtttaggtaactcttaacaccacgaattagttgcctgctggcaaacttcaaactccaagcctgaaatttctggttggagtcacctcccagatggactcagggattcattcaccccctcatccagtgctcacggagcctctgtgaggtgcaggcctggagaggagccctgtggcctcagcaaagggcaggcaggctggtgagcacccaacctctggatcgaggggactcaattatgcggataaaggcccctaatcctctcagtgctccaaactcactctgcttctgaaagggatcttcgtaccctgggttcagagagtaggaagcccgcagggaccgagtatgcatgaaacaagcccaagtctgtgggggctgtacatggtcaagatcacagatttccagaccaagccagctccaccctagctgggatgcccaccctgagacacccctctctgctttcactggaataggatggccctgacttggccgggtggactgttgaatcagagcctctcaaaacaggaaaaaggaaaaggatcaccaagcaggagtttcagttgtcaaagacaaaacccttaccacgattaaagattactccagggcctcgcatattcacccttccaccagcagggcccagtttacggatcatttgaatactagcaaaaaaacaagccatctgctggagagattgaacagagggagaaacaggagtgtttgccctgcttccagacacccctttcctgtggcagttcctgcacctggcaagatctactggggaattcccggggtcccactagctcaggacgggtgtgtagcacttgcctaaataacaatcccatcagtgccctgtctgaccttttctccccaaatgccaaaggcctcttgtctggatgaacaaatccctgggcggatttgtccagactaaaacgttaattctaaagactgggccccttaggcactcgctaagattccaggccacactgtctcaaggccagaattggcttacttggctatctttttgaaagatcaaagtttaaaccagatgatctgtagtcccccacccccaccctgaaacctgagcttagctgtaagcattgaaagtaaatggggtgtttgtagctcaccctccctgttctccaggtgaagggccccgtgtgcctgatcatttcatagcaaaatgctagatggggccagaggaggccccagcctctgctgctgccctaattttaaaactgccttttgggagtgtaagtttcctctgttaaaggtagttatttcaaggtaggcctcaccatctcctcctcctggtgagaagctctgcctggagggctgagcactgcctcccgctctgtgggccccacctgccttgggttgagacctatctcttcctggactctgtgtggggagtgcaggctcttccccttggggagaacccagttctttgacgtataatctgagtggtttgggttggttggttggttggttggttggtttcccatgtgtgggatggctccggaagtctgtttgagaacagaggcaggctcagatgggagcagctcctaccccgggccgcctatccccctttaccctggggtttcttttagctccaagcatccattccagtctaacaaatctggtggcagagtctcttttttttttttttttgagacagagtctcactctgttgcccaggctggagtacagtggcacaatctcggctcactgcagcctccgcctcctgggctcaagcgattctcttgcctcagcctcctgagtatctgggattacaggcgtgtgccaccacgtctggctaatttttctgtattattagtagagacggctggtctctactaatagttcaagacggctggtcttgaactcctgacctcaaatgatccacctgcctcagcccccccaaagtgctgggattacaggcgtgagcccctgcacccagcccctctggttctactgagacctcagatctttcatttatggaacaagggggttggattagattgttcgctctcagccctcacttcatgttagactcactaggtggactttgtcaaatgtcattgcccagggcccaccttgagggaatctgtctcattttgcctgtggtgaaattcaggtatttttaaaaagctcccaggtcccatacatctattgtcaattgattttcaacaagggtgcaggaccattcaatgggggaaagaatagtgttttcaacaaatagtgcaggaacaactattaatagatacccatctgcaaagaatgaagttgaacctttacctcacaccatatacaaaaattaactccaaacggatcagatacctaaatgtaagagctaaaactgtaaaactcttagaagaaaacacaagtgtaaatctcatgaccttgggttaggcaatggttattagatatgacagcagaaacacaaccgaagaaaaatagataaatcagactgtttcaaaactggaaactttttgcttcaaaggacactattaaagtaaaaggacaacccgcagaatatttacaaattgtatatctgataagggtctactgtccaaaatgtataaaggactcttaaattcaacagtaaaaagacacaccagttaaaaatgggcaaaggattcaaatagacacttctccaaagaagatctacaaatggtcaataagcacatgaaaaggtgttcgatgtcattactaattagggcaaatcaaaaccataaccactacaaatggtcaataagcacatgaaaaggtgttcaatgtcattactaattagggcaaatcaaaaccataacgtggttgggcctggtggctcatgtccataattccaacatttttggaggtagaagtgggaggatggcttggggccacgaattggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctaccaaaaaaaaaaaaaaaaaaaaacccacaaaaattagctggacatggtggtgggcgcctgttgtcccagctagtggggaggctgaggtgggagaatcgcttgaacctgggtgggagaggttgcattgagccgagatcacgccattgcactccagcctgggcaacagggtgagaccctgtctctaaataataataaaaatgagaaattggccaggtgtagtagcatattcctgggaggctgaggtgggcagattgcttgagcccaggagttcaaggctgcagtgagctatgatgacaccactgtactccagcctgggcaacagagtaagaccccaaccctaaaacaaaaaaaaacagaaaaccacaatgagataccactgcacacccaccatgatggctataatcagaaagtcagataataagtattgactaggatgggagaaatcagaaccctcacattgctggtcaaagtgtaatgtggtgcagcttcttgggaaaacagtctggcagttcctcaaaatttaaacatgttttgtatttttagtagagacggggtttcaccatgtcacccaggctggtcttgtctcagcctcccaaagtgttggaattacaggcatgagccaccacgcccagccaagttcctcaaatttttaaatataagaggtatcatatgactcagcaattttactcctaggtatatgcccaaggcagttgaaaacatgtccacataaaacttgtacatgaatattcacggtggtgctaatatccaaaagatagaagcaacacaaataatgcccatcagccaatgaattgataaataaaatgtggtatatccatacaatggaatgttattcagacaggaacgaagtactggtacatgctacaacatggctgaaccttgaaaacatgctaaggagaagccaaactcaaagatcatataccatatggttccacttatatgaaatgcccagaataggtaaattgcaagagacgaaagaaaggtaggttagtggttgccaggggctgggggctgggtaggagggaagtggggttggagagtaactgtaccagttttgcggtggtagacatgttccttgtatttttggttttttgttttgttttgttgttttgagataaggtctcactgtcgcccaggctagagtgcagtggcgctgtcatagctcactgtagcctcgaattcccaggcttaagtgttcctcccacctcagccttctgagtagctgggactacaggcaagagtcaccatacccagttaatttttaattttttttttctttttctttgagatggagtctcgctctgttgcccaggctggagtgcagtggcgcgatcttggctcattgcaacctttgcctcccgggttcaagcgattctcctgcctcagtctcctgagtagctggaactacaggcgtgcgccaccatgcccggctactttttgtattattagttagagacgaggtttcaccatgttggccatgagagacaggactagctggatttcctaggccgactaagaattgctaagcctagctggggaaggtgatcgcacccacctttaaacaccgggcttgtaactcagctcacacctgaccaatcaggcagtaaagagggctcattaaaataccaattaggttaaaagcaggaggtaaagaaatagtcaaatcatctatcatctgagagcacaggaggagggacaatgattgggatataaaccccaggcatttgaggcgggagtgggccaccccctttggttcccctcccactgtatggaagctctgttttcactctattaaatcttgcaactgcacactcttctggtccacgtttgttttggcttgagctgagctttcgctcaccatccttcactgctgttcaccgccatcacagacccactgttgacttccacccctccggatccagcagggtgtctgctgcatttctgatccagcgaggcgcccattgctgctcattcgggctagaggctcgccattgttcctgtgcggctcagtgctcgagtttgtcctaatcgagctaaacactagtcgctgggttccatggttctcttccatgacccacggcttctaatagagctataacactcactgcatggcccaaggttcaattccttggaatccgtgaggccaagaatgttaggtcagagaacaaaaggcttgctgccatcttgggagcagccactaccaacttgggagctctaagaacaaagacccaccggtaacagccaggctggtcttgaactcctgacctcgtgatctgcccgccttggcctcccaaagtgctgggattacaggcgtgagccaccttgcctagccttgttctggaattagtggtgattgttgcacgatcttgtgaatatactaaaactccctgaattttatgtaaaagggtgaattttttggtatgttatgtgaattacatttcaatttttaaaaattgattctccaaattatgtacatatttaaagagtacatgaaagagagggagagaaagaaaagctggatgcgagatgccgcaacctgattccactcactcctagatttgttgagtacctgctatgtgaaaggtaccagtccaggcagtgggttcccacagcaaacagaaccctcctctggggagcttatgctgcacttgggagggagactggttatgaacaaagaacatagtttttgatgatgaaaagtgcagtgagtaaaacaatgcagtgtgaggccgggtgtgttggctcacgcctgtaattccagcactttgggaggccgaggtgggcggatcacctgaggttgggagttcgagactagcctgaccaacatggagaaactccgtctctactaaaaataaaaaattagccaggcctgtaatcccagctactcgggaggctgaggccagagaatagcttgaactcaggaggcagaagttgcgttgagctgagatcatgccattgcactccagcctgggcaacaaaagtgaaactccgtctcaaaaaaaaaaaaacaaaaaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcactttgggaggctgaggcgggtggattacctgagatcaggagttcgagaccagcctggccaacatggcagaaacccgtctctactgaaaatataaaaattagccgggtgtgatggtgggtgcctgtaatgccagctactcgggaggctgaggcaggagaatcacttgaacccgggaggtggaggctgcagtgagccgagatcatgccaccgcactccaacctggcgacacagcgagactctgtctcaaaacaaacaaacaaacaaaatccgtcctttgcagcagcaacacgcacgctttctggcacctcaaaggggattgtccaagactggaacactggctgcagggagggggccgggtgcaaagagctggtttctgggtggacacgcaggacctttggaatgctcgctaccccactcagcagtatttatacctcttctccaactgcgaagtcagagctttttcatgcaggctgagaaaactccgaataaggcaacttcaggccaggacataagacgcattccatatttcactgtaattgctttcaaattaggttatgtcgtcatgtaacaggcacacacagtgcacttgctttgcccctggctggggttgggtcctggacaggctgccccgtgtgtcgctgaactgccgcagtgctagccctgattgcctgggcagtagggctgtctgcgtcccacgttgctgcacccatctaatttgtggctgtgttattgtgacctgctcgttttctgttctttcaacctgcttcctggcttttatctccttcagaatctggtggcagtggatcttcaaaaagtgctcaggtgtgcagtctcacaggccagaggctccacgggcccccttgccagggcgagcatctctgcctgtgccgctggtaacccagattccagaaggcttagccgtctggccctgaaagcgcctttatagttggtgatgaagcccatgggctggggagccgtttctgctttcaggaactgaaaagatgccccagtggggctaggccttgcctgaggtctggcaatagcctgccagatgggtgataagaaggcctacccaggtgataagcctacccaggaataaatagctgtacctcccctgtgtccaagccctggacacccttccctaggacccatggaagcaggaaccatgggcagcgtcagaggccacagcaggcaaggtggaagttcaggaggtgggacggcgccctccccctcaaagcaactgatgccccagcggagcgacaaaccctacacggtatttcagagccaaggtttgaaaactcccagggtgctagggagctccgtctggcctccgggtacctggggttggggctggctgtggccagttgcagtcaaccctgagcctgggcaaaatgcatgcaggctggtcctcctgggtgatatcctgctaggcgggtgggcagtgtacacggcagaagagggttgcggcatgaggcagcaaacgtttttttctaaaatcttgtcaagcgtggggtccgtggaatccacatgtgagcatcagcctggtgggtggggagagtgaagcctgcgatccagtctggatcatgtgctacacagtgcagagccggcatgctcacccctcctgagggatcgctcgagcctatttctaggcccaaagcgactttgcaagagactccctttattctgggcttagtggaattccagcttccaacagccatttccctccacccccttcagttctgagaacatgttttgtaacaggaaggcaggaagaaaagagaaggcgagtttgttcagctgggtcagccgcatcccaccaaggccctttcttccctccagctcaccatcgctctgcccactggaaccactcggttgccctgtgtctgccgaatgtttgtttcttaatcagcgccccagagtagagagggctttgcctcttcgggttgagggagggaatcattgatgaatggctcattaaagcccactgctgccacattcctgggtgcttaggtcacctcctgaacaatatccatcattcattcacctaccgccccacatcctggcggctgggaggggtccctgtgacgcaggaaggactttatgaccagagatgctaggtctccgtctccctcctgcagcccacagtgacaaagcagaaactgctcttggggccccctgaagcccgccttagctgggtcaccatgggccttggcacacggaggggtgacagtggatcccaactcaactgacaagcttgcctttctctgttcttccaccccccttccccgcactcacaccctgtgctattttagcaaccagagaagcctctttaataggctgcccgtgtgcaggggcaagctctgaagcctcctctctgtggtttggttcacatgtgttctcaaagacagatgagtccacatccttccttcctccctagataggtcaagggctgggtgcaggctgccttcacaggagggccagggacaggctgggaggagcggggccaccttttgcgaagcgggtgatctgctggggcgttgctctgcctgcctgccttgttctctgagtttacctctagcttggggaccaagggtgggctggggccttctttttttttttttgaaaccgagtcttactctgtctcccaggctggagtgcagtggcgcgatcttggctcactgcaacctctacctcccaggttcaagcgattctcctgtctcagcttcccgagtagctgggtttataggagcccgccaccacgcccaggtaatttttgtatttttagtagagacgaggtttcaccatgttggccaggctggtcttgaactcctgacctcaagtgatccgcccgcctcggcctcccaaagtgctgggattacaggtgcgagccactgcgcccggccctggctgggggcttcttgacctgactctgctgtctctccctcactggccagcacctcccattctactcagacatcgtggaatgaatgcccaccccgtgtttgtatgtatcatctgtgtctgtgtgacattaagcaagtcactgaacctctccctgcctcagtttcctcatcaaatggagataatatcgcatgtgatcatggggttggaggttttaaagagttgctaatgtgtaaatagtaagaactagcaattagccgttatagcataattacctttaatatgtcatgccccccgcacccccgtgctgaatgtaattttgcgggggggcgggttgagacagggtctggctctgtcaccgaggctggagtgcactaacacaatctcagcttactgcaacctctgcctctcaggcacaagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctcggcctcctaaagtgctgggattacatggtgtgtgccaccatgcctggctggccagaatgtaaatgataactgttttgcttcctcctgtgtccagtacataatagggctccaagtcagtatttgtgaggcaggtgcatgcctcttagttgcggtcctgagggcatggccactgccacgttctggacagtcagagtcgctgctgcccctggaagatgaccgcgatcatgaagcccaggagagctcgatgctttttgcctttccctcctcccacagagggctggcagctctggttcctcccaaatgaaatagaaaccttgagtttgcatttcttctttggcgtgccggcagggcacctctgccttcctcttcctgccagggggaggaagtttctctcaggggctcttcaccctgctttattcctggccatcacacattgacccttgtccccttcggctctttccctgcatggcagggacagcatgaccgtttaatggctttgtgaggccagcatgccagcctcacttctttactcccttccttctcggagtgggctctgtcccttctgcaggagggctttggcacatgctcttcccagtatctggaaggtctccctcatttttatcttattaactcctcatccttcagctcagagtttgagaatgacttcttcaaggacacctttctgtgtctgcctcaccagtcgcttggtgcccccccaccccgccaccatgctgaccgcactcttcagctcccatcccaggggaggtgacacaaactcggccccaggagcccagcacctggctttaaacccagctctgtaactttctaggtgtgtgactgatgggagcaagccacttcacctctcaggccctccgtttcctcatctgcaaaatggaggcagtactagcacctccctccagagatgattacgagggtgacagaattagtaagtgaccaagtgcctcgagcagtgcccgcccctagtagactctatggaagtgtctgctgcagttattgctgttattattaccacttttcctaagggcgttatttctggagtggactgatcgcttgattaatgagatcagacctggagcctcatgagagtgtctgcttttgctcactgttatggattcagcacagggcctggccctctgctgacccccagcatatgcttgtccagagaatgaatatgtacggacccatggtggcctggggcatcatgaggtcggctgcccacattctgagaattttgcatggtggagggcggcgtggtgggcgcatagggcccccatctatagaaaccacctctccacaccatccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacatggggtgagaacaggagtgcatcagtggggttccccaagcctgtgtcaggtccggatctgggtgggagttcccttctgcgtcatccaggccaggcgagtgggcatcctccctgagcacctgtgcttggggctttgcctgtgtcagtcaggaagacagagtacacggaagagttaccattgctttcagagcaaaccttcctttgacatgcatttaacacagcacggagtgattgacatgtgtccttgtgtttaatccctatcttaacctctcggttactgtcctgtttatcagtgaggaaactgaggcttattgcttgcctgaggcctcagtggcagaagcaagatgtgaatccgcacctgtgtgatgcccaagccagagctcttgtttactacccagagaagatgagcacaggtgggatgtacgtatggagggcgggtagggcagcagcccctctgaggacaggtggccagaacccaagcggcgaggtttgttcacagcctccacagggtggggtggggccatccgcagagggtctcctgccatcccattttccctgcataccagtgggtggtctgagagcctttgcagagaagagactggatctcagcacgtgcttatgtgcgtgtgtacatgcacacacatgcgtgtgattcatctggctcttactttatgccaaggagcctgtcacatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacgcgtgcgtggccctccctgcagcccaggtgcctaggtctgggcctggcaacaccagagcacggggccttgccctcggggaacagccctcttttgtcctcaggctgtgggatgtgtcttggctactttgctgcccagcagtgcctgctctcaggcacatgtgagagtagaggcctagcatccgtggccacttccttcccagcccatttgctgctgccctttgctctgcagggctgctgggctcctgggctccacgcctgcttgctgcctgccatcaaggctggcagtgctctggggctgtaaaggtgcaggcgccgtacttcccaacccctggagctcgcacatggtaggagagaaagctcatgtgcatgcaacatccaataagactaaaagtgactgggggttgctacgggagaggtgctgagggtgggccggggacagagcaggcacactgtggagggggtgggcaggactcctgagaccagggcagggagggaggagatgctgggaggcacagggccatccagagagctgccacttcctgagcattgccatgcacgctgcaggcatggccatcttgagtcctcacactgcccgtggcctaggtggggtcttcatccccacgttgcagaggaggaaatggaagttaggaaggttaggtgacgtgcccacatgagtggtgtaagcatggttcccgccctgggctctctgaattcagtattgtatgggggaggctgggaaggtgagttagtactctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccaccaggaggggtctctgtctcccaggtagaggaattctccatggtgagaggtggtggtgggggatggtctagctgtccactcttgccccctttcggatttggaaggaagccccatgctgggtccacactggtatggcgtattaattaggcagctgctttgtctgggagggggctttgtgtcgagtctccctgaatgagcagggctggcgacagttgtcaaaacacatggtgcttggtcagagcccccgtagaagccccttgtcctccgcatggcctccgcctgcacccggggcgtggaatgtgctcttgtgtgtccctggctgtctgcttgcttctacactggcccctgcagatggagggggtggggtacaggggttcctataagaagcagacacttggggtttttcccaggccctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcggcttcttgtttagtaccctccatcccttccagttgatcatcagaaacattctccttagatgcggctgcctgaccccggtgagggggcctgcctcccacttgccttccagcctcctctaagctgcactgagtcttaaaaataggaaggatagggctgggtgtggtggctcacgcctgtaatcccagcagtttgggagaccgaggcgggtagatcacttgaggccaggagttcaagaccagcctggccaacatggtaaaaccccatctctactaaaaagacaaaaattagatgggcatgttggcatacacccgtagtcccagctactcaggaggctgaggcatgagaatcgcttgaacccaggaggtagagattgcagtgagctgagattgcgccacagcactccagcctgggtgacagagcgagactccttctcaaaaaaaaaaaaaggaaaaaaaagaataggaaggatagggcatggcatgttctccaggagacagagggacgggggcatcttgcttgcaggaagccaggcgacacaggcgtgtgtgcagggctcagagggtctgtgttcctggcctttcctgggagggcttgctcttgggctgcccaaagctcaaagagagactcgaggaaatcctgcatttatgggagcttttcttttcctgccactttcctgttctgggttgtatctgtgcacgtgattggaacgtagcagcctgagctcctgcctgaggagagcagccacgggtcacggaagccagggtccagctggggcctttgggtctagctggcagatgaagggctggccttcatcaagaaaacaagccccatgagggcaggagcccgacctgttcattccacaccaccgagcctggtgctcagtcatgtttgtgtgactgagtgagccggcggcgggctgaggcgcttttgtctggtgtgcgtactggtctcccttgaggcagcttgggggtgtggaaaaagcacatgttgccaaaattgacagacctgggttcaaatccaagctctgccacttaccgcctggatggtcttgtgatgggtcattaaccaccccgagcctcagtttcctcacatctgcctcccggggtcactgtaaggatcagaaacaatgtgtgtatcggccatgtacggtgtgtgtcggcgagtgctccgtggcagctgcggttctcctgaggtcagagctgcggccctgcaggtgtgtggagagagccccgacagccaggctgactctgcgcactgtcctttgttctgcttccccagaccttcacggcatggtgcaactcccacctgcggaaggcaggcacacagatcgagaacattgatgaggacttccgagacgggctcaagctcatgctgctcctggaggtcatatcaggtgagactcccagccacgcagtgcggcccagccctggcacaggtgctctgccacagcggtccccagagaccctgcccacccagctgtcccattgctcctggggaggagagggcaccccttaatagctgcacggtggtctgatgggtggggccagagtggcctggtgggccagcagaggaacctgcttttggagaacagaggagactctaaagcctctctccctctcgccctctctccctttctctctctctgtctcgccccctcttttctctttgtgcacttctcaggggagcggttacctaagccggagcgggggaagatgagagtgcacaaaatcaacaatgtgaacaaagcgctggactttattgccagcaaaggcgtcaagctggtctccatcggggcagaaggtgagctggaggtggggcagcgagggtcctgctcggtttctgacctttaggctctgaagcacaacatctgcatcctgaagagaagttttgttggtggcagggcgcttggggcactcagagccccagtacatactcagcagtgatcacaacaactgctcttgatatgatgctgggcccacaagctcccccaaacccttggaaaaatccggtgggcgcagtccaaatctaggaagtgcaacccacccaaccacgggggcgacggcttctgcagggggaggaatggttttgactcggactcaggtcgccctcactggttctccttgtgccaggctcagcagacagtgacaaacatgtgccatggcctctctctgtaccaggaacacctttctcattatgccctgcccggtatcagagaaggactggaggccccatgtcaggcattgggacagggagtgcacggccaaaggtcagtgcctagactttgccctgtgtgcatgggcttggagaattttgcctctgaccaccccaggatcctcctgggccccacgtagataaccaggaccacagtccactacctgcaggccctcactagagcagcaggctctcagcaggggcccctgggttgagctcccaggcgcttttagagacaggcgaggcctgatggagccccagcagcatgagctcgcagtccactcattagtcagagtaagatttcttcaccctgacatccatgttgtcccagcttctagaaaaacaaagtaaactaattgccgttaatgacagggctctgagagtttggccaagactccgggccagaatgtgtgtgctgagttccaaggctctgccccggcccaggacctctgcgatgaggggtgccaagccttgcatgccacagtcgaggtggttggtgtttgtttaaaaaaatcacaacccaaaaattcagtcaggccctgagattttctgtccttgcatgggtctttcctccaggctctgttccagccttctgcttctcacagctgcatttattttgctcaaatgctagtctgtaaatacagaaggggttagaggagagacccatgtcagtcatcagttttcatttggagaaaaacttggtctaaaaatgttctctgttcatgcccaaattggttcactcccaatccctgtgactgtggggccttggaacaaagcctaatggaggcgttcctggggctcaaggcacctgagaaccccgccccaccctgtccccctgtccttccacatgattgggcattcgcgggagcattggcttcccgtgggggtgatgagaggggccggaggcacagctgcaggtcagagaagcagctggtggatgtgtcatgagaaacgccatcctcctctcctcaccggaactccataagccctccgttaccagctgcacctgtacttgctgagccggggagctgcggccttgcccagctctgcaggcccggccctcaggaggtgcacagaatagatttcctgaggctcgagctgcctcgctgcactaaggggcaggtggtgctgctcagtttctgggtctggggctctgaaccctaggacagggtggacactgggtccctcccctgtctctgggcagcagaatgagcatatttcctcctctcaaaacccgaaagctgtggctcatggacacccccttcctctgggtgtgtccccgggggaaggtgagccccatcttctctgtgacctctccacctgcttccaagcaagcctgccctggagtattctgctcagaggtcagtgagcagggtctcctgtggtgtcctgggcctccagctctgcagttagctttggaactcacccctgtgcccagcccttccccgagagtgcttgcagcagtggcgcccctctgtcttctttggaagccactccatcatgccccttgcatatggcgtgttgacaagttgggaggactgccctaggcacggctggctgatggactctgggatgaggcactgccttctc

SEQ ID NO: 15020 - DNA, 27910 bp, Human
caggcgtggtggcaggtacctgtagtcccagctacttgggaggatgaggaaggagaattgcttgaacccaggaggtggaggttgcagtgagtcaagatcatgccactgcacttcagcctgggtgacagagtgagactctgtctcaaaaaaacaaaagcaaatcatgttttgttgagtttgtttagctgtgtattcacaagttgattggcatctctcagcccatcccaaccccaccccggaatgctcttcccaggcttcctaacaggtattctcctttacctggattgcatttgtagaaaacactctgcttcagtgggaggcaaggaacagaatatttctctgtctagggcatactcttccatgttatctgattccaattctatgggacctattttaccattctgaaagctacagataaccgatagaaatgaaaaataattcttgtctatggatatgcaaatgcttatattttgaagagagacaacccttcctcacttccccccaaatcccctagtttgcttccattttacacattcatttcaatatttctcttctcttccttcttttctttttttttaggttatctccctctgtgccaggccagagtgcagtggtgcaatcacggctcactgtagtctcaacctcctgggctcaagagatcctcccacttcagcctcccaagcagctaagactacaggcacgtgtcatcatatctggcaaattaaaaaaaaattatagagatgggctctccctgtgtttccctggttggtctcaaactcctgggctcaagtgatcctcccatcttggcctcccaacttgctgggattacaggcatttgccactgtgcccagcccatttcaatatttctgatcaataaatgtgcctgtccttcagattctcctttgaattggctgtcacacctcttcagtttcttcactgaggagttaaacataatcttgagcagcacgtgatattgtttagctctgtgtccccaccaaatctcatcttgaatcgtaatccccctgtgtgtcaagggatggacctggtaggggatgattggatcatggggggtggttttccccatggtgttcccatatagtgaatgagttctcacgagatctgatggtttaaaagtgtttggcagttcccccttctctctctctctctctctctctgtgtgtgtttttctctctctcgccactttgtgaaaaatgtgctcgcttttccttcgctttctgccatgattgtgagtgtcctgaggtctccccagcgatgtggaactgtgagttaattaaacctctttcctttataaattacccagtttcaggtagttctttatagcagtgtgcaaatgggctgttacagcacatattcatttttatatctatattgagttatcatttaacctgtttttgaaaattatcttttaacatgcatttttctctttcttattatcttcttttgctaaaacctgttctccagtagcttcctaagaaagggtgcacaggagacccattttttgagcccctccttatctgacaatgtttttgtttgaccctaacctttgattaataatgcgactggatgttgaacttgtgaaaggaaaataaaaactcaggaccccaattcagtatgccaaaaggaaaaaaaaaaaagaagctgaaagctgagtcatgcaagaaactgccttttcttttgctcctaagtagatggctacagataaaagattaaatatctccacaggtagctactccatgttcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctgagtatctggggcaacaggcatgtgcaactatggctggctaatttttaaattttttgtagagatgtgatctcgctatattgcccaggctggtctcaaattcctggcctcaagcaatctttctagattataggacttcttggcttccacaattgcatgagccaatcctttataataaatgtatatccatctgtatatgtcttgtgtctgtctctctacctatcaatctatccatccatccatccatccatccatccatccatccatccatctatccatccatctatctattttattgtttctgtttttctggagaaccctgactaatacagaaggtgagcccaacttctcactgaggattctcaagcctcagcctcttgaagtgctgagattacaggcatgagccaccgcattcagcctctgattgtcattgacagtgatgtgctctactgtgagtctcttttacccactgtgctgggtattcactggccctttcaacttggaaacgcgtgtcctttggctttgcaaaaatatctgtagcattgattgcctgatttctctccctctgatcagggcctctgcagcatccgactccagggcactgttcaccccatattctatgaatggcgtcctctggagttgtgctgttgcacctgcaccttttatttatttattttggaacacattggagtaagatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttccccaatttgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgggcaccatacccttgaaggcttgaatagaacagaaaggcaggagaatttctctcttggcctgaacacttgagctggaacgttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaacttcttgttggggatccccagatatcagcgggcagagtgtctccttttggcaccttcagtttctccagaaatgaacctttccatttccatcctaagggattgcaagagctgtggacttgccaggagggaagggagcagaggcccccacagttcacaatgtaatgtttcccttaaacacagcccccactttcagctgggaacccaccctttccttgccggtgctttgtgtcctcaagactggacataaggtgttgaggtgtggtgtgtggtttcaccacacaatcatttggggtctcctgagagaggtggggggaggggtgtggtctgcttgagcaggtgagggaaatggattggggtgctagctggtaactgtatactgactttcttttgtagaggcagggtctcattctgttgcccaagttggagcgtagagtcatgataacagctcagtgcagcctcgaactcctaggctcaagcaatctacctgcctcagcctcctaagtggctgggaccacaggcatacaccaccatgcccagctaatttattttttgtagagatggggtctcctatgttgaccaggttggtcttgaactcctgggctcatgtgatcctcctgcctcagcctcccaaagtgttgggattgcaggcgtgagccacggtgcccagccagtatactgactttcagtcaacctcatgctttcagtgccagttcttcttggtgcctgatgattgcaaacccaggatttattggagagtctctgttcttgatgcccaccctgcccctccactttcccacacccccttcacctttaccatacactgtcctcaactcttctgaggctgctcccaagtgttgggtgctttgatcctgtctgccattgcctgagctcctgttctctccatccctgtgggtcaacagcttttatttagttcattcccttactatcattttcatagagttgaggaggtagggaggagatagaggcaggaagttattctaccacatttgtccagagtctgccctgtttgggggcatcagtgggcagagctggaaagccatggtggctgctgagatttggaagtacaagaccaggaggaaggaaggaggatgcttaggtatggggctcaggtgtggggttcaggtagcccgtgcatggtgaggaaagggaacaaatgagaagagtgtggtagatggtggtgtgttctatctattttgatggtgggtcaaaagagggaggtgaggaatgggttgagaggatttggccccactttgaatgcagggcgaggggaaaccagcatctcagatgtgcctcagtttgtgcagggctaagtgggacccagagcaggaggggcagacttggacgggaggccagtgactctggagtttgcagtgaatatgcagggtcctgggtgtgatgcttgggttgtttatctggcctaggggaagcgaccagaaggcacgtgcctccagtccagccaggctgcaggtgttaaaaatctctgcagtcacattttctggcttctctgaacagcccctgtaggtgctcacacatgtacacatgcatgcatatatatttatatatatatacatttacatatttatatatatttaaatatatttaaatatttaaatatatttttatatatatttatattttatatatgtgtatgcatacacatgcacacagatgtacacacacatatgcacatacacatatgcacacacacaccctacaactcagacctttcctttcagagctacccctgaccgagacttccttgccatgttacaaatgagcatctcttttagagtagtgtaatagaacgtggcacttcttgataaaaatagaattctttgacttctgcccaggctgcctggtgggcaggctcacagcctcgttctttctcagctttccacgttattaatttttagtgccaaaagacagttctgctgctccaggcctccagctgagctctgctaggttggaagtcccttctcagcctgattcccattagcacagagcttggagaagacccttcctcactctgatcctgctgcctggagctggcagatgcactcctcacccagcagccaagacccatgctcctggtttagaagggtccgtcctgacagctatctccactaggcagcccagggttcctctggacacaggaccctgccaatttattagtcacggtggcaccggatagacacagcttcacccagtgatctgccggcactgctctctcttcctccagtcctgggcttcttcatgtccaaaccacgtggagaacaagataactaggatcagctcttttggagatagaagtcaccttccagcctgggatcagtggcatagtctcagcccaggtctggagacagggaggctgccatgcctgccagccccatccagccccagctggcagcagtgtgaaatagtgctcgctaaaatgagcctgctgtttgcctagatgtgtgtttcccaataattcagagacctagataatgggaaaggcgaacatctcgtatcccccacttccctcagcaaaaagagaacagtgccgcagccacaggcaaggtgggttagaaaacctgtctgctggcagattattgtctgtaacttgcctccttagttcttccaacactctctccttccccctcctcccctcccatggtccaaccctgagggttccagcagcagctgggaggtctccgatgttatctcagagctcccaatctgctgacatttgaaaatcttctggctataacttgctcacttagcggctgctgctctgcagccctgagccctcctaaaggagaccctacacagaagagtacaatgtaaacagccgtcgccagagtccccccagccagagatagcccttgggtacattttgcaatattttgttttgtttgctctcagaccggacttgcccccctttttagcacagcccaattctactacgtatactccctccttgttctttttgtttggcattatatcctaagcatttccctgcatcatccaagctctgtgggatgtcatttttaacacccacacagcgtcctctggtgtggttgtatgacaagtcacttaactattccacacccaaagcctccccttttccaaactcttccctgggacctcctgaaggtaacagcaagatctgagcagcgctggatggatcctgctctcagtcccctgtctgggaacaacgctgagccttaacagggatgtcagcttcctagggctgctgtaacaaatcccacaaactgagtgccttcaaacattgtctggtagttctggaggtcaaaggtgcagaacgagtttcactgggctgaaaccaaggtagggctgtgctctctcctgaggctttaggggagaatctgcttcctgaacttttctagcttggagagctgcattccttggcccttcgtcccccttgcttctcttccaagccagtagtgtagcatcctcagatctccctctgctttcgtcttcacgttgcctttccttttctgcagtcagatgtccctctgtccctcttataaggacatttgtgatgacatttagggcctatgtgggcgatccaggatcatctgtagatctagaacttaaacttttttttttttttttttttttttagatgtggtctcactctgtcacccaggctggagtgcagtagcaccatttcggttcactgcaacttctgcctcctgggttcaagcgattctcctgtctcagcctcccaagtggctgggattacaggtgtgcaccaccatctccagctaacttttttgtatttttagtagagacagggttttgccatgtaggccaggctggtctcgaactgttgacctcaggtgatctgccttggcctcccaaagcgttgggattacaggcgtaagccaccgcgtccggccacattattcttatttgcaaaacaaatacttatctggcatcaaacagatactttgcatccggcaaaaacaggtggaggtgactgaaggcgaatgtgggaggtcatggtgggttaatgatcgccagcgctgtccggtgaaatcaaccacctgtgacaaaggtggtttttcacttttactgaacaagcatgctattctacagtaaactccttaacaaatgtagcttttcaaggtccttaggactattacctttcaatattattgggaagttctttgctcttcttagcagactgcgaaactcaactttgtgatgacaagatacagaataaatgcatattaactgaaattctaggctcacacctatgtgagcttttctctctctaacaagatgtcagggccggttcagggagttcatctccagccacctgtgctaatcatcgcccatcctttccaagtatctaatgacactcccaaccaaggtctctataatttccagccaaaaatgagttacaacatatggaacatctaattttctgtttccattctagttattttattcttatgagcttgtgggctccatctaccaacctctgggcaaatgctcatctgacttccatagacacacagcaagcagacaaccacacaaagaggaagagggagaatatttaccagccatggaacatctgctctgtgcttatatctcatatgcattatctctaattatcaaaagaaggtattattattattattgttccgcattcacagatgacaaactgaagatcagattggttaaatacttgtccaacattaacttagcatttgggcatcatagttggaattaaaacttgggtctgctcatctccaaaaacaccctaagccttaccacactcatgggacacagctgcagctgcaggttctgaaaggaaaactaaaacttcagaacccagttcactatgccaaaaaggcaaaaaaaaaaaaaaaaaaaaaaagccaaaagctgagtcatgcaagaagctgactttccttttgctcctaagtagatagctacagataaaaggttaaatagctccacaggtagctactgtatgttcaccttatcttacgtaaactgctgatttattgagcatgagacaaatacgtaattgactatcccctacctactccgtttcctttgcaacatgtggattcagtcatgtgaccatacactgcctttctcctctccagcctacttttccactttaaatatcaaagccctcaaaatcatctttggagaaaggcacagactagcgactgtttctgtgatttcgtgtctttttacttccagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgcggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggtgaggcctggaggtgatgtgcttgagattaccaggctcttctgaacctgggggaccttctcctatgatagccctgctcctccagacccagcaggtgatttccccaaaagccgcttacagtgaacgcacctgatagcaataacttaagcatcccctgagaatgacccttatggcaggtgcaggtgaatgtggtttggagttctgagctaaggaatctgggagtggccaacctggagattcattcctattccttatctatgaggaacatctgagctcctgtcccgtcctgtgcaacacggacagtacaggggatcaaggccctttgttttgggttaggtaaatgttgccaggtggacactgttgggggagggtgctaagtgaagatgctatatatgctgcaagctttttgtaagttgtgtggctctcctgcccagcccaccactgctagatgctctcccctgcatgtaagccccagtaaaactccatgtctccttcagcagccctgggtcctttcttcagcctctcaaacctgctgccatccccattggagtagataggggttcagcataacagcagccaccagctggggaaaggcgtggcatttggagctccctacatggtcttgactctaatatggagggaaagaaaacagattctgccctgctcagtaaagccccctactggcctcccaccctggactgtggacaaagcttttttttttttttttgagacggagtctcactgtgtcccccaggctggagtgcagtggcgtgatctcagctcactgcaagctccgcctccccggttcacgccattctcctgcctcaggctcccgagtagctggggctacaggcgcctgccactacacccggctaattttttttttttttttcatttttagtggagacggggtttcatcgtgttagccaggatggtctcgatctcctacctcgtgatctgcccacctcggcctcccaaagtgctgggattacaggcgtgagccactgcgcccggccaacaaagcatatttttttcctctgaggtctttaccctataactgcaagtggtttcatgacactgcacatgggttcttatctggggttggtagattcaactcaattccacaggtttactgggtgttgcctcccatgcttggagccaggaggatgcagggaaatggggctgccaccatacccgctcttcttatgatcccatcacatcattgcaccctttggggcctggcaccatgctctggcactttgcctccatcatctcctttaacctctgagctctgtcaggaaggcattactactatccctggaatacagacaggaaaactgagttggattgaggctcagagaggttaagtcacttacccaaggtcacaaagctagagagtggcaggccagcatccaaggccagcaacacgagctccctctgatccaaatggtgactctatgtttgatcagtgctctgagaactctccaaagatctttatcaactgtcatctcttcattgcccaggcccagtcagggagccacttggctgcggtcccgctgagatttaggggcaggacccctgatgtgaggtggaatgcttggtcacgctgttcaagcctccaccagtcactcctgactggttatggacactcaatgtgccccgtcctgtgtgcaatgcagtgtgggaaggggatcaaggaccttggctaatcccaggcatttccccagaatgtcccaggtgtggaccccttgggaggtgctgggaagcaggctggtgtcccacaggccttggttccatcccagctgtgctgtgctaagctgaaactctttgggcagcttgtttcacctcatgagacttctttttctgaactgttaaatgggatgattcgacctctgcttggcttttggtgacgattaaacgagatattagctgtaaagcatttcatcccgggtctggtatagaagaagcacttgataaatgaaagctctgttgagtatgatgatccgtcaccccaggcatcagtgggatctcacagcaggaacaatgcctaactcctaactgatgcccagtaaacatcgggtggatgcaatgtccaacaagacagatattcatgttcagttttacagaaaaggagacagaggccagaaaaggaagaaagtgcccaggtcagccggctagtaagaggcagagttgaaatttgaaccgggttctggctggctgcagctccactgctccactactgcactgtctgagagccaaaaggcaccttgtagtcaggcaggcagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggcctatgtctgcacgtggtgaggcccctgctgggtattgtaccacaccttcattgtgctcagggtggccagtggaggcccttcccagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggctataactgctgcaaagatagagaattgcaatgattaatatgcatttatgtatttccaaaaagttaccagaatatcaaactcatgattttgtctatagtttggttagattcaagctatttttatatcataaaacaacttaaaatttttttatttttaatttttgtgggtgcagagtgatgtatttatggggtacccgagatgttagaatgaagctattaaatgtgagtgtgaacgttcacctttttgcagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatgggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaatttctttgggctcttattagcagcatccaaatctgtgctggtttcttctcacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcccaggggctgtctaagggctcatctctcccaggagcccctgtatcatctcagtaactagaccagtaccatatccgacttcccctgactttgaaataattttcacctgcaatcaggtgcgcttccctagaacctctctcgctgttctttgcctttctccttcccccgccttgtatctccgtggtcctgccaaaaatcagaagctcattattaaaccagaagcttccttgcattatcccagagactacagacagaaaatatttgcttctatctcaactgaggactgacatagtaaagactccttgagatgttagctgtcaaggaggggaataaaagtttttcatctgcatgagtaattgtttcctgttttatccagagagacaacagatttacatcccagacacattcacactgggccaagagcagctgccattgcagattcgagtcacgtccttttttccttccttctccttcttggagttacaacagaagctggggaggtgagagtgcaggtgagagaggaggggggctctggaacatgtagcctgtgaggagggaaatcaggatggtgcttgggtggaggtgggagctgggccagggtcttggctggtcaggaaggctggtgaagcatgtactggggaggcagaggtcctgctttctttcctctctttccttcacacctacctcaacccactgtcgagtcctatcagctctgaaatagatccttcctccagcgccttctcacctctctctccaccattccagtccatgccgcctcatctcttactgggactttcacaacagcctcccgagtggtcttggcttctgctcgcaaatcctgcagtgccttctctgcggagccacaagctggatctttttaatccgctctcggtttctcacagcccttggaatgaaaccttggcctacagccctgtgtgacttgctgcctgtccttacctcctaacctcatctaatatccccttcccctcctcgtaccggcctttctgtttctcagacactccaggcttgttctgctcttggaccttcacgctgtctttctgtctcctgggaatctgtgccccctctgccagatcatgcagctggctctctctgcccaaataccctcttccgaggggtcttccttggccctgtgtctgacataggtaccctcctccatcactccagcccattacagtgccataacacttttattgccatctagagtaacatcagttggttttgtttatcatctgccaccctgctagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggtaaatttggtatcttagcaagtgggtgactaccactgtctgggggaaagctgatacacgaggacttgacaataattacagcagtaacaatcgctactattttgttttgaaatgaattttagtttctgaaattgtccaaagcacttttatcaatagaaacttgttacacatccctccaacagggagaagcagcacaggaagctgccccctcaaacactaaaggctcctggagctattcacagtgctggggaacaaccagaggaggaggaggacagagggagagaatactttttttaaaaatcccaaacaaaaccaaattctatacatgtatatctcgagtgagtaaatgtgtaacactcagcagtctcctacacttgccaggttttgtggcttcatgcagtaatataaaatgtgcttcacaaagctaggagttggcacagaatatagggttctgattcatattttagttttacttttttgtagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcacacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactagtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagtccagctaacatactatataagccagtgagaccagccagtgtctgttcattgcctctgccttgcccctatgcctgcccgcctcctatagcaggtccctatagcataatgaaaatgcgaacaaccttttctctggacactggggaatctagtctggtggataaagatggatggctgttaaacgatcacatcttgggctctgtgtgttcagtgaagcctcatttaccagatctctctgatgagaaaggtgaatggtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttactgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttacaactatacaaagtttgtagtcttttcgttataccttttgacaggtgagttacttgctggaattcacgtggctagtaaatactggagctgagatttgaaagcaggcaatctggctccagaatctgtgttttcaacccacatactatattgaccatcatgaaaagatggtggtgagcaggcttgtttctaaggatgggagggtcctcataatatttgtatttacagagaggagggagaggtgggttacttcctctcccaaccccagaaagccaggcatgttggctggcatccctgggacctcagatattcaagcaaccatggccttacaaatcaggcattctatttattagagttgtgcagtgaggtcccctccatttcatccccagaatatctcctagacaagttggatcctgcagggcccgagtataaataagatggtgccctctgttgttatggagtagcttggagctgggccccagatgccctgtgtggattagatgagtgattagtatttggcaatgtagcttgagaggcttgctgagttactggggcatatgtccccagctcacgagtaccagcctgacttctgtcaatcaatcagtgaacagggtttgcagcgtccaccaggtacctgtggtgtagtagaagagagtttgaactttggaatcaaacatgctgaagttcagattccagctcctccactaactacctctgtgatcttggctaagtgaccgtcactttttttttttttttttttgagacaagatctcattctgtctcctaggctggagtgcagtggcatgatcatggctcactgcagcctcaacctcccgaactcaagagatcatcccacttcagcctcctgagtagctgggaccatggggcacctgccatggcatcaagctaattttttatcttttgtaaagatgggatttcgccatgttgcctaggccagtctcaaactcctgggctcaagcgatccacccacctcagcctcccaaagtgctgggattacaggtgtgagccaccgtgcccatcctgatggttgctttcagagccttggttcttcatctctaaaacaaagataggaatactgcctagtttccatggggagcttgtaacacatgcgggcctctctcccctcaccccagtctttggttagacacttactatttgcaaagacccaatttcttcatcataagaaggctgccaccacacttgagggagtgacccatttacaaacaattgcttccttctgggtcattctgatggattaaatgaagaaccatttaaaaccacagcccaaagggccagagggagaggcagcagagggaagatgcaggtggatcttcatgcactgcatgaggaagctttgtaccatggtcaggaaaagctccaggcacacaaggcagcctccatggccaatcagagtgcacctctcacctcggcaactctgctaacctaaatagaccagtcacacagcagagctgcaaaagaagacatgataattacagagaccccaggggaccgtctgtgcggactgatgctttgtttctcctgacccctcagacctctctatttcactgcaaactctcaatacccagggcctttgttttgctgtgaacactttcattcctgagtacattttctatgaggagttggcggaagagagtcagaatgaattatattttcagcacacctctgggttcatgttgaacttggctagaactgttttgacccaggaaacaatttgactaaaggatatttcaatccaacaaatactctctgggcccttccaatgtttctggcactggtttgatgctgaggacatagagatgaataagaaatggtctctgtcccccagctgataaattatcattgatgatctaccgtgtgccagggactttacaaatgtgattaccatttcttacaacatagtaaggtagatagcatttttgtgttacaggtgaggagtaggaagttcaaaaagtttataaggtcaaagtcacacaactagtcagatgtagaactaacctttggatttgggactgttcaccatcaaatcctatatgcttttgatacagacaggagacccagaaatactgggtagaagagggtggttccctggcaaaggccctaccctcaaacctggaaacctgcagccctaaatgggaagaggcattcctgttttcatgcccaaaagttgccttttggcccgtcatgtcccctatcctatacctgtataaaccccagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccactgcattcatccttcaagtttatgtgtgacctgattcttcctggacattggacaaagacctaggtccagtgaactgtctaacacttaagtcatccacggacagcaaggctaacagaatgctgtaacatgtgcccacttggactctgggagttgcagacacccacccgtaggtgctgccatgggtccggagcccagaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctagtggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgtccctggcttcctaactcatttgcaaatggaaaatactattccattgtaggaaccttctttttccatttgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaaccgtcaaaggctaggcagcacccacccagcagcttccacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgcccagcctggtgtgttagttctgtggaaactgactggctagggtggccacgggaggaagagcctggttctccctcaccagctccttgtgaagaagggacctggtcaataaggcaaacgacaccacttgccaacatttgatattgccaagtgcttttgtttggcactactatagattttaaaaatgtatctcacttttaaaatttgcattttcttgattacttgtgagattgaacatcttctcatacagcaactggccgttttcatctccttttctgtgaattctagctgttccctatttttccaatgggttattcgctttacttactgatctgtaagagttcattacatatactggaaactaatactttgctatatattgttactatcttctcttactctggtcacttttaaaacttcatgtattgtcataagaagtcatacttttcggtggctcatacctgtaatcccagcactttgggaggctgaggcaggcagattacctgaggtcgggagttcgagaccaacctgaccaacacggagaaaccctgtctctactaaaaatacaaaattagctggtgtggtggcacgtgcctgtattcccagctactcaggaggctgagacaggagaattgcttgaacccgggaagcggaggttatggtgaaccgagatggtgtcattgcactccagcctgggcaacaagaacaaaactccatctcaaaaaaaaaaaaaaaaaaaaaaaaaaagtcatacttttgctttgtttgtcatctttaagaagatcatccctatcgaaggtcataaacatattcttaatattttcacgtgtttattttccaaggttaggtcttagaaaattacaaaataaccatttgtaatttcatgttgtgaaaggtggaggaaaggaatttcatcttcttgcccccaaacctaaaacccttacttgaatctgagccgattctccttgttcctttcagttacactggaagaagagcccctccttccttcaagccaagtcatccccttgggctctcaccacttcagtttataccttgcctgtagtccagtctctccatcatcaattccatcagcacaaagacataatttaattccttctaccttaaaaaaacaaaacaaaacaaaacagctctccctctcttagggtgagatgaagtggttggcaacaggccaatgctactttcagaggcgtttgaatcagagtgactccattttgaataggggttgagtaaaataaggctgagacctactgggctgcattcccatgagcttaggcattctaagtcacaggatgagacaggaggtcagcacaagatacacgtcacaaagaccttgctgataaaacagattgtgataagaaaagccagtcaaaacccaccaaaaccaagatggcgacaaaagtgatctctggttgtcctcactgctgattattcactaattataaaattaacatgataaaagacactcccaccagcaccgtgacagtttacaaatgacatggacacatcaggaagttaccctatatgtctaaaaggggaggagccctcctttccaattgtccacccctttcctggaaaactcatgaataatccaccccttgtttagcatataatcaagaaataaccatgaaaatagccaaccagcagccctcagggctgctttgcctatggagtagccattctatattcctttactttcttaataaacttgctttcactttagcctatggacttgccccaaattcttgcatgaggtccaagaaccttctcttgaggtctggattgggacccctttctggtaacactacagccacgctatggaaaatctaaataaaaataaagattgtattttccaaaccatcggggagctatggaagcaacaagggccagaggaagtaaaattctggagaagggaggacagctcagaggtgagcatctgcagatgcctttcccttcctgtcatttgataatcctgggcaaagactgaaattggtgctgagtccagtccggggatgctgtggagtcatcaaattagaggcttgggggggcctcaaacatccagccagcttcctccttcagaggtgctgaactgtgaagctgtgtgatgtgagaggctgacaggctaagctgaagacctcaggaaagtagagtggaatttcccgtggtctttttttttttttttgaggcagggtctctttctgtcacccaggcaggaatgcagtggcaaaatcacagctcactgcagcctggacctctcaggctcaagtgatcctcccacctcagccccggagtagctgggaccacaggcacgtgccaccactcccgggtactttttgtattttttgtagagtggggtctcaccgtgttgcccaggctccctgtggtctcctgagaagacaaaggctcaccagggggtggagttcctgagaacagcttggcaggagctgaaaacgctggagagcaggtgaactgacccctgctgtcaggcatctgcagctgctttttcctgagaacattagctgtgagttttgtgcagctggacaaatgtggagacttgagggaatctcaaatgcgtggccagtaccctctctccacaggctttttacaatttgaagcagttcagggcaggatgctgaagagcaaagccaaaacccccaaaaggaaaataatttcctgcagtctcttagtgtcatgaacaaatgtgaacctgaaagagccaatctttcaagaaagatccctaggccgggcgcggtggctcacgcctgtaatcccagcactttgggaggccgaggcgggcggatcacgaggtcaggagatcaagaccatcctggctaacacggtgaaaccccgtctctactaaaaatacaaaaaaattagccgggcgtgatggtgggcgcctgtagtcccagctactcgggaggctgaggcaggagaatggcgtgaacccgggaggcggaacttgcggtgagccgagattgcgccactgcactccagcctgggcgacagagccagacgccatctcaaaaggaaaaaaaaaaaaaaaaaaagacagaaagatccccagtggctaacgaggcctaaatgtgaaatagtaaaatacagccaagcagccatctgctaactagaaatcacataggtactcctgagttcccagaaatccaacacctctgtttgacttggtgactttcagagcacgcctaaaccaaccaatcagagcccacctgccttgaccaatcaaggctcagctgtatcaactaattggaactacctgagtctgaatctctcatttgcataaatggacctgattgggaacctgggtggaaacttttgctacagaaccccaaccctccctttgtgctctggaacacatcttgttttacactgaagtctgcatctccctggtttgcaaactattcactggaatataaagtctctttcctccagtttcctttccagagaattttgttcacagtgctgagacaaagacctaccagactcttgattgagggtcatactctaagagcagggcaaactagaagcagataggcaatttttttttttttaatatagggtctcactctgtcacccaggctggagtgcagtggctcaatcttgactcactgcagccttgacctcctgggttcaagtgatcctcccacctcagcctcagctggagctacaggcatgcaccactgtacccagctctttttatatttttttgtagagat

SEQ ID NO: 15021 - DNA, 27910 bp, Human; identical to SEQ ID NO: 15020

SEQ ID NO: 15022 - DNA, 27910 bp, Human; identical to SEQ ID NO: 15020

SEQ ID NO: 15023 - DNA, 27910 bp, Human; identical to SEQ ID NO: 15020

SEQ ID NO: 15024 - DNA, 27910 bp, Human; identical to SEQ ID NO: 15020

SEQ ID NO: 15025 - DNA, 27910 bp, Human; identical to SEQ ID NO: 15020

SEQ ID NO: 15026 - DNA, 26276 bp, Human
acaaactttcagtccttaatgggaatccaagtcagggggtcataagttgagtgtcagaagagaaagattaaggaggtattattagtgccggtgggccaaacatgaagtctagacacattacttaatcattacattcattcatatagtaaatattcaccaggtacatatatactgagtgctgggctagtttctgatgatgcagaaatgaatggctttattgtcttcgtcctcaaggccctcatggtctagtgtagaagacagactgtaaatatttaccattcagtacgatgtgtgctgttgcagagcgtggcttgggcgctatggggaaccagagggcatggagcctggtttggaggggcagggaagactttctgaaatatgggagacaagtcgaagcctatctgaccaaggcaccatgcaggaggaggcgggacattcatggcacaaggccagcatggcagcagtgtgaggtgtgatgggtgtgacccattcaaggaactgccaggtgctccatctgaaccaacatgtctgagctgggggcctggcatgagggtcatgcagtcctgtgggtgccaaaacaaggtggttaattttatcctaaaaacaattggcatctactgaggagttttatttgggaagaggtaaaattaaattagaatgggcaatgtatctctggaagcagagtgaagggggagctggaggggcaagcccagaggcagggccaacactgagctgcatggtccctgcgatggacaatctgagcctgaggtaaacgggctgatgtgggactgacggatgcaaggtgacaggctgaggctagggaccgtcatcactcccagtcacactgcaagctgcagcagggtagagccacatctgatttgtccccagtgcctgaccagagttggggctcagtgtttgttgagtgaattcttactgcatggccagggtttctggtcctggcagctgggtggatggaggggtcatattgagaatcctggagtgcagtagtagccaggtgtgaagagtcaagcaggtctgcagcctgaggatcagcatggcagcaggagggtcctctgggagctggtcatgaatttgatatggaccatgggatggtgcccacttttgtttgtatcctggggtacagatcacagctccatgaaggtttgagctaggcaggtgagccacgctgggagcaaagatggtggtggctaggtacttgcttatccctataccaatcagcaggatgtgggtggggccagataagagaataaaagcaggctgcccgagccagcattggcaacccgctcgggtccccttccacactgtggaagctttgttcttttgctctttgcaataaatcttgctactgctcactctttgggtccacgctgcttttatgagctgtaacactcaccgcgaagatctgcagcttcactcctgagcccagcaagaccacgagcccaccgggaggaatgaacaactccagacacgctaccttaagagctgtaccactcaccgcgaaggtctgcagcttcactcctgagccagcgagaccacgaacccaccagaaggaagaaactccgaacacatctgaacatcagaagggacagactccagacacgccaccttaagagctgtaacactcaccgcgagggtccacggcttcattcttgaagtcagtgagaccaagaacccaccaattccggacacagtgctgagaatcatgccttgaaatctagcagctctgttaaaaactgagcaaggtgtacttcggggttgtgttgagaaggttggtgttcagctaaatcaggagggaaggccaaggaaaatcaggcttggcacctgtcaacaggtgggacccaatagccaagcaaatggtcctgcaaactgtactacccaacgttcacagcaaggattccaacttctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttggaatggaccttttcctttcttagcttgctgtagggattgtgcttcagctaagtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaatgtaagtaaggaaaaaggctaatctataatcagagaaacaaaggttgcagctgcctgtttacatgactcaggtcccatgatcaaattcccttaaggctcgaaatattttaaagttccaacagcttagattttgaattgcttattttcacagaatggacctgtgtaaggaggtatgtgtgggagaagattccagaaggtcttgagacactccagatgaaggttggtgtggggctgtgctgctggagcaccagagagtgaaaagaggcaagcgatttatagtctcatcaaatatcgacaagtttgggttttcctttagagttgggcagggcctggctggacttctttctccaccagtctccgggaggctcaaacaagttctgattttcaggttctgaaaaagctctcagggaaaaagcagcttccattctgttttttttccctttctgcattctacttcccttttatttttggcctggtaatttctgtcttatcagcttttagatgtccttgagatttttcttttctttcatttttttttttttgagacagggtgtaaaccaaaaactcttttattctttttttttttcttttgagacaggatgtaaaccaaaaataaaattctaagccccgccctccctgcaaccatctgaatggacttcctcctgggccagggtacttttaacctgaaagactggttcaggccatgatggaaagtagaggtcagacaggactcattatacctctctgatgagaagcatttacaatctattttctctgaagcctgctacccggaggcttcatctgcatggtaaaactttggtctccacaacctcctatcacagcacagacattttctttctattgagcccagatctttagataaacttaaccaattgtcaaccagtcaattttaaatctacctgtaacctgggagcccccaacctccacccaacaattcaagttgtcccacctttctggacagaaccaatgtatttcttaaatgtatttgattgacatctcatgtctccctaaaatgtataaaaccaagctgcaccccgaccaccttgggcatagttctcaggatctcctgagggctgtgttacaggccatggtcactcatatttggctcagaataaatctcttcaaatattttacagagcttgactgtttttatttgttaatgatctcactctatcgtccaggctggagtgcagtggtgcaatcatggattactgcagcctctacctccctgggctcacatgatcctcccttctcagcctcccaagtagctgagactacacacatgcgccaccatgcctggttaattttaaaactttttgtatagatggaggtcttactgtgttgcccaggctggtctcaaacttctggcctcaagtgatcctaccaccacagcctcccaaattggtgggattacagggatacgatttttattttatttttatagagatgggggtcacagtatgatgccctggctggtattgaactcctgtgttcaagcaatacccctgccttagcctctcaaagttctgggattacaggtgggagccaccatgcccagcctgggagaagacttttaaaacatattttgtttaggccagtcatggtgttgaggtcaggagttcaagaccaggctggccaacatggcgaaactgtgtctctactaaaaaatataaaaaacttagccaggcgtggtggcaggtacctgtagtcccagctacttgggaggatgaggaaggagaattgcttgaacccaggaggtggaggttgcagtgagtcaagatcatgccactgcacttcagcctgggtgacagagtgagactctgtctcaaaaaaacaaaagcaaatcatgttttgttgagtttgtttagctgtgtattcacaagttgattggcatctctcagcccatcccaaccccaccccggaatgctcttcccaggcttcctaacaggtattctcctttacctggattgcatttgtagaaaacactctgcttcagtgggaggcaaggaacagaatatttctctgtctagggcatactcttccatgttatctgattccaattctatgggacctattttaccattctgaaagctacagataaccgatagaaatgaaaaataattcttgtctatggatatgcaaatgcttatattttgaagagagacaacccttcctcacttccccccaaatcccctagtttgcttccattttacacattcatttcaatatttctcttctcttccttcttttctttttttttaggttatctccctctgtgccaggccagagtgcagtggtgcaatcacggctcactgtagtctcaacctcctgggctcaagagatcctcccacttcagcctcccaagcagctaagactacaggcacgtgtcatcatatctggcaaattaaaaaaaaattatagagatgggctctccctgtgtttccctggttggtctcaaactcctgggctcaagtgatcctcccatcttggcctcccaacttgctgggattacaggcatttgccactgtgcccagcccatttcaatatttctgatcaataaatgtgcctgtccttcagattctcctttgaattggctgtcacacctcttcagtttcttcactgaggagttaaacataatcttgagcagcacgtgatattgtttagctctgtgtccccaccaaatctcatcttgaatcgtaatccccctgtgtgtcaagggatggacctggtaggggatgattggatcatggggggtggttttccccatggtgttcccatatagtgaatgagttctcacgagatctgatggtttaaaagtgtttggcagttcccccttctctctctctctctctctctctgtgtgtgtttttctctctctcgccactttgtgaaaaatgtgctcgcttttccttcgctttctgccatgattgtgagtgtcctgaggtctccccagcgatgtggaactgtgagttaattaaacctctttcctttataaattacccagtttcaggtagttctttatagcagtgtgcaaatgggctgttacagcacatattcatttttatatctatattgagttatcatttaacctgtttttgaaaattatcttttaacatgcatttttctctttcttattatcttcttttgctaaaacctgttctccagtagcttcctaagaaagggtgcacaggagacccattttttgagcccctccttatctgacaatgtttttgtttgaccctaacctttgattaataatgcgactggatgttgaacttgtgaaaggaaaataaaaactcaggaccccaattcagtatgccaaaaggaaaaaaaaaaaagaagctgaaagctgagtcatgcaagaaactgccttttcttttgctcctaagtagatggctacagataaaagattaaatatctccacaggtagctactccatgttcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctgagtatctggggcaacaggcatgtgcaactatggctggctaatttttaaattttttgtagagatgtgatctcgctatattgcccaggctggtctcaaattcctggcctcaagcaatctttctagattataggacttcttggcttccacaattgcatgagccaatcctttataataaatgtatatccatctgtatatgtcttgtgtctgtctctctacctatcaatctatccatccatccatccatccatccatccatccatccatccatctatccatccatctatctattttattgtttctgtttttctggagaaccctgactaatacagaaggtgagcccaacttctcactgaggattctcaagcctcagcctcttgaagtgctgagattacaggcatgagccaccgcattcagcctctgattgtcattgacagtgatgtgctctactgtgagtctcttttacccactgtgctgggtattcactggccctttcaacttggaaacgcgtgtcctttggctttgcaaaaatatctgtagcattgattgcctgatttctctccctctgatcagggcctctgcagcatccgactccagggcactgttcaccccatattctatgaatggcgtcctctggagttgtgctgttgcacctgcaccttttatttatttattttggaacacattggagtaagatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttccccaatttgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgggcaccatacccttgaaggcttgaatagaacagaaaggcaggagaatttctctcttggcctgaacacttgagctggaacgttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaacttcttgttggggatccccagatatcagcgggcagagtgtctccttttggcaccttcagtttctccagaaatgaacctttccatttccatcctaagggattgcaagagctgtggacttgccaggagggaagggagcagaggcccccacagttcacaatgtaatgtttcccttaaacacagcccccactttcagctgggaacccaccctttccttgccggtgctttgtgtcctcaagactggacataaggtgttgaggtgtggtgtgtggtttcaccacacaatcatttggggtctcctgagagaggtggggggaggggtgtggtctgcttgagcaggtgagggaaatggattggggtgctagctggtaactgtatactgactttcttttgtagaggcagggtctcattctgttgcccaagttggagcgtagagtcatgataacagctcagtgcagcctcgaactcctaggctcaagcaatctacctgcctcagcctcctaagtggctgggaccacaggcatacaccaccatgcccagctaatttattttttgtagagatggggtctcctatgttgaccaggttggtcttgaactcctgggctcatgtgatcctcctgcctcagcctcccaaagtgttgggattgcaggcgtgagccacggtgcccagccagtatactgactttcagtcaacctcatgctttcagtgccagttcttcttggtgcctgatgattgcaaacccaggatttattggagagtctctgttcttgatgcccaccctgcccctccactttcccacacccccttcacctttaccatacactgtcctcaactcttctgaggctgctcccaagtgttgggtgctttgatcctgtctgccattgcctgagctcctgttctctccatccctgtgggtcaacagcttttatttagttcattcccttactatcattttcatagagttgaggaggtagggaggagatagaggcaggaagttattctaccacatttgtccagagtctgccctgtttgggggcatcagtgggcagagctggaaagccatggtggctgctgagatttggaagtacaagaccaggaggaaggaaggaggatgcttaggtatggggctcaggtgtggggttcaggtagcccgtgcatggtgaggaaagggaacaaatgagaagagtgtggtagatggtggtgtgttctatctattttgatggtgggtcaaaagagggaggtgaggaatgggttgagaggatttggccccactttgaatgcagggcgaggggaaaccagcatctcagatgtgcctcagtttgtgcagggctaagtgggacccagagcaggaggggcagacttggacgggaggccagtgactctggagtttgcagtgaatatgcagggtcctgggtgtgatgcttgggttgtttatctggcctaggggaagcgaccagaaggcacgtgcctccagtccagccaggctgcaggtgttaaaaatctctgcagtcacattttctggcttctctgaacagcccctgtaggtgctcacacatgtacacatgcatgcatatatatttatatatatatacatttacatatttatatatatttaaatatatttaaatatttaaatatatttttatatatatttatattttatatatgtgtatgcatacacatgcacacagatgtacacacacatatgcacatacacatatgcacacacacaccctacaactcagacctttcctttcagagctacccctgaccgagacttccttgccatgttacaaatgagcatctcttttagagtagtgtaatagaacgtggcacttcttgataaaaatagaattctttgacttctgcccaggctgcctggtgggcaggctcacagcctcgttctttctcagctttccacgttattaatttttagtgccaaaagacagttctgctgctccaggcctccagctgagctctgctaggttggaagtcccttctcagcctgattcccattagcacagagcttggagaagacccttcctcactctgatcctgctgcctggagctggcagatgcactcctcacccagcagccaagacccatgctcctggtttagaagggtccgtcctgacagctatctccactaggcagcccagggttcctctggacacaggaccctgccaatttattagtcacggtggcaccggatagacacagcttcacccagtgatctgccggcactgctctctcttcctccagtcctgggcttcttcatgtccaaaccacgtggagaacaagataactaggatcagctcttttggagatagaagtcaccttccagcctgggatcagtggcatagtctcagcccaggtctggagacagggaggctgccatgcctgccagccccatccagccccagctggcagcagtgtgaaatagtgctcgctaaaatgagcctgctgtttgcctagatgtgtgtttcccaataattcagagacctagataatgggaaaggcgaacatctcgtatcccccacttccctcagcaaaaagagaacagtgccgcagccacaggcaaggtgggttagaaaacctgtctgctggcagattattgtctgtaacttgcctccttagttcttccaacactctctccttccccctcctcccctcccatggtccaaccctgagggttccagcagcagctgggaggtctccgatgttatctcagagctcccaatctgctgacatttgaaaatcttctggctataacttgctcacttagcggctgctgctctgcagccctgagccctcctaaaggagaccctacacagaagagtacaatgtaaacagccgtcgccagagtccccccagccagagatagcccttgggtacattttgcaatattttgttttgtttgctctcagaccggacttgcccccctttttagcacagcccaattctactacgtatactccctccttgttctttttgtttggcattatatcctaagcatttccctgcatcatccaagctctgtgggatgtcatttttaacacccacacagcgtcctctggtgtggttgtatgacaagtcacttaactattccacacccaaagcctccccttttccaaactcttccctgggacctcctgaaggtaacagcaagatctgagcagcgctggatggatcctgctctcagtcccctgtctgggaacaacgctgagccttaacagggatgtcagcttcctagggctgctgtaacaaatcccacaaactgagtgccttcaaacattgtctggtagttctggaggtcaaaggtgcagaacgagtttcactgggctgaaaccaaggtagggctgtgctctctcctgaggctttaggggagaatctgcttcctgaacttttctagcttggagagctgcattccttggcccttcgtcccccttgcttctcttccaagccagtagtgtagcatcctcagatctccctctgctttcgtcttcacgttgcctttccttttctgcagtcagatgtccctctgtccctcttataaggacatttgtgatgacatttagggcctatgtgggcgatccaggatcatctgtagatctagaacttaaacttttttttttttttttttttttttagatgtggtctcactctgtcacccaggctggagtgcagtagcaccatttcggttcactgcaacttctgcctcctgggttcaagcgattctcctgtctcagcctcccaagtggctgggattacaggtgtgcaccaccatctccagctaacttttttgtatttttagtagagacagggttttgccatgtaggccaggctggtctcgaactgttgacctcaggtgatctgccttggcctcccaaagcgttgggattacaggcgtaagccaccgcgtccggccacattattcttatttgcaaaacaaatacttatctggcatcaaacagatactttgcatccggcaaaaacaggtggaggtgactgaaggcgaatgtgggaggtcatggtgggttaatgatcgccagcgctgtccggtgaaatcaaccacctgtgacaaaggtggtttttcacttttactgaacaagcatgctattctacagtaaactccttaacaaatgtagcttttcaaggtccttaggactattacctttcaatattattgggaagttctttgctcttcttagcagactgcgaaactcaactttgtgatgacaagatacagaataaatgcatattaactgaaattctaggctcacacctatgtgagcttttctctctctaacaagatgtcagggccggttcagggagttcatctccagccacctgtgctaatcatcgcccatcctttccaagtatctaatgacactcccaaccaaggtctctataatttccagccaaaaatgagttacaacatatggaacatctaattttctgtttccattctagttattttattcttatgagcttgtgggctccatctaccaacctctgggcaaatgctcatctgacttccatagacacacagcaagcagacaaccacacaaagaggaagagggagaatatttaccagccatggaacatctgctctgtgcttatatctcatatgcattatctctaattatcaaaagaaggtattattattattattgttccgcattcacagatgacaaactgaagatcagattggttaaatacttgtccaacattaacttagcatttgggcatcatagttggaattaaaacttgggtctgctcatctccaaaaacaccctaagccttaccacactcatgggacacagctgcagctgcaggttctgaaaggaaaactaaaacttcagaacccagttcactatgccaaaaaggcaaaaaaaaaaaaaaaaaaaaaaagccaaaagctgagtcatgcaagaagctgactttccttttgctcctaagtagatagctacagataaaaggttaaatagctccacaggtagctactgtatgttcaccttatcttacgtaaactgctgatttattgagcatgagacaaatacgtaattgactatcccctacctactccgtttcctttgcaacatgtggattcagtcatgtgaccatacactgcctttctcctctccagcctacttttccactttaaatatcaaagccctcaaaatcatctttggagaaaggcacagactagcgactgtttctgtgatttcgtgtctttttacttccagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgcggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggtgaggcctggaggtgatgtgcttgagattaccaggctcttctgaacctgggggaccttctcctatgatagccctgctcctccagacccagcaggtgatttccccaaaagccgcttacagtgaacgcacctgatagcaataacttaagcatcccctgagaatgacccttatggcaggtgcaggtgaatgtggtttggagttctgagctaaggaatctgggagtggccaacctggagattcattcctattccttatctatgaggaacatctgagctcctgtcccgtcctgtgcaacacggacagtacaggggatcaaggccctttgttttgggttaggtaaatgttgccaggtggacactgttgggggagggtgctaagtgaagatgctatatatgctgcaagctttttgtaagttgtgtggctctcctgcccagcccaccactgctagatgctctcccctgcatgtaagccccagtaaaactccatgtctccttcagcagccctgggtcctttcttcagcctctcaaacctgctgccatccccattggagtagataggggttcagcataacagcagccaccagctggggaaaggcgtggcatttggagctccctacatggtcttgactctaatatggagggaaagaaaacagattctgccctgctcagtaaagccccctactggcctcccaccctggactgtggacaaagcttttttttttttttttgagacggagtctcactgtgtcccccaggctggagtgcagtggcgtgatctcagctcactgcaagctccgcctccccggttcacgccattctcctgcctcaggctcccgagtagctggggctacaggcgcctgccactacacccggctaattttttttttttttttcatttttagtggagacggggtttcatcgtgttagccaggatggtctcgatctcctacctcgtgatctgcccacctcggcctcccaaagtgctgggattacaggcgtgagccactgcgcccggccaacaaagcatatttttttcctctgaggtctttaccctataactgcaagtggtttcatgacactgcacatgggttcttatctggggttggtagattcaactcaattccacaggtttactgggtgttgcctcccatgcttggagccaggaggatgcagggaaatggggctgccaccatacccgctcttcttatgatcccatcacatcattgcaccctttggggcctggcaccatgctctggcactttgcctccatcatctcctttaacctctgagctctgtcaggaaggcattactactatccctggaatacagacaggaaaactgagttggattgaggctcagagaggttaagtcacttacccaaggtcacaaagctagagagtggcaggccagcatccaaggccagcaacacgagctccctctgatccaaatggtgactctatgtttgatcagtgctctgagaactctccaaagatctttatcaactgtcatctcttcattgcccaggcccagtcagggagccacttggctgcggtcccgctgagatttaggggcaggacccctgatgtgaggtggaatgcttggtcacgctgttcaagcctccaccagtcactcctgactggttatggacactcaatgtgccccgtcctgtgtgcaatgcagtgtgggaaggggatcaaggaccttggctaatcccaggcatttccccagaatgtcccaggtgtggaccccttgggaggtgctgggaagcaggctggtgtcccacaggccttggttccatcccagctgtgctgtgctaagctgaaactctttgggcagcttgtttcacctcatgagacttctttttctgaactgttaaatgggatgattcgacctctgcttggcttttggtgacgattaaacgagatattagctgtaaagcatttcatcccgggtctggtatagaagaagcacttgataaatgaaagctctgttgagtatgatgatccgtcaccccaggcatcagtgggatctcacagcaggaacaatgcctaactcctaactgatgcccagtaaacatcgggtggatgcaatgtccaacaagacagatattcatgttcagttttacagaaaaggagacagaggccagaaaaggaagaaagtgcccaggtcagccggctagtaagaggcagagttgaaatttgaaccgggttctggctggctgcagctccactgctccactactgcactgtctgagagccaaaaggcaccttgtagtcaggcaggcagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggcctatgtctgcacgtggtgaggcccctgctgggtattgtaccacaccttcattgtgctcagggtggccagtggaggcccttcccagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggctataactgctgcaaagatagagaattgcaatgattaatatgcatttatgtatttccaaaaagttaccagaatatcaaactcatgattttgtctatagtttggttagattcaagctatttttatatcataaaacaacttaaaatttttttatttttaatttttgtgggtgcagagtgatgtatttatggggtacccgagatgttagaatgaagctattaaatgtgagtgtgaacgttcacctttttgcagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatgggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaatttctttgggctcttattagcagcatccaaatctgtgctggtttcttctcacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcccaggggctgtctaagggctcatctctcccaggagcccctgtatcatctcagtaactagaccagtaccatatccgacttcccctgactttgaaataattttcacctgcaatcaggtgcgcttccctagaacctctctcgctgttctttgcctttctccttcccccgccttgtatctccgtggtcctgccaaaaatcagaagctcattattaaaccagaagcttccttgcattatcccagagactacagacagaaaatatttgcttctatctcaactgaggactgacatagtaaagactccttgagatgttagctgtcaaggaggggaataaaagtttttcatctgcatgagtaattgtttcctgttttatccagagagacaacagatttacatcccagacacattcacactgggccaagagcagctgccattgcagattcgagtcacgtccttttttccttccttctccttcttggagttacaacagaagctggggaggtgagagtgcaggtgagagaggaggggggctctggaacatgtagcctgtgaggagggaaatcaggatggtgcttgggtggaggtgggagctgggccagggtcttggctggtcaggaaggctggtgaagcatgtactggggaggcagaggtcctgctttctttcctctctttccttcacacctacctcaacccactgtcgagtcctatcagctctgaaatagatccttcctccagcgccttctcacctctctctccaccattccagtccatgccgcctcatctcttactgggactttcacaacagcctcccgagtggtcttggcttctgctcgcaaatcctgcagtgccttctctgcggagccacaagctggatctttttaatccgctctcggtttctcacagcccttggaatgaaaccttggcctacagccctgtgtgacttgctgcctgtccttacctcctaacctcatctaatatccccttcccctcctcgtaccggcctttctgtttctcagacactccaggcttgttctgctcttggaccttcacgctgtctttctgtctcctgggaatctgtgccccctctgccagatcatgcagctggctctctctgcccaaataccctcttccgaggggtcttccttggccctgtgtctgacataggtaccctcctccatcactccagcccattacagtgccataacacttttattgccatctagagtaacatcagttggttttgtttatcatctgccaccctgctagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggtaaatttggtatcttagcaagtgggtgactaccactgtctgggggaaagctgatacacgaggacttgacaataattacagcagtaacaatcgctactattttgttttgaaatgaattttagtttctgaaattgtccaaagcacttttatcaatagaaacttgttacacatccctccaacagggagaagcagcacaggaagctgccccctcaaacactaaaggctcctggagctattcacagtgctggggaacaaccagaggaggaggaggacagagggagagaatactttttttaaaaatcccaaacaaaaccaaattctatacatgtatatctcgagtgagtaaatgtgtaacactcagcagtctcctacacttgccaggttttgtggcttcatgcagtaatataaaatgtgcttcacaaagctaggagttggcacagaatatagggttctgattcatattttagttttacttttttgtagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcacacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactagtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagtccagctaacatactatataagccagtgagaccagccagtgtctgttcattgcctctgccttgcccctatgcctgcccgcctcctatagcaggtccctatagcataatgaaaatgcgaacaaccttttctctggacactggggaatctagtctggtggataaagatggatggctgttaaacgatcacatcttgggctctgtgtgttcagtgaagcctcatttaccagatctctctgatgagaaaggtgaatggtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttactgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttacaactatacaaagtttgtagtcttttcgttataccttttgacaggtgagttacttgctggaattcacgtggctagtaaatactggagctgagatttgaaagcaggcaatctggctccagaatctgtgttttcaacccacatactatattgaccatcatgaaaagatggtggtgagcaggcttgtttctaaggatgggagggtcctcataatatttgtatttacagagaggagggagaggtgggttacttcctctcccaaccccagaaagccaggcatgttggctggcatccctgggacctcagatattcaagcaaccatggccttacaaatcaggcattctatttattagagttgtgcagtgaggtcccctccatttcatccccagaatatctcctagacaagttggatcctgcagggcccgagtataaataagatggtgccctctgttgttatggagtagcttggagctgggccccagatgccctgtgtggattagatgagtgattagtatttggcaatgtagcttgagaggcttgctgagttactggggcatatgtccccagctcacgagtaccagcctgacttctgtcaatcaatcagtgaacagggtttgcagcgtccaccaggtacctgtggtgtagtagaagagagtttgaactttggaatcaaacatgctgaagttcagattccagctcctccactaactacctctgtgatcttggctaagtgaccgtcactttttttttttttttttttgagacaagatctcattctgtctcctaggctggagtgcagtggcatgatcatggctcactgcagcctcaacctcccgaactcaagagatcatcccacttcagcctcctgagtagctgggaccatggggcacctgccatggcatcaagctaattttttatcttttgtaaagatgggatttcgccatgttgcctaggccagtctcaaactcctgggctcaagcgatccacccacctcagcctcccaaagtgctgggattacaggtgtgagccaccgtgcccatcctgatggttgctttcagagccttggttcttcatctctaaaacaaagataggaatactgcctagtttccatggggagcttgtaacacatgcgggcctctctcccctcaccccagtctttggttagacacttactatttgcaaagacccaatttcttcatcataagaaggctgccaccacacttgagggagtgacccatttacaaacaattgcttccttctgg

SEQ ID NO: 15027 - DNA, 26276 bp, Human; identical to SEQ ID NO: 15026

SEQ ID NO: 15028 - DNA, 26276 bp, Human; identical to SEQ ID NO: 15026

SEQ ID NO: 15029 - DNA, 26276 bp, Human; identical to SEQ ID NO: 15026

SEQ ID NO: 15030 - DNA, 26619 bp, Human
gttctctgggcttggggaggaatgccaagagctcagactgactcaccccagggggcgggcctggcctcttggcccacgctggaaggagagaggcctgaggaggtggggccctggctgtggctgggatctgtttcttgcctgccctgggaaggtggctggagcaggttttcattcttttctgcagcctggcttctggaataggtggctggctagttaacctaagagattgggcgctggagctggagaaacctgcttttgagggttcaaatgtaagcttcaccatggatccttggccaagcggtgactttactcctcttagctttggttttctccccagtcaaatgcgaatcattttaatacttccttcctcagagggttgctatgagcattcaactatagcattctggtttagtgctcagcacaggcctgtcctgttcctccatttttcatttattaaagtatagatgaggacatagatgtaaatagatgtattgagaatacatactgggagatacagacatattcatatccattcatccacccacccatccatccactcacccacccatctgtccacccacccacccatccacacacccacccttccacccatccatccacccacccacccatccatccacccatccacccatccattcatccatctacccacccacccatccactcatccatccatctacccacccacacatccacccacccacccacccatccactcatccatccatctacccacccacccatccacccacccacccacccacccacccacccatccactcatccatccatccacccatctatctacccacccacccatccacccacccacccatcaattcatccatccacccacccacccacccacccatccactcatccatccatccatccatccacccatctatccatccatccacccacccacccacccacccatccacccacccacccaccaactagtacgttctcctcctaggttcttggcactattcctggtctaggcttacagcagtacacaaagcgaagcccctccttcctgggcttatatgctagtaggttaaagatgaaagaagataaaccaatacaagctacatataatgtatctgaaagtgaaaagctctatggagaaaagcaaagtaggacagagaaagcaaaggtgacagagaatgagagagagggaccgggctgggtactgctgttttaactcttgggaggggatggggtgggttaaagaagcctcccagaggaggtgacagctgagtagagacctgcaagaagtggagaagggagacatgcaggtaactggggaggacagacactaggaagtgcagatgctcaaaggtaggagtatgctgagtatatctgagagacagaatgttctagaagtgtggctggaacagagtgaatgagggagagttctagaaaaggaccccatgggtagatcatggatgtcttaacgactatgttaaagatcataaatgaattccaaagtcaatatgtctaaacccttcaggtactatatcctaagcttagcatacatgatgccttcatgttttggctgacatcaaatgtacaaagaaaggatatgctttaacaaaggaaacctcttataaagaagtttatttgcccatccctttataaaaggataaagaaaaccaattctcatgtacctgttctccttataaggacaacaggcagcctctggcttcctgtaaggagaacaggcctctgtcccttgattcatgaaaacgaaatgtgttgttagagggaaattagctcaaatgacttagagcactttcacaaggcataacatttgtacgtcattgattgtcaggggtgatggttccacattttagataacaacaggtgacacaggtgggcagagcatgtcatatctcagtaccatgaaatcagacctcctcttttgaacagacatctcccctcatcacagtgacttctctctcttttgcctgcagcccagcgatctgctcacgagctgcccatggttgaaagacaagacacagacagctgcctggtctatggcggccagcaaatgatcctcacggggcagaactttacatccgagtccaaagttgtgtttactgagaagaccacaggtcagtggatttttgagctctttctctgtcccccagaatcatgcaaaagtgaccatctctttattatatacaactttggttttggggggtagatcccaccgtgcagttttataccctgctctttttactcagcgtgtcttcagggattgtgatggccataccattcgccattgcatgaatgtgccattctacattttaactcttctaggtcattttgacagaaaatgagattatctcccaccctcaatcctttttttaaaattacttttttacataaggaaggaaatttttaaaactttttgctattatcaagaagggaggccaaacagcacagtgataaagcatgcatactctggccctggatatcttgggttcaaattctgggtttgttatctgcttgcttggtgatccgaggcatattacctaaccgttaaaatttcttaccccataaagttgtcatggaggttaaatgagctaatacatgtcacgtaattataatagtgccaagtacagcataagccaattaatattggctacttgtatttttattataagtagttctgcagtgaatcagcttatacttctaggattaattaatcttgtacatgaatctatatgtatatctttttagtttatttagggtttattcccagcagtggaattttggatagtcattctgaggactttaaatacatattgctaaattaccttccagaaatctacaaattgaagttgccatcatgtcagtcatagtttcacccccatcccagaaatgccatttttttaaattaaaaaggaatcattgtggaattggtacttctttctactttgcatttccttgctctgagacgcataatgttttgtttattcaccacgtgtattcttcctttggtgtactatcggtgtctttttcagtgggtatgtggtagaaaagatgctgatctgaagtaggaaaatatcagattaagcaataattaatgaaacaaatgtgttgttagaaggaaattagctcaaataacttgggacacttattttggatactagaaccaattttccttttccttaacagacatgatttcagtaggttacttcaaaggggtgttgatgtttgtctatttgtttattgtccttagaacaatccgagaatataacaggtgagttgtccagttggagggattgtgcactgtacaagggcacctcctctgagggctgccattcaaattggatacatcaccagtttacacgttagtaagacaacttctggcagggggaagcagactgtcttaggcaaagagtgcttcttccagtctcgcacaaatcatccttctgggatgggctggacatgtgaccggggtgtgacaactgcattctcacagttggaagcataacaagaggcagaatttattttaaaagggtttgatgacgcctttgcgaaaaataacaaaaaaggtattaagtaaggctgtggcagtggggaagggagatgcagggatgggtcgggagtggtttagaaggcagatgtcactgaggtttgatgggacgtagtggtgtagagaggcattaagaacgcaggtggcagggccagccaccaggagggctgcgtgccacccgggcagctctgctgctcactggcagtgtcacctgcggaaactctccatcatctatcccctgaaaagcagggacagtgacagtgcctacccacaaaggtaaggtctgaatgaattagagcaagtgggcttagcaccggaagtgctcggtaaggggcaggggctgctgctgtttttctggagctgctgtggatggggaaggggaagaggttgagtgtcgagattgttttgttcacgtggtgcacttggccagctgagatttagcacacaggagaggaggtctgtgtggggatgaggttgggcagggaggacgggtttcattttggaagtggaagcgttgagtctcatgtacccatgggccttcttggatgaaccatgatctcacctctgtggaaaggcaagagattggtgggtatgtggccacgtggtctagactaagaaaccagatcctggctgcagatgttgtcatgggagctgtcagcaatgagatctgaggtgaagtcctgggaattggctccgacctcccaggatggcctccagtgggagaaggggaggcttagagaactgagagccacatcccttaaaggtggcagaggaggagctgtcacagcaggaggaggagaaccaggggagtctggtgccctggagaccaggggaaggagacttgggaagggtcagcagaggcagtgctatgaaggtcacagagcccgaggtcagcctgagagtccagtgattggggggcctctggtgatttgaatcacacgtacccaggtggcagtgagttgaggagtgagctgaggagtagcgttgcttgagggatcagagatgatgaaggtaaagtctgctctaggcaagaagactctgcaccagcagtccccaacctttttggcaccagggaccagttgcatggaagacagttcttttcaagggttggggagatgggctgatggtttcaggatgattcaagcacattacatttattgtgtaccttatttttatgattattacattgtaatatacaataaaataattatacaactcaccatcatgtagaatcactgggagccctgagcttgttttcctgcaactaggtagtcccatctgggggttgacgggagacagtaacggatgatcaggcattagactctcctaaggcgtgcacaacctagatccctcgcaagcgcagtttacagtagggttcatgctcctgtgagaatgtaatggcaggctcatctgacaggaggcagcgctcaggcggtaatgcaagtgatggggagtggctgtcaacacagatgaagctttgctctctcgcccgccacccacttactgctgtgcgcctagtaccggtctgtggtccgggattgaagacccctggtctataccacatttttagcctcagcattattgacagtttggcccagataatgacttggcaggggcgctgtcctgggcactgcaggatgttcagcagcatccctgacctccacccacgtgacaccagtagtgcggcccaagttgtgacaaccaaaaatgtctccagaccttgccaaatttgccctggggggcaatattgccactggtcaacaactgctggtctacagcttagaaattttcaggaaagacaaggaaaggaaaagagcatgaggaaaaatcagaatcagggtcaccttaagccttcccctctgcgtctcagcagttcaggcccagcatctgcttggtggaatgcctgcacagctcccccgagctgtcctgcaaagtggggtgcagggagaaggcctggcctctgcctgctttgccttgaggggctgatccagccacacagggctctgttgactgagtggtttctatttacactgaaatctttttgttgctgatggaactgtgcaggaaagagtttgaggctggatcctaccaagttccttacggagttaggagtcagccagcttttaagcactctgggagtttaattattctgaagctatccaagggcatcaattaagcatttgtggaatgagtgaatggcatttattctctagcttctattctcttggtttcagaagaaatttcatatttacctcttgaaggcaggaaaacacagagcctgtttcagctgtgaaaagttggctgttaagaacaagagtaataatcacagctcctattattggccactgtctgcaggcagccctgtgcctgccactttccgtgtgtggtctcatctaagctggcacccatgggaggcagacagtttagcttggagaatccaggggactcgtccacaggtgatattcagcattgacctgtcattcaacctctttgggcctcagcttccctgtctgtaaaatgagatagtgacagtctttctttcctggagttaaatatgtaaataagcagcatgcacttagtgctcatgggatgttcatcgttattttttgaagtggggtctcactatgttgcccaggctggccttgaactcttgggcaacatagtgagttcaacatagtgaactccagtgaccttcctgcctcagcctcctatttgggattacaggcgtgtgcttttgttattatttttatggtcttgtgatattcattactcaggacatagtcatcattcagttgatacatgctgccccaggtgctggcctaggctgggagagatctggggggctgtaacccacagcggtcaccagcacagctctgaggtcggatggcctgggttcaaatccctgatctgcatttagtagctgtgtcgttctgagtaagttacttcacctatctgggctgacatttcctcttttgtaagatacagatgatgatttacttctcttgggaggcaagattaaatgagattatacacgttgggtgctttgcatagggctcagaacattgaacatgctcattagatgttagctcttttattatcatcattatattttggctgtagaaaaacaaagacaagtaagactttatctcatggaaccaagagacattaaaaaacagtagtaagtactaataatgaacgttattagtaattgagtaattagtaattagtagttcattaataatgaactatgtgccaggccttattctaagcactttgtatgtgctaactaatctgatccctcataagagcccaaaagatagactactgttttctcaattttactggtgagaaactgagcacagagaagttaagtaacttagtgaagatcacacagctgataaagggcagtggtgggatgacctcaggcagcctggctctagaccccacaccttggactctgctgttctatgcttaaaaagcttagaaccaggttaattttgcgtgaagacccttcagctgctctgagccacaggcttacccattttgtggcgatagagatccttgaattaaccactgcaccgctctgagcagcagtttgaattctctagtgtgtttccggcatcaagaggatacatttctgacccttccatgcctaactgaagaatcccaggtgaatgtagttcctggattaacgacaagagacaatcgggggtgttagggacacggtgggcttctctgcgggggatgtctggctctgagggctctctgcagagagggggctcgccttgcatttgctggtcctgctcttttgacctcaagagctcacctcccagcccgggacgccttctgcagggggaatccctgttgctcaacttcttttttccaaaactcatccccgttcccatctccatggacatttggccagcaagggctctgcggggcggggcggaacagttgaagttttccaaggaaggggaatcccagctgtttctcacattaaggaaaggtgacagtctcctgggctaatcttagccccgagtttggtcatcggcaccaccagctccaatgttctttttatagctgtcgactaaaatggaattggcagtttccactccagcaagatgacaaattggagagcagtggaaaaacagtaggagaggggcagcgtggtgtttcttaagttagaaaagcttggtgttttggaaaatggcatcttatttatagcagcaataataataatgattattatattatttgtattactatttttgattatttttgtgactttcaagagcctgtgtgatctggctctgacctcagcttttttgactctctccctgccacttggccatagcaacacctggcttccctctgtcctcaaacaccccaagcccatttctgtctcaggaccttggctttctccgtttgctcttagaatgttcctccaccatttcttttcttttctttttttttgagacggagttttgctctgtcgcccaggctggagtggcgtggcgcgagtgcgcgatctcggctcactgcaagctccgcctcccaggttcacgccattctcctgccccagcctcctgagtagctgggactataggcacctgccacgacgcctggctaattttttgtagtttgtttagtagagacggggtttcaccatgttagccaggatggtctcaatctcctgacctcgtaatctgcctgccttggcctcccaaagtgttgggattacaggcgcgagccactgcgtccggcctcctccaccatttcttttcaagcctgcggcctcctattcctcccagtctcagctcaaaggtcacttcctccacggggtcctccttgaccgtcattctgaagttgtcccgcttcccagacaccttgtcaccttctgtgccactgcccggctctgttttcttgggggcacttagcgctgttgaaatcacctaccttgtctgtctgttcatttatcacctggtctctcatgctggactcttagttccttgacagcagagtctcagcgtttgctgctgtatcctcagcatccagagtggtccccggcacatagcaggtgctcatttgtgttgttgaatgaatgcatctcttttagttgtcactccagccctgagaagcgggcagcattatccccattttacagatgaggtaactgaggctcacagatgtcaagtcatgcaccccaggtcagcccacaactggtgacagaggtggaatcccaaggcagcatttgtcgtcaactcgagtaattttttctagtcatgtcagagaggacagagaaaccaaacagaacaatcagggtctttcctatttatcattctcagtaattgctgaaaagccatttggatgttctctgaaatttaaaaaatgtgtaacccttcaggcaaagttcacactgggaagtccaggctgttcctgacttcagtgggaaccctggcccttggccacagggcctcaggcggagtcgggggtcccagcaaaacattgcaaaacaggaaaaaatctaaggacacaaaaataaaagtgatgtggcagcgggaaaggggttgccatggctttgagcgactcgctgcgcctgggtgggatccaatgttttggaaggttccttcacatgacacagagttttggaatttttcggctggtaaatccttcttaattcaggcccccaggcttggccaactagctccctggctctgtgtgtcctgcgggggcgtaggttggaaactggcctgcatcagattactcagctttgaaacttaaattgtttgaagagaattttttgttttgttttgctggacgattttcttggaacggtctgatggcagaggctcccatcacctgtccagaggacaaattgattttttagaaaggacgcgtgggtggtggaattccctctttcccactgagtcatcatatcctgacatgagtcattttattacttggaggtccccaaaggttgtattttgagctttgtttaataaatataaatgcatatgcttaaaataattttttttttttctaaattaagtatttttccgtgaatttgtgccctggaacaatcggaaccatcttagagcagacacctgctcttcccacctgtttctctccctgggtttggttgtacccggcgtgatgttctctgaaacaatagacctggtatgggagtctctagatggggcttccctctgggaaatgtcagactccagacagggctggggcatgactaaggctctccggacctttgccctctgtgactcatgtccctggtgtcagtggccccccgggctggagcccatcacttacccacagctttgctgggacacgaagctgctctccaaagatgcgatccagattgcaactccgaagctgccgtggagatagagaaaatggtctcgttttcagggatctaaatatttgcctaaacttggtcccctgcattgaagaacaggcttttaagtccaagaatcctgcagttcattccgtttgcatccatttgaaggaggccacagagaaatgagtttttagttagaacactcattgtgtctaagcacttccaccatcagaaattgttcctggtaccaaaggcctttgtgtaattcccacttcaaaggctggattttgaatcacccagcagactcggcctgaagcctggattggcctcacactatgtaccttgggactcagttttcccatctctgagatggggttggtggtgtattagcaatagaaggagatcaaggaactgaaagtatcaggcacatagtaggtgctcagaaaacatcagctgcccttctacctgcactctgggagcctggttgacttcacacagggttcagagggcagagccatgttggtttcttgtctgggagaagagtccttcttggcgaggtgaattcctctcctgtccttaccctagacccatcagactcctggagtcatagcctggcagctggagggagggtaactcatggtctgcttcctccccttcccattttacggatggggaagtcgagtcacacagtgtggtcactagacttctttgaggtgacagagttcatcagtggagggctgggcctgaaaccccaacttcctggttcccagagtagctggctgtctgaaatgtgtggggatcatccacagatgacagcttagggccgagaagagtcacgtctagggtgggacaggggaggagctgaaatccgacctctgtgtaagattgaccttgactgagcatccaagcgtgccctctcaggcttgctccactcactcagcccccggtgcttccatgttcatttcccgggtgtttattgagcacctactatgtgcagtgccatgccaggcacaggggacacatggcaggtgaggtccctgcccttgggagtggacagtctgaaacttgtttataagcaggacactttcagatggggaaaatgctatgaagccagggaagccaggtcacaggcccaagagagaaaagcgtgtggagttaggggggaaaatataggatgcgcagtcaaatttgaatcccaaacagtgaatttctttagtaaaagtatgttctatacaatggcaaggagtttgggacatacttgcagtaaaaaggtattcgttgttttctgcagtccaagtttaactgaacatcctgtatttttattggttaaatctggtaactctggatagaggagtcagggagctcttgctggaggagatggctttcagcagacccctgaaggtgggaaagagagagccacaaggactgctgggagagtgtcccaggcaaaaggagctgcccagtgccaaggccccagcgtggagatgagcttagggcatttgaggaatgggaagcaggcccgggcggctggtgcgtcgtgagagtgagagcccagcctggagaggtgctgcggggggcaggcccagctgggccctgcagtcatggcaaggagtttggattgaattcccaaagcaacaggtagttgttggaggtttttgagcaggggagtggcatggtctggttgatgtttgagtgctctggccacctgtatgaacagtggacttggtggggggcagcactcggagaagctgggaggtgagtgagcagctggaccagttgtcccggtgggggatggttggggcaagcccaccaaggaagtagtggggcaggagactcgggaatcaagggacttcctttctagatctcagtaaatccatttgagcagtgttaccctgtcgggcggctgaaatcctaagctgggggggccattcctgaatctcccccaccccacccctgtctgctgggctcattaagcccatgcttccagggaggacacgtttttctgctagttagcagtcataaagagcagactgaaatgacttcaaccatttttatttggctaatttttaaaagcacggccaggactgggaagcatcatgtgcggtttcctaacacgagctgacactttgatttcctccccattcgcctcgagcccagtggcatgctcacagcccgggtgaggatggatttgccttcctcctcccaaaagcttgctcatttctcccagagtgctgacatgagcccgcagctcctccaggctgactgctaagactccagccccaacccacggccaaccctactgcttcctggctgctttgttccatcacagggttaaataattgcctgcaaagagaaaccaggaaaccaacgaaagtataggggccatacatcagcaaacgggctggttagcgatgcccattcttcttgcatctagtaggggttttcttctggagttgactctgcagtgaagataaagcagaggctataatgtcaggtgggcgtggtggctcatgcctgtaatcccagcactttgggaggccaaggcgggcggatcacctgaggtcaggagttcaagaccagcctggccaacatggtgaaactccatctctacttgaaatgcaaaaattagccggccgtggtggcatgtgcctgtaatcccagctacttgggaggctgaggcaggagaatctcttgaacctgggaagtggaggttgcagtgagctgagatcgcgccatggactcctgcctgggcaatgaagtgagaccctgtttcaaaaacaaacaaacacaaaacaaaggctatgatgttactttagccatccccccaccctattttttttgtttttttttttaacttgcagagttgtgctaagtcttctctagacctaacccttttgcccaaagtggttggctcctttctcttcccctctgactaagacttggaagggctgttttcacaccggctgccagtccttgttaattttggatggggtaattttgcctgaacatctgctcaagagaccgaagtcctttatttcatctcagcccagagcggtagaagcatacttggtcttctcagtcctgttccacgggggtaggtctgcccagagtcccagacccaaggtgtgggttgggaggtggattatacggaacttctggtcagtggcactgggaatgctgtctgggctgtgttgctctgattgtgtttgattccttgtctgcacccatattcccagctccttcctcatcagctgattcccacaaaggatcccgtaataagggcttggtgattcctccttgcagggtcctgcggctggagaggtcagtggtcagatgtttcctggaccctggctgtagggtgcacactggaggatcctgaggtcaatttgtttgtttattcagccagtattaattgagcaactattatgtgccagatgctgtagagctaaggataaagcagagaatgagatagctatagccctgctctggggtaactcacagcctgaggctgggtggagatagcaaaccaataggtagctaaaatgatttcaggctggaagggaggagtagaaagttataaggggatggtgtaggatgaagggggggtctccctgagctgcacctgaaggatgggaaggggatggtcacagaagagctgaagaaaagcatcttgagaggtggcaacagcaagttccaaggcctggagataggcaggtgtggctgttggagggagagagaaggccagtgtgtctaatggaatcaggggaggaaagctgggtagagaggctgggtccccacctcagtagacataagcaaccctgagtccatgtctctcttgagcctgggtggaatgttcggccctgcctccctgtttgggggccccggagggctggaaggcatacatggtccatctctcggcctggggtacagctgtgccggagctgagtcagagctgatggtccatgcccagcctccctctcaggctgtggccccggagggctcccaagagacaggaaagtcaacaggcagttgcaatgtgcctttttcttaagaaaaaaaaaaaaaacaaactttatttaaaaataataaaaatataaacaaattaaagtcactgtgatgttacatgtttcttgaatcagtgaagaaaggcatgaaggtctcacctcacgcattcaggcccagccctggaggtacaaccatatgagtagcttggggcacaggctttctaagtttaagcagacttaagaatagacttacaaagcggcatcatgcggtacatactggtctgcagcatttttttaaaatctgctttttattttattttattttactttatttttttgaggcagaggctcactttgtcgcccaggctggactgcagtggtgcgatctcagcttactgcaacctctacctcccggattcaagtgattctcatgcctcagcctcctgagtagctggaattacaggcacgtgccaccacacccagctaatttttgtatttttagtagagacgggatttcagcatgttgaccaggctggtctcaaactcctgacctcaagtgatccacccacctcggcttcccaaagtgctgggattacaggcgtgagccaccgtgcccagcaaaatctgctttttaatataacagggtcatgttttcaggttagaaaacacaaatctacctaagggctgcccagtgctcttctactgattttccatactaattacaggtggcccataattaattcaaccagtcccctaccaataaatactttttatgaccattttatttatttgcaatgaggaattcaatgcaatgaaatgaagcaaaaaacttcaatacccaccaaagcacttgggtcaggatggcccttcaattcttttttactggaatcagaacaatgcaagactccaaattctaaaatcatagtaatgacagcagcattaactatgcgctgggaattttactaagcatttcacatacactgtctattttaattctcgccacatcttcttaagttcagtaatattaactttatctttttttttttttttttttgagatggagttttgctcttgttgtccaggctggagtgcaatggtgtgatctcggctcactgcaacctccgcctccccggttcaagcgattctcctgcctcagcctcccaagtagctaggattacaggcgcccactaccacgcccagctaattttttgtatttttagtagagacagggtttcaccatgttggtcaggtgggtctcgaactcctgacctcaggtggtccacctaccttggcctcccaaagtgctgggattacagtcatgagccaccgaacctggccaaactttatcacttttgcttatgaggaaactgaggcacagagagctgccactcgaaggccacacagtgagtaaactttggggacagaacttgaacctgggcagagtgacatcaggctgagaaaactccatcagcatttattttttatttttgagatgaagtcttgctctgtcacccaggctggagtgcagtggtgcgatctcggctcactgcaacctccacctcccaggttcaagtgattctcctgcctcagcctcccgagtagctgggattgcaagtgcccgccaccatgcctcgctaatttttgtatttgtagtagagatcgggtttcgccacgttggccaggctggtcttgaactcctgacctcaagtgatccactcgcctcggcctcccaaagtgctgggattacaggtgtgaaccacaacacctggccccatcagcatttgttttgaattctactgccccatgggagtgcaattcagaggttgggattattgggttctccaggcgaaagcccaggacttgtgcacccgtggatgcggggtggagtggggaggaggagcctgggaaaatgaccccaaggtaccttgcaaaccgcacacttcccttagagaccagcctcctggagtgtgtcttgcacgtgctgcataaaatcaagaaagacaacggatgtgggctttcacttcctgttggggacttgtttgtccagaaccgagtgcagaccttccatgagaaagtacaggtcaggccagattccttggctgcccttggagcttctggtaccaaaagggtgcaaaagaaagaagatggacccttggctcatagtttaagttttgatttcttattcctctgaggtctttttctctgtgtgtgtttttaaagttaatggtgaaaagacccactttggaaagcaaaggaaaatcaggcaccatgctgcagtctcccataacagacttcgtcgcttcataaattccctccagcccaaacctgtaggcagaagtattgcaatcataaaatgcacttggaaaatgtttattattttctgattttaaaatgcttgtgtttttctcagtattgacacattgtggaatatatgcaacaaatgataaagaagacagtgttgaaataatctgttgccactagccataatcgtaacaggtatcttctgttgaacattttttttttttttttttgagatggagttttgctcttgttgcccaggctggagtgcaatggcatgctctcagctcactgcaacctccatctctgggttcaagagatcctcctgcctcagctccccaagtagctgggattacaggtgcatgccaccatgctgactaattttttgtatttttagtagagatggggttttaccatgttggcctggctagtcccaaactcttgacctcaggtgatccgcccgccttggcctcccaaagtgctgggatcacaggcgtgagccactttgcccggccctgaacatttatataataccctgctcaggtctgttaccatatttaatcttcagaacgaccccataaggtgtgggtactatgattatctccatatgttggataagaggcagggagagagatcgtgccatatctaaggtctcacaaatcattgggggtagtcaaggatttgaagctgggtgtgtctgctccgaaatttggggtacgtgggagtaaaatggcagagcactggggtgacagaagttggttgtggccgcaggacatggccaggaaggctcagggttccagtcagcgtgttgtggaaggcctggcagagaacactggagagggcaggactttccccctgccccccatgggcgtctttccctgtgacccacacttaccaggctctggggaggctgtgggatgtggcggctcaccgcctcactttggggcgtcccgaggaagggctggttgctgtggctggaactcagaggagaggaactagatggaggagctgcaaggcacagggatctgaaactgcataaggagtgctgactctgaggccaggctgcctgggttccaatccggcttccccacagggtctggctgtgtgaccttggcctgtgctcttgcctctctgtgcctggtgtcctcccctgtaggatggggtgaggagacctgcctcctatgggtgctgtacagatgagacaagcccatgtatacgaggtgcttagagtgatgccaggcatgtagtgagcgctcataagactcaggggtaagaatagtgcctggagaggcaggaatgagggtaggagccaggttgtgcagggccttgagggccacagtgaagcttccacggtatcttgagggcacagcaaagcagggaagggcttgaaatctgcatctgcatgaatctttgtggtgagtgaccctacaagggtcccacccacatgagatctttctccagcctcccaggaaccttctagcctcacaatgatctggtaagtttctctcgtgtaacaaccttgacctgtctttgaagccatctcctttgttattagattatgtcagttgttgcttaaaggctgtgatttaataactactgtgggtctttgcacagccgccttgcttctctgggcctcagttgccttgtctgccagtgtagggctggctagtttctaagggtactctcaagaacctgtgtgctggaattctatggctgtcagtgggtagagttttgtctgccatgcacacccaccagaggtgggaaaaggtctccttcttcgtgttgcgtcccttgacccggagaggacagtccatgagaactctcctcttggtgatgccctttttgttggaccgccattttgtattttctgtttcatctgccacttattggtgtgagcctggaagacagctgggaatggaagctttatggatcctacttaatacttcctgaccacatttccagctactattttctccctttcttccccattatgaacttctgaaaatgatctttttttttttttttttcaaagcaagctcatataagtggaaaaagaaatgatgctgttggtagcagaattcaagaattcaattcaggcaaggagaggctatgggggagggtgacaaaccaaacatcaacatgttgccatttccgctgttcatttcttactcagtcttcaggcttcaagctcactttgcaggtgtggatgaggacccactttttgatgaagaccctaggttggcctgtacagtcacgctcctggtggtgacctctacctgaaaaggggacatgtgtctctgttgggtggtctttgacttgtctttgacaaagaaatgaggattgtccctgactagttctgtacaggactttgcacactgaaaggactcaggtcttgatgacttcacttccaattcctcgatgtccatccagcgatcttcccttgcttccttttgagcatagacatgcctgctcagttgtctgagaaaacagggggccgaagtattctgccctcatcaagggggcatgggtgatgttagcctttggccttttcttggcctcaccagcagcctttggagctgctgacacttctgtctgttcagtcatgagatgttgattaggcatttgtgcgtgttggggagatggtgataaatatgacttggtcccttcagcagggaccaagggacactagagtgagagtcagtaaacaaactgcctgttcttttcccttttaacatagcccatgtcttgctgagtcatttcaggaattgcgctgtaaggtcaggacttacagacttaattgttacaaagggctctagcgtgttcattgcgtgttccttgttaagatcatctagagagcaatcacaatactttatattaatttttcatgggggaggtgggtgggagtatgtttaagaacgcttgaagtccagatttcgctgggtgaatcttaagagccaagactatatgggttcaaacctaagcaatcacagaagatgggaatagctgtgcttaaaagtagggaggggttcattggtcaaaccttgggaagtgctatgtactccagcccacctcgcagagttactctgcacagcagcatgttaaagcttctgagaagtcctgcagtgaagaaagccatttgactttgactcagcagtttccaaatgctcattagcatgtagatttttcccccttctcataaaactatttaatatccttcagaaccagtgttccacaaaacaccctggaaatacttgttgaaattatttgtttcagctgaaaactaccaatgaccagtataggtggtcagcaagagaaatcaattatttgcaaatgcagggttttttttttttttttggcccaacttcttggccccaaactgggggagtagtgttctgcttctggacaggagagtttactgagcaaaacctcttcatcagtagttatgagtgacatgagatccaggctgtctgctgaggaaaggtggagggtgagcccctgtctttctgctcttcagtgacttgtgagccaggataccactgaagtcactggcttccctcatgacttggggccgcatctttaagcctgtgttctcagaccaccaaggaggcgtgtctgggacagtcagggacctgtcatggcgcttctctaacagctttggcgtaggataaagtgtaacatataacaatgctttttaaaattatttacttatttatttacttatttatttgtttgtttgtttgttttgagacaaagtctcactctgtcgcccagtctggagtgcagtggtgtaatcttggtttgctgtaacgtccgcctcctgggttcaggcaattctcatgcctcagcctcccaagtagctgggattacaggcacctgcaaccacacctggctaatttttgtatttttatttttagtagagacggggtttcaccatgctggccaggctggtctcgaactcctagcctcaagtgatccatctgccttggcctcccaaagggcttggattacaggcataagccaccatgcccagcccttaataatgccttttaaaaaaaaaaaaaaaaaatagaaagatagacattcagatacagggaaaaaatgatgggaggattctggacagtttctattttttttcttattttctgttgttgccctgttttctttcttctggctgtcaacattattttattttttaattttttaaaatataacttcaacttttagatttgggaagtacatgtggtttgttacatgggtatattacatgacactgaggttcgggtatgaatgagcctgtcagtcaggcagtgagcatagtacccaattggtagatccctggtccctgtctcccacctacattagtcctcagtatctgctgttcccatcttcatgtccgtgtataccccatgcttagctcccacttataaatgagaacatgtggcgttgagttttctgttcctgccttaatttgcttaggacaatgttgccttgttttctattgacaccatgtctccttttggaaaaaggaaatatttatatgtataaatacatatgtacacacacgtgcacatattgacacacaccttactgaaatgacataatatacaagctaagataaacagaagttggtgagtttttgtcttaaatctttggtttctaatagttccttcaaagtctgtcatttttgaatttttctagatggacagcaaatttgggagatggaagccacggtggataaggacaagagccagcccgtaagcacgtgacgcacctgagtgtctctcaatccccctcacgtttccctctttcatgctctttccttctttccctccttccttcatcagtgtcccccagagctctggacctaacaggtactcaatatgtgcatattaatgagtgagttcaacatttattgggcaccacactctctgatttgcaactgtgacaccttattatattttgatggagtattattttttgctgccgctgacaagttaaattcccctgaaattgaacttcccctgtaaaccgatgaaaggcacatcaaaacacccattagacagtgggctgcctggatgcgcttagggtctgggtaggaactgagacatgattgcagttaagttcatgacaactccttccttatagaacatgctttttgttgagatccctgaatatcggaacaagcatatccgcacacctgtaaaagtgaacttctacgtcatcaatgggaagagaaaacgaagtcagcctcagcactttacctaccacccaggtaaggagtgtttctgatgacccctttgttattgagaggcagtacaggcacagggctcaggactcctgaagtctgctcctagccgggtaactttggacagatgactcaacctctctgagcctcagttgcatcatctgtgagacagcatcttccttataagggttccggaaattaaatgcacataaatccttagcacagtgcaaagtaagctgatgtcagtgatattagctcttattgccttagtaccttcctttaggggaagggggaatagaagaagggtgtgtgtacgcatgttcagcagaagggtggtaagtggatgactcctgtccctggcttggatttgatcatgatagaggggctgtgccctaaaacctgcagaatctttatgtgacccccccatgtgagtcatcaccccatggcctaatggagtgactggtggataaccgggtcaggaggtctcattcccacaaagtacagccccaagaaaggtgatgagtaccattttttcatgcattcatttgtccagaaaatatctgagtgtcaggcactgttcttggcttgtggacacagctgtgaacactacagggtaagaatccctgtccatgtggaactgccattctaacagaggggattaggtcatagataatgttgatattattgatatgttggattacgattggggctgtagaaaaggtggacaggaacagccaggggaagcataattttaaattttaaaaatgcttctctgagctctcccttgggaaataggctataggcttcccaggctgagaaacgcctgctagctaccttccaagattggaaacctataattcgagacaatcacccagggtataatttgcatcctatgacagtttctcagggagcctctgggcttctagaagcattatactgaggggtgccctggcagccttgccttggtgagcttgactgccctggcagccttgccttggtgagcttgactgccctggcagccttgccttggtgagcttgacttgtgcccacagttttgtgttgacccttgtgaggacactgctgtcttgggacagacatgacactctatcagggcagggttcaggtcaccaggacccaaaactgtgggagattgctgggggggctctagactgcagctcaggaatccctttgagcagacatgctctcagatatgtttcatggtgctcttgcctctcatttgtggcccggccttggctcttgtctggttgagtgtggctggagtgagctctcagtctcccagttgggccagggagtgaggtgatggcctttgaatggcacctcgagggacaatttctgtggttagagacagccttgcctagtctccttatctcctccaaaccccaatacttggaggtcccccaccacaacacacacacacacacacacacacacacatgcatgcatgaacacacacgcatgcgcacacacacatgcacacacacttggtcacagtcctgtcactgactcactccagtaaaaagaaaactgattcctcaactcctgggattggtaatgctttagtatggatgttggggaaggagtgatttcagtgactggtgctgggcagggagaaaggaatggccacagcgacaacacaagtggtagtcatgatggatgatcatagtaagagaatagcagtgacagcaagcattgagcacttactgtatgccagccactgtactcagtgctttgcacacacatttaatcctcccagtgatctcgtgggggtaggtatgattgttcctgccaggtaacagatggggaaactgaggcttgagacagtagtgcttattcccccaaagcactacagaatggaggaaggaaacagtcactttgctgattcctttgtctagaaaatatctgagtgcccattaagtaccaggtgctgttttgggtcatgaggatcaaaaaccagacaaaagtcctctctttgaggagctgacatttggaggcagggcgtatttaggtaataaatcagcatgtaaagcatctatgacatttctgacggggataagcagtagaaaggaaagcaagcggagacaggagctgctgggatagaaagagggggaggcatcatctgaaatcaagcattctcctctgagctgtcacctggagagataggctgtaaacatcccagggctgagtcagacctaccagccacctttccaatattggaaaaatctataattcaagatgttcatggccagggtaaaatttcctacctaagacaattgcatggggagccttttgcccaaggctgataagtgacagggaccagctgtttgtcccacccgtatggactcccaaggccatgttctcaagcaccatccacgaatcctccgtgcacatccgtggctcactgccatgggcgcccctatgtgctcttttctcctcccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatggtaagacgcttgagttttgtcactgcctgtaaggatggtgccctgaagcatctctgcccaggaagttcactgcatggcctacggattccgtaatctctttgggcctcagtgtccccattttaatttaaggaggttgaataatatgaccctgaaagccacccctagctctgtgcaagaattacctcccagcagtagttgcagaggggaagcagtaacaatttcagatgcccccctccagaatcgcccccatagaaaaagcaaatgagggcaacccggcatcccctgggtcatgaactgggtccatttaactgcttccacactctttccaattgccagatttagactgaggccaagaaaataggaaggaaagctaacctcctttcattcctgtacagaaaaaaaatcccattttatagccctcttttgtatatttgagggagggagagggaggaaaaggaagaagaaagctcgttgaaaagtggctttatcagaacagcttgcaggcaggctgcaggcacttctctaccctgtgctcgtggaacagagatgcgcattgatgggaaggaagcagtgggcttccgctgtggtgagcccagctgatgggtggtttgggccaaggaaaagatgcagaggaggctttgtgtgagtctgtaggtgcccgtttgtgggcaaggggtctgcccagagggtagtcttgtggagaagctgtgatgaggtgttggtccaggatctcagggaggaaggacaaaccgcattgctaagactcacctgggagccgcaaggtgcattgggaggtcggagagggtgggatgagcagagcagccttgccttgggggctccagacagaaaaataggctgttggactttctttaccttcatttttcttttaaaattttttgtggatatagagcaggtatatatatttgtggggtacatgagatgtttggagacaggcatgcaaagtgaaataagcacatatagagaatggggtatccatcccctcaagcgtttatccatcgagttgcaaagcccatgacactgtttacattatttaaaaatgtacagttaagcgactggagttttttcttaatagaagaaggaaaaacctaaattgctggctgtcattcccagttccagtcctgtattttataggcagtagcgtctgatataccctgaaacctcaattatttcagaaaattaactctcaggagcccagccaaggggtaggaagtaaagcgaaagctttgaaacagccacaatagttaccatcaagactgggtactaaatttcatataccgcagtgccagaaatatcctctgctgcatagtcagaggctgttgacctttactctacaaaacgtcttgacaagccaggttatctgggggctctgtgacttctggtattctccatacccaatccctagggagacagtcgatcaaaaacgtcccctgaattcaccaagcaaagacctctggggccacttcttgtagggtcatcctgccccacgtgccttacaaggctgacctctaggtattgctctgttaataattgatccgtttgatcctgaataatcaagcacaggttgagttaaagtcatggtgctctgttttgaaacggacacctgcatacaatccatccttgaacaatttacattcacaatggtgaagataaggttttggtgcttattttcaagggggcaatcgtgtagagaattaactaaggcagaacgtggtggatcaatgaagcatggtcgtaaccagatccctctccacgtgaggccctgggggatcgattgtattggagaagaggtgctctataaataaatgagtgtctgtgcagggctggataattttccccagctgactctgcacctagggctggtctggtctccagagcgagaaacacactggcctctcctaccctgtccatcccttgttaaaggcaaatggtgagtgccttggatattggggcacccgtgtccaagtggcccgaggtggtcat

SEQ ID NO: 15031 - DNA, 9597 bp, Human
attaaataagcttgaaaactagatgaatgcacttaggttcttgggtagaatgtattggatagctagctccctttatgatgagcatttaaaaatctgctctccaaaaactgggaaatgcattctctgctgtatggaaagcaatatagtactgaaatattcctccttaattttggtctgaacaaacaaaagtgtctgtgtttattcttgcctaatgcatcacaaatctgctgacatgctaaccttggagtcttggctggcgttaatcaggcctgtgcaccggcaggaaagatgtacctaatgcactccatcagtgcagtttgcatatggaagttctcacaggggagctgccctgtgccagctgagggttacctgcccactgcagttattgtatgtaattatcgaaccaatctgttcagcccagcagggtttagacggtaatcatgaagcaacactggaaaagaaagatgtaaggcattctccccttttctcatcagttatatgaagttatagccactcttacagctatttttgagaggcaatacccccatatacaaatctgctaaatgaatgcctttgaaagtttctcaaggttcagtcaagttgttatttttgtatgtgtgaagcattttctttaggaacatggtgggtatctctgagttctaattttccacagccaccttaagaatgttttgaaacagtgggattaattgtaatacatagataataacagttctgaccgtttggaggttttaaggtaatgtgccttgaatagagttcagctttcccatgtagttctctttggaacagaacccatggttgccattaggaaaaggaacaatgtgctgtcagcaggcattatcctcttttctagctgtacacaaaatggcctgcagcaaggaacattctcagatgaagtttaacttattgttaattgttagaaaatataaatgaggacattctgttgcattgtgaacctgtgagatttggggcatgtcggatggttttctaaatgatacagacttattttaggcaaccaagagaagctttggattaaaatttgtattttaacctgcttaaatttgaaactacagaagataaagttatataaaaaaattcaaagttttatatttattcctaatgcccgtctataattttacctatgtatagagatgttagagaatttagaaacttaacgcaggattggacctgttagaaaatgttgtagtggtagaaacacataaaatgaaattgaaggaacatttgggaagaatggatggtgacagaatataagcactgactcctaaataacacttcactagaaaaataggacaggcccaagagaatgtaggaaatccagacgatttttgagattttcggagagctttgtacttttaagactattcatgtacagtaaggtttatggccctcttaaacttttaataaaaagtatgctaaaagagaaacatttattacaagtttttcattattgattcataaatagaattctaccaccaatgttatgtggtacaaacactgatttaataaatggggcaagacatacattttttccatttatcaaatagattatcctctccaccccacccatgttgtacaatgtggagagtatcattggcctgagtggtgatcgtgagtttgtaaaacattttgttttaaaagagtttctgtatgattagtcctgatggttaaaccatagctttgaataatgaagtatataaagcatgaaaagttagaggtggatataacaaatatatctaccatctgggttaactgtctagttgaaagttcttgtactccccctttcttccatccctcatccattcctttaggtaactactatcctgaagttgagaatattcttcctgtgtgttttgacacacccacacctatatacatttatacacacacacagacaaatatgtgatgagtttgtagtttacttgactgtcagatatctctctctctctctttaattttatatgtaagaagcgaaagaaagaaattgaagaaagcaaggaacctggtgttgaagatacggaatggtcaaacacacagacagaggaggccatacagacccgtaagttgaacagttttgcctagctgctttcataggtaaacacaaatttcatttcctcccattagatgaggggtcaactatttgggtcatgaccttttgattttataataaaataccacaagatttttatatagtatgtattgtgtcttttgtacacaggttagattattttctctccacaataattataaagttgagactgggaagcttccttcattttgcagatttggaacccgagacactgaatgattaaatggcagagctgccaggcgtggtgactgatgtgtgcctgtagtctcagctactcaggaggctgaggcaggaggatcacttgagcccaggagtttgagtccagtctgggcaacatagaaaccccatctctaaaataaataaaataaatgactgagctgttgtgaaagggttagtgatagagaccagaactcttaactgtcaggccaatgtctttccacttcctcacactgatcccacataactctgggtatgatagtgagtgtcaggggtcagacatgggtctgttgcagctgagctgcctgattgttccttataaagtttgtcaacctcttcttttttttgaacaagttaagaggaaaggaattaaagctttatggatgatcacttttcaaagttcttgaagcaaaaaaaaaaaaaaacacaaaaaaacaaaaaaaacaaggtatgaagtcatttttctgagatggcttataaactggcactgaaggcacttccaatagttccagaaatgacattagcaaaggcagcatctgcaaagggcagagctaggttggactttggtctgatatgtttaataaactgccagccaatgtgttccaggattcatgtgatatgatgatgtacttgactcaataaagagagctattcagtgtggcccacaatacatttttttaaaaagatttttcctgtctgcctttttttttttttgaattattattttgtttgtcctgaaatatttcttggttgctaacagaaaaggcttatttttggttaaaaaaaaattttacagcataggtgccatattgagtaatgccaccaatttattttaccttccttttgctagtgacattagtgcatgtttgtggaaagcacagtattcaactttcaaagagaatcatttttgccctgattttattactatgttcttcattacatattatggttagaacatcctttggtttaatctgttttaacccaaagaatacttgagatacctgaagagggaatatataacttcacactgaaggcgagaggttttgaagtagtccctctctttttcccgctgctgtcttcctttcgctactgtcttttttcctcctttcccctgtcttgttcattttgttattaggaagtgaggagtcccaaggagcaatacatcgaagcatgtctcagccagaggctagcagcagcagctatgacagtgagtgggaacaaaattaaggagtatttataaatatacagcaatattcttaaaaaacaatcccttaaattttaaaactggcaattttagtttcagaaagatcctgcattgttctagtgagattgacactcattaagtctaaggcagagtctcagctgcgcatcaggaagactcatccctttcttgactgcctggacatcatttgttacctgaactttgcttaatgagcatcaagcgtttttgttttgatagataaatgcctttaaattctagtataattatgaatttttttttaacctaagtttttagtttaaggtcttctactgatgctttttcccatgagaaaatatatcagtatttttgttattttattaatgacaaaagagtatagtaaagtcataaataatttaaggagaacaattcagtttttttgacctaactttttcagaagataaagaatagtcagattcacccttattcatataaactcaaaattgccgttcttaaaatgctgtttatttcccccattacagttcacttttttcccctaaagtacaatgcgagttaaggtattttactatcaaaataatcataagtgagagaaatattatctgatggtaaaatattattgcttccagcaaaaagaaaaagccaagagttcatgtaaatgtatatttttaaatttatcagtttaaaagttacttgaaggaaaagacacattattacatttgtttttttaatttttaagatatatagtacaattcagtgaacactgtgttttagggctttaagattttgtgtcataaacgtgtttcaagaatggttacctctaacagcagctttagaaatgtcagtttcttcattaacaattttattttcaaacacaatttatgatttacagtatggtaagagatttttcgcactgtgtgatctttcagaatgctgtgcctagcaaaatgggagcaactttcctttaatatctatttagaccattttaaaaatgtgtataattttctagatacacctaaactcattttgaatagttgggggtctattgtgtaagaacacattctgaaagctttcaaaatgtgtattgtgtaggttttctcaaataaatagaggaggtgatgggatggttttcaagaagaacagaggcctctaatccttttatttttatgcaaggcataatttttaccagttgagaaaatttggttactggctgcaagtaatttttcccctcacaaaatgaggagcctttaaaaatcatgcatattttggcatttcaaaatcatgccagtatttcagaattgtgctaaaaattagctaatatagccatgatatttatggctggtgtactttcccccctcctgttcataaaatggaggctacttttgttggtattatttttaagaaccttggattttggaccattcctgaggaatctttggagaaagcatgactagtcaaaaagtagatatttttaagggaaccctacaaagaaatttcctactttttttttcctactgcattataaaatcatagaaaagcatcccaaacttgtatgttattttccaaatatcaaattatatacattagtcttctgattggaccctttgccagtagtgtatattatgaaaatggttatatatttaattaaagagataagaaggtagttttttttgtaacaatcagaattgattattagggaaaatattgaattgatttatgcagcaaagtcaacaaggtgcgtaggactgattatataataaattccaggcagtagtagcccttttagttgcagtgagaaactttggattgaaggagatgagcagcagtgatatttaatttcagagtaaaatggcaaattaagacattaatgagaataatgctatttgaatgtaactttatagttgttaatttagtgttctttgtagtgtggttaaagatttaaaatgtgttgaaagggagatatagtattgattattgaccttgattttgtaataccctttatgccagtctcactatcgcagcattttcagttttctgtgcagaattaatttcaaatttcttgaaataggccgggcgcagtggctcatgcttgtaatgccagcagtttgggaggctgaggcgggtggatcatttgaggtcaggagttcgacaccagcctgaccaacatggtgaaagtctaagtcctactaaaatacaaaaattacctgggcgtggtgacaggcacctgtaatctcagctactctggaggctgaggcaggagaatcacttgaacccaggaggcggaggttgcctgagccaagatcgtgtcactgcactctagcctggcaacaaagcgagactccctctcaaaaaaaaaaataataataataaaaataaaatttcttgaaataaaaacctaaaaatctactgtgggatatttttaatagatggccgtgttacagaaatttaagaaaaaaactcaaattttagaatcaatcatagtacagtatatagggtatgtattatgagtggcagaaaaaaggatattcatataagcttgaaatttgctttcattgaactgtatgattgaatagaaactataacttggaaaaattaaaaatgctagttttgaaactgaccttcatgttaagtaactaaaacccatgatcagaaaacctttagatacacatggtagaattttgttccacattcaaagaatgtttcgtacttttcagaaaagaagtattgatcttttgttttttttcgtgcagtcattgattaattatgagcaccatgctgtccctgactctggtgcccctgctctttcctggcagagcgtagcatgcggcagtgggaaagaaatggccctgcttctttcaccagcactaggcagccgtgatcaggctaactgctgtacccagaggtggagtaggagtagtaggtggggtgaaatgtcttggtgaggcagaattcccatgcccccagcagagagtcattgatttattccaaaccagaatagttagataggtactgtcataaaggacttagaccagtatcacatatgatccttttccaggaggctactcatttgggacctgtataattcctagcggaaaagactttccatttcagtatatcccagtgctctcctgcctcaagggtgtagctaatagtctttaaaaagcaacttattgctttgcttttcataacatgtgtgacctcatcgcttccacctaaggagtgaatgcttatctatattgctaaggtttatatttggagataatgttttaaattttacaacaaatttaaattttggagagaaatatttcagtattagtaaaaattagatacgttttatcagtcagtatttttatatggcttaagagaaggtaggttttgtcagcatattttttgacatattaaaaaatgacccaattttctaagattttcagagtattagcaatcatacctttgtatgtcagttttatctttgcaaatcacgagagtcgatttgattttaaaatgttaataactatatttagggatatttatatttctgttcttttgcttttgtaaattattgactagtgatttcagtttctttgatttttcttcaaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacagtatgttgtggctgtaaggtttggtttgtattgattttgttctgttcccaaaatcttttattaaacacctgctgtatgagacaggaggtacaaagacaggaaaggaatatgaaataaaaagtggaggaagcgtatccatgagagagaaaatctacatatatgaaagattacataagaattatgtcagtatgcaagccgtatgacaagaaaacaagtgacagatgatcaaatggtggtgtgattaaagattgtgtaaagactggcttcatctacggaagtcctatgaactagatattaatagatagagcctattgttcattcacagaagtttatttttcttaaaagtttcactttcatagcatgtaatatttatacagtaaaccaagcacttcagagtttcagtgatcagaaagtttaagatctgaaatgtttttagttgccttgggaacagaagcttgtaattttaacacatttatgaacaatttcatgattcattcctcagagttttcttggtcagagaaattggtattggactatattttctgatggatggcatgccttaccacttaataacatgcacagtgtgtttagaaggtatatggacatagtttcacttaaatatttaagtatattaatgtgtattcagaatacagctagcacattaaactggtgatttgtctactacttaggacaagcctaaagtaggtatttcaatttttaaaagcaagtcgatttgagggaaaaaataagtaaatgtacaggtgggatatggacataccagaaattgtgaaggttggaccaaatttgagaaactatgaaccaatacaaagactataacttttggctctcttatgtggatatttagttgtcatgtgaagcatttatcactgaaatggttagatactgaaaaatgcaaaacatctacagactttcctttgaagattaaccttttaatgcctcctgaagttctagagcaatgtatctttacagattagaaaatttgactttgggcagaggctcctcctgctttctgtagaatgttacgttttagtactcatcagtgttaatcccccaagtttatttgtaacacctaaatcaactctcaagttccattttaaacacattaatgcttaaaatagagtaaactgtgtgtggtatgtttttctgtatatgctgtagcctccttatttttcaaaacataaaacatggaaaacttggttaaatattaagaaaacaaatatttcctcacattattgtcttaaataagtgctggcattttcttgaatgttcctatattggcagggctagagaaattaatgaaaaactactagccattgtagccagtttgattcatcagctacatcccttgttcggctattttattccctaccttgtattgttttattctactccccttttaagaaatggttaagctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtctcttttgctgtgcagaagctctttagtttaattagatcccatttgtcaattttgtcttttgttgccattgcttttggtgttttagacatgaagtccttgcccatgcctatgtcctgaatggtaatgcctagg

SEQ ID NO: 15032 - DNA, 41041 bp, Human
ctgaggtcaggagttcgagagcagcctggccaacatggtgaaacctcgtctctactaaaaatagaaaaattatccgagtgtggtggtgggtgcctgtaatcccagctacttgggaggctgaggcaggagaatcacttgtacctgggaggcggagttgcagtgagccgaaatcgcgccactgcgctccagcctgtgggccagagcgagactccgcctcagaataataataatgataataataataacgccaccaacaatactaagagctaacatttactgagtgcttactatgcaccagatattgttctaagtatacatttattatctcatttaaccatccataatactgtggtatagacacttttatatccattttataaataagtaaactgagttatggagagattaaacgacttgccagtaagattcaaagcctgtgtacaagctcacgcttgattctggagccagtgttcttaacacagtatcttgagaatgttaaactaaaaagtttttaatttacagtattctttccacaattaaaaaagaaattatgagtaattatttttagttctttcttctcttcaggcatttcccatggttcttttcaagacataatacatatcatttagtgttgtagatctgaaaaaacaaaagtagcgtgaagatcaaaaattttctaaagagacggagtctcgctacgttccctaggctggaacacccaggcttctccagcctcacacctctgagtagctggaaccaccctgtccgctaaggtcaatgtttaatcgtatctttgtaggtctactgaccagttaaaaagaggtgctgtatacattggttgttgtcttgtcagagtttgatgcttctatatagaccattgtttttacatgctaatacaattgaaagccactacagatatttatatttacaacccaaagctaggttttaacaagaaactcataaggcaaaggtgagaagtaaaataatttagcgccaagtggagatatatgtgcaatgctactttgttgggctcaaaacatatttttcttttagaagactgacaggcttgaagtttatgcctccaaagacaaaagtgattacgttttgtttagtagcttgcaaagttgccaaaggccattttttctactctttccctgaaattggtttatatgcttattaaagtcatttatacctatttgcaaatgcttaacatagtttcagattttaagatttccctgcaactttatttcccttgaagtttacagcaacaggagttcatttttatttttaattgcatttattcagtaagtaaactccgccacagaaaaacttagtagacaaggtgagttcccctgtgctccgtggcaaagagtgcggtgggtgacattgacccatggttaggtaatctggtaaggaaagaccccgttgtaacacatctgagcaacgagaccaaaggaagggcttgctgccacgaggcgaagtctgcttttttgaacagagagcccagcagagttgggcggcaatcgtgcccagcactgaggccgaggagaaagagagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccgccttctcccccggcgaccccgcccgcctgcccgccctgggctcctgggccggcctcggcgttaatgggattggggggggcagcctttttgtttctgctgctgctcccctcccctctcttcccccaacctcgccggccgggctcccccgctgtccacgtcgccatcttgtcgtggggggtgggagacgcctcgaaagtgctttcaggggccggggtctgagccctgcttgccctccccgccggccgtgggggcctcgcgccgcccacctacccgcctcaaaaacccagcctgctctgtggccccatccggaggggactttacccagcctgaaaaccccgggaagagaaatgagctgcagctcggtagccgcggtttgcacccggagcttccgctccttcccgcccccatcctctccagttccattgaaaactcggccctggggcggaccctgcacgctggtcctggctttccagtggacttggggccttgagttcccgactgagggactcgcgtggtcggatgcgatcttgtcctgtagttgtccagccgtcgcgggtgtctttgcctttgtgcattagggatttgccgcgatggccttaagatgcgaactttttagtttgcacgtgcaggttttgtttcgttttaatcgccttgaaaaacttgcctagactgagagtcagagtaatgggaatttagggaaatggcaacattttaaagagaacttcagaattggatacttgagttcatatcacctgtcacgagaacgcagatattataaatgaatatatgcctcattcattcttcaaataatgaaaatgtaggggctggttaaatttaggcagttttaatgatactgaaaaaagtatatgatgagtgaatgaaatgcggcactaaaatgttgcaaaaattttcgaactctgtctcattttcctgaaattgaagtatattaaaggaaaaccgtcaacatatatctaaagtaagtaatcactcggttagaacttaatgcaagttttataaatcaccttgaagtttgagtctaaggggtacattagagattaagaattgtgagttggaccagtggtgttaagagcggactcccccatcccccaacacacacacaattttgcccactttggcattttaacttttaaggaaatcacttaaggaattgaagatttagagtaagagttttggttagtagactggctttgctgttaaatccttccactcttctggcagagagattaatttccctaatcagtatcagcagaagataaacttgtttatattcctgctgttttgtagatcccttctcctggtccttcttcaatagaatattaaattcttagtttgtatacagcagagaaggtcacttataaaattcaaaaagtgagcaaacaggtctagattaattccaagagttaccaggaattaattgcagtttattttgcggaggtgattacagtgcttttgatgaaatgataaagctgctatattgtaaacctaaggcagattacctctgtgtagtgccagttttctatccttattatatattgaatcatacttaatacaatgcattaaattatgtaccactttttttatatacagtatcgaactcattgttttgccattcatccgttcagaatatcagaagcagttttgaaatgaattaataaattagctactgttcatcagccccaattctaaataagctcttagattttcctcagcccatctgttactttcaaaattttctcatttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatgggtatggttatgatactgtagatttaacgcaggacatttcatgttgttcctagttataggggctgaacttatttaatagcacgtgcattttgatttttagatttttaagggaatgtcaagagagtaatgattctgtttcaggcttcaggccagactccttcagagttttccaaaacaaataattactgaatcattaaagtaaaatttctgagaatagatattccttaatttccttcattaactttggccattaaaagtcaagaagctctctcatttattagcaaacttttctccttatgattctattttgattgtccttttgtttgaggaagcagcatatggtggttaagagcataggatctagaggcagatacctctgagttaagggtcccagcccttcacttgtgagcttgagcaagttactgaatgcctctgagcctctttcctccttttgaaatgatgataagaatagcagccatctgagcagttattgtaaaggttaaatgagataatgcttgtgaagcacttagcccattgcaggagtcttgatgacactgtgtacttgaaaatagatgttacctgttaaaattcttgtttaaacttccacaactcttaaaactcttttttgctagtccttccagctgtttcctttagtttcttttctgtgtcttcatgcatcttttctatctcctgaaagtgaaaagactaacattggatccagagcttgaaaagcgtttttttcctgttacaatgggcaaaagagtacatccttgggttatattggcacctagtatcagttatttttcttgagcatctgatctgctctctactctagtggaggcctcctgcttcacaattgctcacccctgtgttttctccccaaatagaatactgagtttactctggactctagagtcaaacatacacagtattctagtcttactgttcatttaagcaagatatgtgcaagacactgcattcttagtactggcagtaagttaaaacatttttcgtcttgatgccaaagtttagacaattttataaaaattaacctttgtaaaagataatgagttgataaaatattctcagtaaagcagctacgtggtagaaaaactgtcctttgcttatgagtttctccagagttaagaccattgggttccatctgaaggcaagacttcaagcttgtcttactggtctgttttgtggctcaatttgtatgaagtctatgcactcttccacacgtgtgtatttactgaactatcgagttattttagactgagaaagtattggagttcattcctacggtccactgcagagcaccttgtgcagtttggagaatgtcaacttttctacctgttaacttccattgtctttacttttaacgccattgtctgtgactctaatggtgtcacggctcagggtttagattttgtggttacattctattcttgtatgtcaagagtggtgtatagaaagctgagggggattatttagtctcttgactgatttttttttttttctgaagaactcagtttattatgtttggtggtgaaataaaaattgatgtgcatggatgttaaagatttgggttaaattgtgtgttcatagatgccttctcttagtatataattttttaaatttagatacttaaaatactgtatccctttatctaagattaacataagtctgtttcttaaccaggataaaaaaatctaaatttaaatgtgatgttggatgagtttccaatcaagaaattgattttttaaactttgtgactagttatccagtgggtggattttacccagtgtgtgtatgtgttttctgcttaactctggaaggttagaaagagaatttgaaactaagacaagccaagcttcttgttgctcagtatttttggtaaaaatatggtcagattgtttaaattaactataggctttggaattttaaaaataattatatctcttggtctcttgacacatcaagaattaactgttttgtatatgcgttgagtattaatgttcatgttttctgcagtagaaatttataaacccttatttatttgccagacatgatccctttagagaaatctagtatctaaaacctgaatttttaaaacaaaatttaaaatttttgtttcataaaaacaaaaatgtgattacctcatggcttttttcttatagcttttgattgttttttaaaatcgtagttcaaaaacattaacctaaaatttaccatcttaaccatttctaagtactgttcagtagtgttaagtatattcacattgtgccactaacttccagaactttttcatcttgcaaagctgaaatcttacccattaaacaactcccaatttccccctctcctcagcctctggcaaccaccattttactttctgtttctgcaaatttaactactctagatgcctcatataaatagaattatagggttttaatatttttgtgatgggcttatttcactttgtgtaatgtcctcaaggttcatccatgttgtagcatgtgtcagaatttccttcctttttgagtctgagcaatattccattatatgttccatattttgtttctccattcatccagcaacggacacttgggttgcttccacatcttggttattgtgctgctctgaacatgagtctgcaaatctctctttgaagctttcactttttttggatacatatccagaagagggatgctggatcatatggtaaccctttttaattttcaaggaaccaccatattgttttctatagcagttgcaccagtttacattcccaccaacagtgcacaagggttcctatttctccacatccttctaaacacttgttttctttctttccttccttctcttctctttctctcttagccatctaatgtggcaaagtggtagccatctaatatgttgaagtgattgtttttaagggcttgtttgtggataattaaccagctgaaagctaactacagtttgccagtggaagctttaactgaaaggagagtaagtacctctaaaaggagaattcaatttttctagtgacttagatttgttatgccagtactttttcacagaaacactttttgggtaaaatagtgtacacctgttctattgttgataaagcccaatttaattaggaaatttgttctctaagatttaaaacaataattgaaataatgtatttttattaaaaactgttcccaagatgttagcttttagctgttctggtgatctcaactgttatttatgagtgtttctttattttaaaatttcaccttaaccggttacagttttaaccataaagattatttcaacatatgattttgaaaatttattatcttgtaaatgggaaaatgtagtgatggaacatagtttactgtatgtagttcttcacttgtttgaaaagtcacaatatatttaggcaaattaatttaaaagtgtctagtatttaatattgcaattttcactcattaaggacaggtcccccgtgtttcccccttttttttttccaagtagtttgggaggatttgtttttccagctgaaaaatactatggttaaaaataaggtttaaaggcgaaagttgaagtctttgagggttgggatacgtttctgttcttaagagtcttgtaaattcagatgctaagcaaatttctttaaaatgatttctaccctccccctttccattataaaactggatatgtttcagtggaccaaatcccaagtaggctgaatttgaaatttgtgggctgggcgcggtggctcatgcttgtaatcccagtactttgggatgccgaggtgggtggatcacctgaggtcaggagttcgagaccagcctggccaacatggtgaaaccccatctctactaaaaataccaaaattagccaggcgtggtggcgggtgcctgtaatcccagctacttaggaggctgaggcaggagaattgcttgaacctgggaggcggaggttgcggtgagccaagatcgccccattgcactccagcctgggtgacagagcaagactgtgtttcaaaaaaattaaaaaagaaatctgtggtgtgaatactggtacgtggtgtacacagtgagctcttaataagtatttgaattaacaaatgagacaatgattgaataattggatgaacaaagagaatgcaggtttttaaaaggtttctttagaaatattgtcggcccggcacggtggctcctgcctgtaatcccaccattttgggaggccggggcaggtgaatcacctgaggtcaggagttcaagacaagcctgaccaacttggagaaaccccgtctctactaaaaatacaaaaaaaaaaaaaaaaaaaatagcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgtctccaaaaaaaaaaaaaaaaaattaaaaagaatgttttaattctttagttccctgtctgagattcactggtaagaagaaagttaaagaatctcctttgactttttttgatatagatatttaaattctattactttatagtaaggttggggtttattttctttgctttataatagaagagcattgattattctctttgctttataatagaataccatttaaataggagttccctgagtgtgtttacaatcatttgatctggctaaactattttaatgttaatgaaattttaaaattttggaggaaaaaatttaaaaactacacaggtgcacaaagaaataaaaatcacctgctttttcactatgtagagaccattgtctactatttctcaattctgtgttacatctgtatgttaataactgtaggattagggactgagtactgtttttaacctgcttttaaaaaatttacatctacattttttcccatctaaatagtgaggaagagtatcagaattttgtaggcttgtggtgatggttaaattagataatattaatgttgggtacttaacataatatatggctcttaatactctccagatttcagatatagtctgttttaccattactgcctttttatcaaacctattctcaaaaaagtgagaaaagtgctgagattacaggcgtgagccaccatgcccggcctcatggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatataaaaaaaaaaaaagtaaaaaaaactccctctctcttctagtgtctatatatcagtttcctagaagaaaacgttttgccctacttggccatgtgaatggagttccctgattacatgagtcaaatatgtcttattgtagcatatttgatggtcttcttgtagaatattatcttactatacacagaactcttgaccagtgctaccattgtaattaatgggccatgagtttttgttgcaagtcatttgaattcatattctatagttttctaccaagtgtagtcattctgcaagctgttcttgtcatgacttttgggaagttgagtatttcttctatgggttagggttttcatctcaagaaaaagatgatccttttctctactaaatatgtgttaagatcacacatttttctagatcgtttagctctactgtgtgatcttacacaaattgctttattgggatgataagaataattgccttataggattgttatgagaatgaaatgatacatcaactcatatgaaacactcagaacagctcttggcacaaagtaagggcttaattaagtagaaactatccatatattcataatattatagtattggttaagttgttttcaacattgtttagaatcgctcaagccttctttgtgataatctgacgaaggctattcaccaccagtgagtaaataatagtggcagaatagttactgatgcttttcctttacttggttttttttccataaacatctggcctttgcagactaaatactggtttatgtatagacatgttattctaaaataattttccatagtggtaatactaaaggaagaaaaatgttctcaaagctatttatttgggatgttaaaggagggggaaattaagaaagcctacatttccatgtcctttgtgtccagaatctcattaaatgtcttttaacttgttagcagaggaaagttggatattgcctgcctttgtagctaacatagttaaaatatttaaatggttatagtgtcaaaccagtagtcaaagccttcactgtgaatggatgaagggatattttcttgaataatttaagttgacttatttcagtggttcaaaacatttcttcaacgcttaaccatgactcaggcacctaactattatactatgtcctgtaacagattgttgtgcattcatttattcaacaggtatttgtgcagctaatttattgagtacagcattgaatcgttgatggcttaggccacagttgaacattccattttttatgttcattcattcattcatagcatattccatttttaaattttcagttcattgcactttaaagtttgaggttcttgcgaagtacagacttttgggtttaagttttgttatttaatgtcaaccaccacaggcgcattggccagtctgcttttagaattttcagacatacatacacaaaacattctcacaagacaatctacttattttcttttttattcctgtgtttcttaacacaggattaatgttcagatctcttttggagcaaaataatcctctgaatttttgagatgtacccagtgacctcagtctgagtatgtatactgcattaaaaaatgtaaccttgttccttttagtggtcatttggtaacagtttgatcataaacaaatgcagcctcaaacacagaaggcttgaggcaagtatacagaactatggagagatcatttagatgatgtagaatatgccttttctttttttacaatgccaccaaaatgaaaacacggttttaaaaattctcatagagtgtaacttcaacactgctttaactctattaaacaaagcactgccatgttgtaattcctatttattactctctggagttgtataaattaccaaatccgccttttgtttgatatccttttcaaatatctgagggtagctatcatgtttcttccttctattcttaaaaaatagtcccaaatttcttgaatcttttaatttaaaaattatatattgagcatctgatttgtggaaaggcataggccatattaaaaatggggcttcatattaaaatggggaaaagggtggagattctcaggtggaatctgagatctgccacacactaatagtgttacctaaccctttttaaagacaaagaaacaggatcagaaggtcactttggaaaatttatttggtaatattggataggatggattagtatagttggaaaacagagactcttgctttaggagagctgctcctttgtcatttccagaatcttaatcatggtcaaggtttagagctaaatatttaatagaagaagtctttagggtatgctttctattgtacacccttatttcaatacatgtgttttttcctgttatgtaagtactttattattatttatgcatcttctattaaagttaagcaaataattatttcaaggacacattcttctacatacacacaaagtttagggtcactgaccttcttaggttctagtcttagatctgttaccatctaagagcatataaataagggaaacagaaagaaaaggatttacaagctgagaaggaagcaatgcagagaaagaagagtgatagagtaggtaatttggggaaagtcagtgatacacagctcttaaccatgaacagtgattcttcactcttgaatgtttgtgacattcatgaaggtattaaaagctgacttttaaaaaattgtttcagagaactggaaaaaaattcagttgccacattcttccttaggtcatctttgaactctactcatgcacttacgtgtttaaggcaaagttttactaaacgcacacttgttcttgctggcttattgacttttactgctagcttcttattcttagcaattatacctcacattacatagtattgtgaaactcactatattcagtgttttgcctgacaaacatggtatgttataggatgtgtattcagttatagctaaaaataaattattctcgtttttcaaaatttgctggcctacctgttaagcttttgctttaagacctgctaatgtttctcaaacttctgtggttaaatcacctgagtgtctagttgctctatggattcccagggacccattcgccagagattctgatttggtaattttgggatggaactcagggatctgtaaattttacaagcactcagaaatgaaacatagactttaaacagctaagagtgctcatcaggattatgttgatattattttttaaacagatgtgccaagcctttaatttgaatttccagggttgggatttggccttctatatttgggggaaaaaagttctattgatgattgtggatatataccacaggtcaaccattgaatagtctagtcagtgtagttagtgtattttataattactaagttctaagtatgtggtgtattaatgtcttaggaggtggatatatttcctgtatttgtaaagcatttgggtaggttttttaaagagaaaagtatgtaacaaactagttttgagcgttgctcttttacttctttgggcatttttgaagaacacgttaagtatcttcttagagcagaggggctcagagtggtccccagattatcatcattggtaacacctagttggtgcattactaacttgttagaaatgcacattctcaggcgccattcagacttcataaatcagaaactctggaagtaaggctcagcattctgtgtttttttttctttattatactttaagttttagggtacatgtgcacaacgtgcaggttagttacatatgtatacatgtgccatgttggtgtgctgcacccagtaactcgtcatttaacattaggtatatctcctaatgctatccctccccgctccccccaccccacaacaggccccggcgtgtgatgttccccttcctgtgtccatgtgttctcattgttcagttcctacctatgagtgagaacacgcggtgtttggttttttgtccttgcgatagtttgctgagaatgatggtttccagcttcatccatgtccctacaaaggacatgaactcatccttttttatggctgaatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccactaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtcttttggcagcataaatgtcgtcttttgagaagtgtctgttcatatcgtttgcccactttttgatggggttgtttttttcttgtaaatttgtttgagttcattgtagattctggatactagccctttgtcagatgagtagattgcaaaaattttctcccattctgtaggttgcctgttcactctgatggtagtttcttttgctgtgcagaagctctttagtttaattagatcctatttgtcaattttggcttctgttgccatggcttttggtgttttaaacatgaagtccttgcccatgcctatgtcctgaatggtattgcctaggttttattctacggtttttatggttttaggtctaacatttaagtctttaatccatcttgaattaattttagcataaggtgtaaggaagggatccagtttcagctttctgcatatggctagccagttttcccagcaccatttattaaatagggaatcctttccccatttcttgtttttgtcaggtttgtcaaagatcagatggttgtagataagcggcattatttctgagggctctgttctgttccattggtctatatctctgttttggtaccagtaccatgctgttttggttactgcatccttgtagtatagtttgaagtcaggtagtgtgatgcctccagctttgttcttttggcttaggattgacttggcaagcattctgtgttttgagaattcttccaggggactgtgatgaaaactgacgtttgagaaccttcatcttagagtaaaaactttacatacacatttttgttgttttatttatctagcacaatacttcttttttttgaaatggagttttgctcttgttgcccaggctggagtgcaatggtgtaatctcagctcaccacaacctccatctcccaggttcagttgattctcctgcctcagcctcccgagtagctggggttacaggcacgtggcaacatgcctagctaattttgtatttttagtagagacggggtttctccatgttggtcaggctggtctcgaactcccgacctcaggtgatccgcccacctcagcctcccaaagtgctgggattacaggcgtgagccactgcacctggcacaataccttatatataatcagggctcaaagatttgttgagaggctcaacaccaattctggaccaggaaagattttatttatatcactagtcaggaataatctaaaaacaaaaagcacattcttcttacaagtaatatttcaatacacattaatgtaaacacatggaaaagtattagctacttaataaattaacatgtaaatgaaaaatttacacattatggctatttcagatgtgatatagatttcattttcagaaggaaccctccaatgtaaaacagtgattcttttccccgtttattttactgtattagaaaatcacatttaaagtaagcattttggtgaggtttggaaggtgaataaatccatcttttctttaattatggatatttaagagagatgttgttgtgccgtttagataataatgatctaaaccaagaaatttagttgctttcaaaaataaaataagtgtatgcattctgaacatttttctttagaaacaaaccatttcatctgtttttttgaatttcaaattaattatacagaattttcaaaatttgaaaattaggttagcatgagaaactgaagatactgaattatattgcctgttcagtctatacttttctttaggatatacagtaggaaagaaatatgatagttcaagttagattactacttctttcagagttttttgacaaatgcaggtacagtgatagtgtcagttcatggtgaatttttgttaaaataaattacaaaaaatttgtgatcctggtatcttgaaactagttaatatttgtaaactttgctaacactgtatatcactgtattctggttttatctgtgcatctatgagttatatgtgtgtatagctacatatgtttatatttatacacatacattacacacaggagtggaatcatactcaattttttttgtatagcctgctctgttcatataatactatattgtagcatctagtgtaagcaaagattaatttttgtagactttgcttttatcctgaaattttgtggtagctggtttaatggaaagacaatttctgtgacgtgttttgtcagttagggattgaccctggtaaaatattgctggataacaacaagcaatgtaaaaatacatttgttccataagataacctccgtgaaggtagagacttggtctgttttgtttattgcaccgtgtcctgttctgggaagagtgttagactcatagaagatgatcaagaaatattttttgaatacatcaataacattctctaacatgtgggtatcctaaaggtttatttttaaagtttattgattagaattcagaagatattttcccagataaaataatagattgctagctgtcttgaaaatgtaatttatatttaatttgaaatgtcaggtttttgctattttttccattaagtagagatagggtttttaaaaattacatgtgatgttttaagtattctggttttgcaacaattactagatagaaaatgtaacaacagatcctattaataatacttccaataatacatataaaatacttgtctaaaagtaaccctccttaaaaaaacaaagctggccaggcgcggtggctcacgcctgtaatcccagcactttgggaggctgaggcaggcggatcaagaggtcaggagttcaagaccagcctggccaacatagtgaaaccccatctctagtaaaaatacaaaaaattagccgggtgtggtggcaggcgcctgtaaccccagctactcaggaaaatcgcttgaacctgggaggcggaggttgcagtgagcggagatcgcaccactgtacttcagccttgggcaacagtgcgagactctgtctcaaaaaaaaaaaaaaaaaaaggcaataggattaggtatcaacttaatgaaaacttcgtgacagcactttcttgaaaaagactgtggaaaccaaagttagtaaactcctgtttctgcctgggttcggaaaacataaagatgataaagatgtttaagtattcctttttttttttttttttttttttgagacagtgtcttgctctgtctggagtgcagtggcacaatcacagctcactgcagccttgaactcctgggctcaaataatcctcctgcctcagcctcctgagtatctggaactacaggagtgcaccattacactcggctagtaatttgattggttaagaacattaactataactcacacattttcctgaccacatttgcttaggacaaaacagtaaaagacatgagtgtagatgaaagcgataagggaactaatcttaaacactgaacctcttttcagcaaattggctttctagtttctcagctctctctttacacctctaaatctctttcctggcaagatcatttatttgccttggtttatggtgatactcttcattgttatactggtgggtgattgttttaattgatagctgtttttttctacttcaggaagatgacactgctggctctgctggctctgatgtttaccttgtggctaatgcctgtgtttgcctgtgttcacatttattccacgattcatttgttaacatttactaagctgcttttctgtgccaggaacttggctagataaataaatggttgtttttgtacacagaattagctgtcataatcagttactgtagcatttattcttgcaaaaatatatatttatacttcaactagtgatcgaatctcaacttattaattcatacattcagccagcacataattgaatacttcttatgtgtcagaaactgttctaggtgcttgggatgttcattgaacaaaatagacaaaagtctccgcctctatggaacttactttccagtgaaggtgtggattggtgggatagaaaataaaataatcaagtaagatatgtacttaggctttcataaaaatacagcagggcaagaggaccaagatggaggcagtgatcagggaatctcaatgagggtgagactgcgacaaagacttgaaaaaggtggagaagcaagccttgtgggtatttagggtagcagtagtccaggcaaggggaacaactagtgcaaaggctctaggaggcaatgtgtttgaagtgttttaagaacagtaaggaggctagtatggttagaacagaatgagcaaagggggcaaagtggtagaaggtgagatcaaagaggtaatgaggccattgtggaggcccatatggactattggaagggctttggcttttactctaaatgaggcaaaaaccattttaagcagagaggagtgatatgacttgatttcttgttaaaaggattattctagttgctgttacagaaaaagattacaggggtgcaaagaaacagggagacaaaagaatataagattttcactgtaacttatatctagtatgcttgcttatacttgaaaatgcatatccagataattgtagtaaattcaaatattatgtttatttaatagtactaacattgatatgctggttaattatgattaggagcactaataaagcacaaatcagggattcccaaaaagaatgttgaaagggcagtcagcttttcctgtgccagaaatcaaagtcatagcagatttggggcaaatatgtcaaagtcaaacttacgcacatcactactgagaagacaaagatgaatgtgtgacagtttcctgcccccaagaatctttaagcattgtgaaggaagattaatatagccaaataactagagtgatcagttctaccagagaggaccagttttggaagccagaggaaaaaaaaaaaaaacagaaacaaaatgatgtttgaattaaatctttaaaagtttctcttataaatttaccaagccacatattgggaatggtaccccaggcagaaggagtagagtaagcaagccagaaaggaaatactatggtgcttttgagtaactgcagtgtggctgaagaatgtggaaaatgatgaggataaagaggtggacagggaactaggtaagggagggcttccttttaaataattagaccttgtcctgtgtacatttaatgggattttaatcaggccataatgccaaatttctttacttcggaaggatctttatggtgatggtttcagaaagaaattaaagcagagtaacagtggttagcaataatgatcagctagtggttcccaaacttacgtatcatatgcatcttggaagtttttaaaaactcagattttgggatcctgacttagatctactgaatcagaatttacagattcaaattcccagtgaggcctaggaatttgaaatgttgaatgtccttcacgatgcagctagacaagcatttgggaataaagcattaggtgactatttcagtagactaaggagtgggaggccatttaagctcaaaggctattctacttctcactatatttctagtacctagcacagtgcatggtacttgatagatgcatcctttctcccatacctcgccctacacatctcttcatgtgtatccttattaatatcctctattataaactggtaaacatgtttccctgagttctgtgagctgctccagcaaagatgggtttgtgagaatcccaacttttgaagcctgtcagtcagaagttcctgaggccagacttgcaactcctgttgagggggcagtcttggggactgagccctcaacctgacactgtctccaggtagatagtgttagaattgaattgaaggacacccagttggtgtccgctgcagaactgattgctcacctggtggtggagagaacccctcctctcccgatagggttgcagaagttgtcttctgtgttgttgattgctgtggtgtgggagcagaggggggaaaaaagctgttggagagttttttccaaaacaataggagattatttagatttataaaaatagaatcaaagtagattaactgagcacattgtgaaatatagagtagagctgtgtgtaaggagtatatcttaatgtcaagctgacaccaaattgaatgtttgctggaacgttcaaaaatctaagcttcccaaatctgtgaaaacactcaggttagtaaacagtcttatgcaaacagcaagacaatgctcaaagccatttaaggaaaaagaacagtaactgaattctcttatggaaatgtgagatgttgttttagtaagtactgatggtgttatactttttgtttattcgtttgctggtatttcagttcctaaaattccttcaaatatgctgcaaaatacaaaccaagaacttggtggattttccatttgttttcctgtgggaaatgatggaattaaaaaccttgaggattagaccttgagagttaccttccagtgtttatgccaccattatacaaaattctggaggacaaaacccttcccacttaaaaaccagttagtttcagaaaatcacctcatgttaggagactgcatcattatagtatgtgtgttagctttaggtatagatctaaaatatttttaatattttaaaaacttaagcctttcttcattaatttggcctaatacaagttagaataactttaaaaatgagtacaaacaacaaggaagggccaggcgcagtggctcaacgcctgtaatccgaacactttgggaggccaaggtgggcagatcacctgaggtcaggagttccagaccagcctggccaacataatgaaaccccatctctactaagaatacaaaaattagctgggcgtggtggcacacgcctgtaatcccagctactcgggaggctgaggcaggagaattgcttgaacccaggaggcagaggttgcagtgagccgagatcgcgccattgcactccagtctgggcaacaagggtgaaatgccgtctcaggaaaaaaaaaaacagtttctgtgactgctagacaaatgttgagcaagtaaaacaccaacaatgttgaacttagatattgaaatagctgctctgtacaaataaagtctactgggagtatagactgaattaccatcttttgactctttcgccataatgattggcattaccggaagggattaccttgctttgaagagctgctggacagtagagcagagagcatctattaccattgtaggtgcctttcagttaggattttggatttataagcaaactccaagaaagagcctggttctgagtttctctgaatagcttaggtcaagtcctaaattctgaagccaactcctataattccttctttatgtctttggcatgtgaagtaggcaaatttcgaactttataataatagcctagacttacaaatacttgccttggtaatcaggatgagtttttgagagacaacatagtctagtgttaatcgcgtggacaccagactgcttgagtgaaatacaggttctaccatttattaacggagtaatgttgggtaagctatttagccagggtccttatctgtaacatggtgataataataaagattaaataataggtgaaaaatgtttagaataccactgtgttattagtaagcaccatgcataggtgtttggatttaaaaatactggcaaaggccaggttgggtggctcacacctataatcctcgcactttgggaggccaaggcagaaggatcgctttagcccaggagttcaggaccagtcgaggcaacatagattccgtctctgcaaaaaatttaacagaattagttgggcatggtagcgtgtgcctgtagctacttgggaggctgaggtagggagggggaggattgcttgagcccacgatttcgaggctgcagtgagcttatgatcatgccactgtactccagcttgggtgacagagcaagactctgtctctaaaataaaatgaaaataaaactgcaggcaaaaatgccaactgaagagtgaacatgaacttttctttgcatttttcttgggcctgagactttaagaagtgcagggcagttaaaatgatgagatataattctcacctatcagctcagcagaaattaataagattaaaaagatgcgtaatatataatattgcagagtgcatgggggaattgatatacacattcatgaacaaaaatgggcacagaaccatttggaaagctattgtgtattttaaaaaatttcagtagcacattttttatatcatgaaatttcacttcagaatgtcagtcctgtagaaatactgacgcaagtgcaaaaacaacaaaaaccaacttgtaccttcaaggccagaaagagttatttcaccaaataacataattgaggtacattaactttattagaagtaaatctgataatctgctcacattttaaatagttatggtttaacttcagttcttgaagtcacatatttttacaattaggaatgctaacaggctttttgtgcaatacgaaaagatgactttaaatgcctacaattattttgtgtccttttatttttttttaatttttactgacctactacaaagcactaaatattttatgttcttaatctgaagaacaatagacattctctataaaacaactcttgcttattcatgaactttgtacacaagaagcttaataagacgggctcaaaattatttttctaaatatatttcctatacaaaataatttcaagatataattgttacttttgtgtctaatactgtatgttaaataataaaatggtaagcatgtaaaaactacaataccacaaagattgagctattttgccagtagtatactccaactttagttctagaacagtcgtagaaatgggtaaacaaactgttttaactgtactcttaactgaaatatagtaccttatgcagtagcagaacatatcagcagaagaacttcacttgacctgtacttaaaaacaaaacagatgcaatttataaaatttagagaaatatagtgaccttatttgcatgtggaaaatgtacttctttctgatctacatatcttctgttgtgcaatgtaagcagtaaaacaaatagtacaggattcatctctgtgggacctagaccccctggtctaacaaataattcttggtcagtactgtaattctgtggtataaaactgataaaattagccttcctgtgactagacaagaagccgggcagtttaaatgctgaaactcacaagaacttcagaagctttagctttaagctttaagcttacttagaaatgttataagacctccagtagtcacatatgaagaatatcatgaagatttttccattaaatctttattatagatcccttgattggtttctgtctagactcattgtgtgataaaggacataataatttttatcaccttcatctaatataggtttgtcaactctatattagttgttttcttgaaggctggttttcttccaaaattcagtcttattttcagtctacactagcttttaaatatactgtcctttagatgctttatctaacctcaaatttctaatggatttgtcttagacacttattgccactccttagatagtcattgctatctttgaagttctggacgatacgtgtattacagaggaactggagacattccatcaccatagttagcttgattggataccctttaaaagcatatactcgcgcctgtaatcccagcactttgggaggccgaggcgggtggatcacttgaggtctggagtttgagacaagcctggccaacatggtgaaacctgtctgtactaaaaatacaaaaattagcctggcatggtaccacatgcctgtaatcccagctactcaggaggctgaggcaggagaattgcttgaacctgggaagtggaggttgcagtgaaccaagatcttgccattgcactccagcctgggtgacaagagcagaactccattaaaaaaaaaaaaagcatatatagcacatattataaggttttcaattttttcaccaagtgtttcatttgggtagtcatttattggtagtttacatcagttgagtggttcagaaaaaatacagtaagttgcttataaaattctgaacactttggccaggcacaatggctcaagcctgtaatttgagccctttgtgaggctgaggcaggagaattgcttgagcttaggcgttcaagaccagcctaggtaacaaagaacgcctggaatgattgtggcatttgaactaatattcaggtttaacaagagataattgaccatcactctattttagaggctttatttgaaccagatagaaatctatttcccacagctatcactgcctgtcacctacaacttaagggggttggggaggaagtgagagattttctgttagggccaatagggacctgctagatacccccccatcctgggaatggtgtatggaactccagtgtatgctggagttattatcatcatacttgtttttttattttactcttctgcttatacagatcaagtcatacgttttatttttaagtttaaattgaaaacatttacagagaacaatgcagtgaaatgaaaaaattacagactgctggcatttgcattttcatgtagcctcagtgactaatttttttttattgtacagcattgagaaaatcctagttcatataactagttatagttcatatagattcatataactagttttaagtgataatagtttcttcctttttttcctccaccatctaaccagatgaagataatagtttttaatagctcaccgtaaatttcaaggtactcaagttaaattgatctagatgcttgagttgaaatttttctatcaaagttcaataacatgcttacattccttattaaagtataaaagtcctataaacacacaaacttgagtaagtgctaaaactagtatcagtattgtcacaatacaacatgttatattgtaacaagagcatttgctgagaactgtgcttgttactccagaatgttgcttctatggttgtacctttcaactttgcagatcatttggaaggaggagagatttggggtggagacaattcggtacttcattcacaggatgtaaggaggattaagtaaaataatgctggctaaaagtccttatttagcatactgcccaatgctcactaaatcataatagctgtttttaacatttggtgaagaatctatttaacaggagtgagttgaggggcataggagatcatgtgagtgtttaaagtagaagcagcattccccattaagaagagaaatactgtggaagagcaaagactttaaaacacctgggttcaaatcctatttgctacataatggctacttttaacctattgaacgccagttccctcatttgtaaaatagggacaatatttaacctatttacaggttgtgagagaactaggcacctagtacagggtaatgttggcacatggtaacctttaataaactgttgctattcaacaagctattagatgtcactaggcagttaagcaaaggaagacagcttttgcttggtgtgacaatgaaaatctttctgatttccttcttggaagagttccctgaagatatgtcattgtattgacacctttatttttgctaacctatccctctaaattctggatattgtgtgtgccacagctttttttcttccatattcctgcatttatttggcacctgttgtgccagtaatagataaggggctgctaagggaggaggcaacctgcactggcttatagctgctaatgtcagttcctatagcttatcgtcagtgttattcatgtggtaaaagggtgagaaagtactggagtctaaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgtacaggctactttaaatttttgcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgcacataatttgttttgctttattctcttaaacatactctcaattcttttctaatataacatcctttttattacctgcttttaaagctttagtcaggaataagatactggcttttcccctcccccctttttctcctgttccatctacctttcttcctttaaaaaacatgactcaggccgggcgcggtggctcacgcctgtaatcccagaactttgggaggctgaggcgggtggatcatgaggtcaggagttcaagaccagcctggccaagatggtgaaaccccatatataccaaaaatataaaaaattagatgggcatgctggtaggtgcctgtaatctcagctactagggaggctgaggcaggagaattgcttaaactcagagggcggagcttgcagtaagccgagatcaagccactgcactccagcctgggcggcagagtgagactccgtctcaaaaataataaaataaataaataaataaaaaacattactcttctttcttcttctatggtttgctttgctgcattactttaatcatgaaaagcagctggcacatctaattatagtttttctagcttctggcctgcacttttctgtgttgaaatggctgtatatattaaataaagtgtctgcgagaaaactttgtaaaaacatctaaatattatatcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttagtttttaggaatttcattttgaaagcccacctaattgcataaataattgtgtgggtgtgagaaataaaatggaaaagtaaaatcatgaccaagagagttacaaataactttttttttttttttttaagatggggtctcgctcttttgcccatgctggagtgcagtggcacaatcagctgactgcagccttgaccgctgggactcaagcgatcctcccacctcagtctcccaagttagctgggaccacagacgcgtgctaccatgcccagctaaatttttaaaaattatttgtagagacaaagtctcactatgctgctcaggctggtcttgaactactgggcttaagccatcctctcacctcggcctctcaaagtgttgggattacaggcatgagccaccacgcccaggctaccttttttttccttttctttttaaattgtgataggggttcttgctgtattgcccaggctggtcttaaactcctggactcaagtgatcctcctggctcagcctcccaaagtgctaggattataggcatgcgccaccacacctggtggagttaaaaattaaaatacaccattaaggcaaggagaaattataatacaaatggcagataataggactttagacagtcattaaagttgaggtgccagtttgagtctaaggcccaataaaaaaagttcaccagaattttaagacaaacaactgcttatttgacttctttggatgttctcaataattcgagaccgtgtagttagattataaagtattacattgtggatgcccacatattaacaaaaatagagagtaagacctctaattcttaggaattaactgttaaaaataatcaagtgttccaagattttttggaaactacctcttgaattaaaaaattaaagtctttctacatttttatcttgttaaacagtgtatactgatcataattatttaaaaaatcatgtgttctaagatttttggaaagtacctcttgaattacaaaaacaagaaagtctttccacatttgtgccttcttaagcagtgtatactgatcataattgaacttttcttcatgatggaaagttaccacaaggaaaatttcttatgttctgctgttctttgttgctctccaatttaagtgcatacgtttgtttgcttctatattataaaacctcaaatttactttttgtataatttttgaggttttctttttcatctcatttattataataatagctaacctccattgagagaatgctgtgtgccaggacactgttcttcctattttatatgcttttaactcctttattcctcacaaccctgtgaagttaactgttagacaatttctattttactaggaaactgaggtacagagttactaagtaactttcccaacattatttggttagtaaatggcagagcttgggctgaacttcagtagactggcttcagagtccacgctcattagtcctttggagcgcttttcatattcttgaattctcacattctgtcttttttcactctgtcagcaggacctgactcctgtttttaaatttcatattgtgtttttactgttaatttggaaaacaaatgcatactttttagaattctgtataaaggaggagtaaatatgctgtgagcaaggacctaagtgggttgtcaatgagtttaatatatgagttctaatgtgcagagttgaggtttatattgactgctcagtgcttccctggggctagactataaatggatggatattaggaagtcttgttctgatttggtaatgatgttaatgcattattctaaatcagatagtcttaatatagtttaaatgtatgtttcgaaccaaatgttcttttttaaagcacacaaacattttgaaatcattactaatgtggttaatgaattattgatgttccattgggaaactaaaatgcagatttttctcttttagaaatcagggactattgcaaagcatcacattttagtgatacactgagagccagtggtgtgtttatacaaatagtcctattttccatataaattctagaaaaatgctttagaatttataaattatacaaaatatgacttatttttagagagtttaaaatttaggtttttttaatggtttgtttttgtttgtttgttttttgttttttttttcctcattaggaaaacactagtacttttcagttaccttgatttttaaattaatctgcaggtccccattcaaaggccttgggttcctttcaaaggtcagtataattcaagcttagtttatgaaggactgaacatacccaaaggattttgcatgtggatctttactgccactaccacaaccatcaacacctacacacacacgacacacacacattctctctctctctctctctctctctctctctctctctctctccccctccctcccgcactccttcccttccccctcctttgctctcatggcatcttttaaaaatatactcttaaatccttccagggagggcaaattcacttcttaatctaagtaaacccaaatggcatgcatcagcaccaggactgcccatctttcctagttccattattcatagagtataggctggaattcatcttgttcctcaagagtccagcatttctagttaaccatgcctacatttaaacttactctcatttcttttctactttacagtgttttttcaatatactagcattacagtttccagatttgatttctctcctgtcttatttccatcagttttcaagtctattaagattctacctcttcatttgtcttttgccaccattcttttccctcatactctactggctcagccctctcattacagtcacctaattctaacatatatattgctgctaagttaattttccttaagttactgattgtgcttttttaaagccccttgttgaatatttaggcaggactccatgtggacatccacagccctccgtggtacagccctaaccttcccttctagctttgccttactactcttctacgtgtactctacattgtggacaaactactatatgctgtttttcaaacatgtcctatttttcctacctctgtgcttttcattctcttacttctccttggaatacccttctaacccatctctacttactgacattctaatgtctctttttctaagcaagacttcttgatttcccttgactagaaattatcttctaagctctccctatccttctttaaagcatttttataagtctcaagtaccaactctacattgtgtttttgttgaccttactatatctactacatttttaacttcttcaggaaaggtggcgtatcttactcatctttgtattgcctacaatatctagtccaggttctgaataataaatatttttatatgtgttctgaagcacactgaccaatgaagataagaaatcaagaggctagttccttattttttttaattttttttttgagacagtgtctcactttgtcacccaggctggagtgcagtggcacaatctcagttcactacaacctctgcctcccgggttcaagtgattctcacgcctcaacctcccaagtagctgggattataggcatgtgccaccacacctagctgatatttatatttttagtagagatggggttttgccatgatggccagcatggtctcaaacttctgtcctcaagtgatcttcctgcctcagcctcccaaagtgctgggattacaggcatgaggcataagccactgcgcccagcaagatgctcttttctcagtcacctaaatataatctcatttttagttatagaaggtttgaaattggagtgaatagactttacttaattctgactttatttctgtagctttttttttttgagatggattctcgctctatatcccaggttggagtgcagtggcacagtctcagctcactgcaacctctgcctcccacgttcgagtgattcccctgcctcagtctcccaagtagctgggattacaggcacccactatcacacccagctaatttttgtatttttagtagagacagggtttcaccatgttggccaggccggtttcgaactcctgacctcaagtgatcctcttgcctcagcctcccaaagtgctgggattacaggcatgagccaccgtgccctgcctatttctgtaacttttgataagtcatttgatctgttgttgttgttttctcatagtaacaaagtagaagtaattttctgcctgctttactagataaattaaggggaaaaaaataagatacgtaaaaatgttatttgttattaaaaagaaagttgttattttaaaggttctataaagacatagagtgcttattagaaattgagctaacacattcaggaaaggataggaagagtttgctgaagttctttctttagggattcttgtgtaccgatagcacagttaaagagcaaactcataccatttttatatttctgtgtatttgactaagcttactggcttcaatgattaactgttatcccaaatatggattatctttcagccaactcagggaatcacagctactgagtagtgtgtgtcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactcatttgcatgtgatctccaaaatgcagaaccgtgtagtaatttgccaatttgaggcacaaacttaaattacgtgaattgtggcactggtgttccaggcttaatcagttggctttgccagccacacaatatttgaatcctgatagggcttaattttctattaatcatggttttatatctttgttcaatgttgaaacatagtcatcagtgcaagaaataactatcaaacagccatgatgatgagatgaatgaaaaagcagcctagactttatacgaggggaattttttaaagagtaatgtataggccctgggcaggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaattactcaatgttaaactatactttccactaaattgaacagaatgatacatcctataatattagattaactttgtaaattaattcagccacatttattgaacatttactctgtactatgaacacttactttactaggtgctatccagaagttaagatgagtctttttttccccaataggggctctacttacttagagaatttcaaagatatgcagtgtgtattttgagcaaagatagattaccttaggttggggactagaaagccaagtgtttgtacatctcttcatcctacatattttccctgagaagcttcaaccttgcccatggtttctattactatttcccacatttcttcctgtaactaattctatttaattgccaacttaatatttctatctggatattcttctgtattgtaaactaagtattactgtaacaactgtactactactgcccccaaacaacatcatcatcaaaaactgcctttcttcctataatgcttattgtggtttaatacaccaccatacacacatgactccagcaaaactttggaagtcatctgtaacttttcttttacattcattggctacatacagttggtgtctaaatcttacagatttactatctacatatatctcttgatccatttcctcctttccatccttgcactcctgccattgaattcattagctcattattactcttgacttgagttgttggcatagctgcctttttgccaacagatttgtacccttataatctttcatctaagttgccagaaagtgggtgtcctaatgtgaaaatcagatcatgtcattctgttgttgaaaatgcctcaaatgcttccctccatctttgcacacaaaaatattttgtttataaaaatactagatgagggaagtaaatttttcatttatcaaaagaagatgtgtattttagaagactgaaaaaaaatagacctacacaatacaatctaaacttagcatggcaaacaaagatatttatgctctggccctaactctgtctttggaatcagatgttagattcactcatggcttgcagctctgatacttacaatgtggccttggccttggtacttaactgttgtaaaattcacattccttatctataaaataagaatcatggctgggtggggtggctcatgcctataatcctagcactgtgggaggcagaggtgggtggatcacctgaggtcaggagtttgaaaccagcctggccaacatggtaaaaccccatctctactaaaaatacaaaaattagctgggtatgggggcacatgtccgtaatcccagctacttgggaggctgaggtaggagaattgcttgaatccaggaggcggaggttgcagtgaaccaagcttgcaccactgcactccggcctgggagacggagtgagactccatctcaaaaaacaaaaacaaaacaaaaaaaagacctcagaaggatgttgtcaggattaaaggagtccattgagtgcctagtacagatagtgaatgcttcactactggtgtcaactttaagaaaatgaatatagaaaagctaagaattattttaaggtgtttactactagcatgtaaatgtatgatgggacagagatttccatcctattttgaggaattattttttatttttttgaaaacttaaggtaacaaagtagagaggaggccagggagaaaggaaggtagtggagcaaaaatgagaaagggagtgacattcccctctagttatagcagaaaattagcaaaatgatcatgacaggaggtaacagtaaagacagccagctcatatatcaaccaagacagttttgagtttgaccagcagactgttattttctggtttagagctctttccaggaacttcttgcatctataacccctgagaaccaagctatggaaaaaattttgctcaattttaagaaaatctaacatatcaagctcctcaactccaaaatattccacaaatagctgctatttactatactgagtaataatcatttaaaattattcaacactttatttgagcatctactatgttcatggcactaaagtagaaatgaagatgaacagttcctgcctcaaaataaatgagtagtatactgctttagatcatgggtttcctagtccattaaaaacactttttggtcatattttctggacaccccgacccttttggtacagaatataacctatgtaattctctaaagttaaattaacctcacttttcttgctctaatatgtgtaaaactgaccttctaggaaagcatatacagtttatatttttgacttcttggtatcttttagtgatagacatacctcagattgagaagcactgattgacattagattaaatcagagcttcctatgacaatataaacaataccttcattaatctgatccccctacctacttcttcagcatcatctcatatctgtctccactaatcatattatagaatctttgttacctgcaccatgttaagcatttttaaaaatcttttgtttataccatacctttttcctgaaagcagttttgcctttcctttgtctctagtcataagtctcctataagaggctgttcctcattctaccattcctttgcatggataggattccatggaatagattctcatcactgcatttatcacattatttcctaagtagtacagtacatctactggaagattagccacgtgttgagttttgtctttgcattttcatgcctagaataatgccgggcacacataggcatattaagatttgaatagtgaaaaagtttttaattccatggggattttatttaaacagaaaaatataagaccaattaaaattatttttaaagcataatttcaagaaatatgactgattttgtttaaaaacatgttttcctttataatgctgccacctggtgttgctgtgtttagagatgtccctttgtaaagaattgagggtttgagttgagtttggtttggtttttggcaaatcagcttttcctttgtatatttattttgtaataaactatggaagatcttgcctttaagtgtgagaacacaagcaatgttacttttatacctttatagaatatcttgcctatgtccttcctgtagttaggtagggttttttttttgacacacagcatgttatataaggtttgcttgcacctcggtaggaaagtcctctgaaatctaaaggctgagaatctaaaagcttaactcatgttttgctcctagaaagacttgagaagagagtatttctgttcagcatggtactaagaagacagctttctcttcctcatgtcatggttgccatttcatactgcttacagagaataagatctagtctctgtcttaaataaaggtctactctctgccagcgagctagatagggtaattggattgttttccaatctattttcatttgaaatattgttttatctgaaattactcccataatttcatgtaatgccaaaaactaaactaagtacaagagcatcttcaaaaaccaacataattcctttagttcccatttagtgtagatgctctttggttgatgatattagaattgtgtaatggctattgatctctcaaagtgaggtgttgcctaggggcttaaaagttactacataaagaatttggctttatgaagaaatgttacagattttatctatattttaaaataagtgtaagtgactacctttataacttttaccatgtagtttagtagtatttcttatctgtttattaataccctgccttgttaccaaaagtatgtataatgagatgtaataagaataggtaacaagtaggctgggcacgttggctcatgcctgtaatcccagtactttgggaggccaaggcgggtgaattacctgaggtcaggagttcaagacgagcctgaccaacatggagaaaccccatccctactaaaaatacaaaattagctgggcatggtggcacatgcctgtaatcccagctacttgggaggctgaggcaggggaatcgcttgaacctaggaggtggaggttgcggtgagccaagatcacacctcattgtgctctccagcctgagcaacacgagggaaactcttgtctcaaaaaaaaagaccaggtaacaagtttgggtgaacaggattaaagagttaaataacaggaggaacctagaggacttaaagaaatgtgtggtgttgcatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggttatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtacaaccatgcctggctaatttttgtatttttagtatagacagggttttgccatgttggccaggctggtctcgaactcctgacctcaggttatccacctgccttggcacccggcctcttttagtttctttaaaatgtacaattaaattattttttactatagtcacccaaaacaagtacctttgacataagatttgattctgaattttactcaaatgaatgttaagatccccaagataagttaaactttcgactatctcacctgtttaatctgtacctatgcatgacttcccactgtgcttgaggatacctgaatatcactgagtttgtgtgactgatcagccttgaactcaagagtaaatccaagtctgcagtcaggacaccccaatcctcaaaataataccatcattagcatttatttagtactttctcccaaatcagtatttaatttaaattgccaaaagacttacaatgtggtatcaatttatatttaaatatgctacatatagctttttaaagcatctttggttctctggaaaccatagtcagaatttaaggaagttattgcggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccat

SEQ ID NO: 15033 - DNA, 13693 bp, Human
tacaccctgtgcagatgtatattggctgggtggggggtgggggggatacctgttgtgtttattttgaaaatgcaaatctcggggcagttttttttctggtttttgggctgggtggctttacaaggacacttcccccttccctcctggcactaagggcagtcacatcctcactggaagtagtggctggaggtccagggcataacccctgacccagggaggatgaaccggaaattcagtcttgcagagccctctgcacagcacaggagctgggcaaaatttggagaaaaggaaaggtcacgttcccaccttggccacccctctcaggtggggctggggtcttcccctacccttcagatgcattggcccacccagccccccatcaccaggccctcccttttgccacccccatccaatgcaccttgggtctgggtggctgggactgcacgagaaggggtactcctgccttgctgagctgcagcccgccccccgcaccaccacccgcccagccagaggccacttctaacctggggagacaggatgcgaaagctgctcactacccaccggcttttgggtgcagccttcaggcctcttgttccaggaggcctggaaaacgagcggggctggaaggcatttagataattggaagatgggccgggcacagtggctcgtgcgtgtaatcccagcactttgggaggcctaggtgggtggatcacgaggtcaggagttcgagaccagcctggccaatatggtgaaacccccgtctctactaaaaatacaaacattagctgggcgtggtggcgcgctcctgtagtctcagctactcgggaggctgaggcagaagaatcgctggaacccgggtggcggaggttgtagtgagcagagatggccactgcactccagccgggttgacagagggagactccatcccaaaaaaaacaaaacaaaacaaaaagaaagataattggaagctgctccgcttaaaacgaatgacaaattcagcctccctggtctggtcatcaaagaaacaccaattaaataatatggtgccattggcaccaagttagccaaatcatcaatgggcgtgatacttaattcgcttctctggttgctgacaccctcctcgacccccagccgcggaaatccattcctagttccaccgtttagagcctctcctggggctgccgcgaaaattgggccggttggggtaacatctaacctggggtcccgcgaaagagcccatcagttccgcttgggggccccactgccctcccacctcctacgctgggcgctcctcctgcgaatgacgttttgctgctgctcagggcagccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttcccaggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcaggtaggacaccccaaggaggctgcatatgggggtgagaggctaggtctggagtcctgggcctcctggagaactgggcatggtagtcgaatccaggaggtggagtccggggaggcatcctgagcagtggagaggtacgcccttgttccctcctaggggcccaggacatgggaagtgagacctgggctgtgccccccacacctccaggtgacctgctctcagtctgcacaagcctctccaaatcttctttcccctcactccctcctccctcattgtgcctccaccacgctgcctccgtaatctctgcccggatagccaccattttgccccaggatgggaatctcaagcctggagagggaacttaagggtggcagagccgtggagcactcacacatccatgcccctgctccctccaccccagttctgcccccagaattaagacaattaattaaacactgatcctgctccctaagtctgcaaggggagagctgggttgttccagtaggagaacctggtcttggtccatccttcaggaagggtcctggaaaggtgggggtctgacagtttaggggaaggctctctggggcggctctgctagaccaccaacccttaggctggcctccagccaggcagccttgctcacaccctgggctcaccttgccctgctcctgagaggacctttcctaaaccagtcaacgaagagaagacgctttagggcctctgtagaatgaaccttccttgacctgagaagagggggccctcagggccattgctttcccggtgtagtgtttcgctcagttcttttctcagcaagggagtgggaacgtgggctagccaggccttgagccccacgtttacctttctcctttcccgggtccctgttcccttcccagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtgaggcccaggggagcctggggagatctgcctgtgtcaggagagtttgtgggggctgcctgggcctcccaatttccctgccgatcaaactaacatcctccccacaacctggtgggcccaggagcctctcccccaccctccacagaaatgggaggaagacacacctcttgtggggctcaccacacccaacgcggactggctgagtggatgagagggtggggccctctacggagatgagatcttacctatgtaaaaccacgctccagagttcctaaaccacaaccctacctgggaagcacccagggctgagagttggtctttaaaacattcttagcctataacctcttctttaaaaatctgttgtctcttctagaacaaattattttaaaccagttcaagaaaaatgcttagtgagcattgtggtttaaagacgcatatgaaggaatttccatagtaaacagggagtggagccctgtaccgtctgggggacgatgtgtcagctctcagggtccatggttgggtttttgtttcattttctaatgtgtcaaagtccaaactagaaactgttttttttttttttttttttttcatattgggacatggtgggggaaagaatacagaaagtgccactactttcaaaccaaggtgctctgtcccctcaggtctctgcatggattcccccagccctatggacccccacatggcggagcagacgtgagtagagaagggaatgtgtacttccaagcattcagcacctgtctttaagaatcctagttctaccataaattcacccgggaggcctgggaaagcagacagaccatggggtggcttcaggatccccatggccggggggctcactgactttctcaggccttggcattctgctccctgtctcagagaaggatctgctctcatgggagccaaccgagtgtgggctcagggccagggatagtggggacagtggccactgggagagcagatactagactacagcccatgtcttgcaggaatacaagcccagcgtatgtcccgtttttctttcttgcctatacccatttttttctgtgaaatattacaatttaaaaatatgatccaactaattcaaaactttaactcactctaggccaaacaaaacacagttgcctgcagattgatttggctcttggccgatcagcaacctctgacttcgatgacactttaccctctggccagccctggtctaggccctttctgcaagggaatggagagagagttggtgggctctggcctggacagaccatccccttggctgtgggcatgggtggtgtcttccagagcacagctgttcccatccagttgttaaagcccaagcagcggggcagctgccagccattagtagggacagctgggcatctctggcctgtgctggggactgtggctttgggtttaggatagtgacttgtcttacctcccattgcctttgatcagactgggttgggctgcagattggttcacaaacaggaaatggggagaggattgggtggggttgggggactgcaggttggttttggtggcagcacagagcaatcttgccctacccccaaggcccatgtgcaagccaatgaaattggtcatccctgatgccaggttggctgggcacagcagccccccgggggggcatccccctcatactttatccctgagtggttccctgccctgcacctgctctgacagttatacagagtttctcagaagctgtgtgtgtgtgtgtgtgtgtgtgtgtgtgtgtgtgtgtgtgcgcgcgcgcgcgtagatgcacaaaagctccgcgtggcaggtggtctcctgtaacacggctgagggggcggggcctcagagggaacatgtgttggaattccttgcctgctggcctcttctaaggcaggaggagggggtgggacagaggctggtcctggaaaattccataggagggaggagaggatgtgagcctgcacgtttgtcactgggggtctactgtatcagactggagctgactgggggagccctaaagcaggccccagtcctcagaggaccgggagccaggccagctcctcacaggggagaggaagcctagccttgctgttgtccaggccctggagacacccacattgctgggtgcccctggcctatcataggatggatggatgcctttcctggcagccatatggccccgctgaggtgatttgcatacaggtggaaggcctggtgcaggctggcgagactgttgccttggtgacgcctccctgaccctgacctgccccagctgtctctatcactgccattctctgggctttctttcattcagggcagcctttaaaattccaagctgcctcttatcttccccctccccaatacctgggccccctgatggtgggcgttcttcccaccccaccccttccactgccttgagccttggcccttgtctttgcccttactcccccctggactgggggcctggtgctggggtgggtgatgggtgcggagggagcatgggttgcatgggacccttctctgtcctaggtttgaacaggccatccaggcagccagccggatcattcgaaagtaagtgttcctgggcctcttccatctaccacaagctttcccttaggacagggctccagaagggcatgctgcatgctcttggtccctgccctgcctctcccagctctcacctgtccccatttcctcctgtagcgagcagtttgccatcagacgcttccagtctatgccggtgagtgtcttcgaggcctgactgaggcttaggcatgctagccaggcatggggtagatgagcaggatgcattcagggatcacctcccagctgggtgtccccaggcaggctgtaggagatggggtttcagaggtaggtaggtaagtgggaggagctggaggagaggtggagaaggtagggcctgggctcgtgccggaggaatgcagccttcattcctctgcctgccgccctgcctggctctctaggtgaggctgctgggccacagccccgtgcttcggaacatcaccaactcccaggcgcccgacggccggaggaagagcgaggcgggcagtggagctgccagcagctctggggaagacaaggagaatgtgcgcttctggaaggccggggtgggagctctccgggaagaggagggggcatgctggggtggttccctggcatgtgaggaccctcctctcccatcttggctgcaggatggatttgtcttcaagatgccatggaagcccacacatcccagctccacccatgctctggcagagtgggccagccgcagggaagcctttgcccagagacccagctcggcccccgacctgatggtacatccagagagcggatccctgggaggggcctggggaggcagcctcggagaagaggagggtggccctgaacccccaggcactgggaacttttcctcaggaggatgggggcgggaactatctccacctctaagtctgtgtctgtctgtcatgtggacagtgtctcagtcctgaccggaagatggaagtggaggagctcagccccctggccctaggtcgcttctctctgacccctgcagagggggatactgaggaagatgatggatttgtggacatcctagagagtgacttaaaggtaaacagccttgtcccaccaggcccctaccttcctatccctgggttcgcccaaaagaagagagctctgagcccttgtggcaggaccatgatgtcattccagtgtcagaagaagaatctgaggtaactgagtcacagcctaacctctggccaatgagagaagaacaggtggctggtgccacagtggagggcggtttgggaggtaggggagcttctcaccccaacctggagtttgccagggaaacagggaaggctgtgctggaggattccgggactggaggggtttggcctatgcctgtgggttgtgaccctgtccttgctaatctggcctcaggatgatgatgcagttcccccaggcatggagagtctcattagtgccccactggtcaagaccttggaaaaggaagaggaaaaggtgggcctctggggtggccccctccgaatttggaggcatggggtccatcctactctccagtggatttgagggatgggacggggcctgggcaccctgatccctaacctgctgtccctgccaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctgtgagtgccttcctcctggggttcactttggcatgcacctgggcagccacccccttggctaagtttgtggcagagggcaggtggcagcctgggcatggcagagaaagggggtaccagccagccagagcactggggggcagccccaccctgaccctggcctccatctgactcactttccagaaagcccgcgtcctccgctcaaaatcactgtgtcacgatgagatcgagaacctcctggacagtgaccaccgagagctgattggagattactctaaggtacctgcagcagcgaagggggtaccttgggggcttgacctcttactgactaggggtcctctagcccaggggctgcttgggttcctccctttctccccggagccccccttttctttgtcctttgtatcttttcatcctttgttctcacatagactcctccctctggccctccttgtctcctgactccacctcaagtcagtccaggcatctgttgagtctccgtcttatttccaagctcatacctagcttggaaccccctcatgcctcaccttcgggcttggcagagggtagggagcagagtgtggagttcatctcttccacttccctttttcatttctctttccccttggaaggttgttccctgggtgtcagacccaagaggtgcctctcagttgccatgggaaccagaactgaatttgaaggccaaagcaggtgtggcctctgattttgggaatgaaacttcattctttgaggctcctggtcttaccaatttaactttctcccctctccctcatcccttccgttcccttcaggccttcctcctacagacagtagacggaaagcaccaagacctcaagtacatctcaccagaaacggtaaacagcgttgcgtcattttctaggcacatttgggactgtagctccattgttgaccttccctggggacaggctagggccacctgccagctgccagcctgacctgccggaaccaacccccatgacctcctacagatggtggccctattgacgggcaagttcagcaacatcgtggataagtttgtgattgtagactgcagatacccctatgaatatgaaggcgggcacatcaaggtaagatggggcaatggggagaggccctgaagatcccacctggtttaggtccttgctttgccaagagggtgaatgggtggaggacgggtgccccctctcatggggagggttcctactaagagaaggacagcgactgcacggggagggccctgactcctggacccggggctgtgcctgacctctggctcctctgacagactgcggtgaacttgcccctggaacgcgacgccgagagcttcctactgaagagccccatcgcgccctgtagcctggacaagagagtcatcctcattttccactgtgaattctcatctgagcgtgggccccgcatgtgagtcccagctccgcccagccagctagtgtctgccctggccttccctgcccaggctcacaggtgctggcaccattgagatggccaggggtgcaagtccaggtcctcctctgtcccatctgatggcctagagctgacctcagccccacttcactgtgcatggtacccgcctcccatctccctcactgtcctgcctatcaagcctcatgtccaccccacatccattactgccaccctcagaaaatttagttccaagtctctagcggtgtcttttctcgaaatctaagggccgcgtgtcagtccccagtacacggaccctccccatgttcagtgctgttaggtctccattagaacctcttccattggcatccacagcacctgggcctccctggctgagctccttctgtcgctattcctgttctgcctggccatctgtcctcccacccctgcctcctcctgggttgccactggtccatatgactgctagtggctccccagcctggcctcacccatgtggtgggaatctgcacccagacgccccttacagagtcgcatccctgcggccctcccaacttctccaggcatcccagcatatggcacccacctccacctgggcaccgggcctgggcactggcttcagtcttgggtcctcctcctcccttctccccaccactgatcctcaccaggtcttgtccaggagtggcccgaatggatcccttgaatttggcccacttgtctcctctcctgcttctcctttcctggtccaggcacagatatctctaacaaagattgtgcaactgccttctagaaacggagagttcatccccttgattttacctccttccttccgcctccccaccctcttctgtagccagagtgacctaaaagtgttcttgtggttacattcctgtgctctaaagctttctgtggctccccaaggccctcaaaggaggggacgtgggggataggtcccatgatgtacaagccactgcatgccccactctgaccacaccctgcccatgacgccccaggtgccgtttcatcagggaacgagaccgtgctgtcaacgactaccccagcctctactaccctgagatgtatatcctgaaaggcggctacaaggagttcttccctcagcacccggtagcgtgggtggggaaggccacagtctctgtgtgagggttggcttggccaggctggagccatgggatggggggtgggagggttgggtccctgccaaacttacccattccactgcattgacccctcctgtcctgccctagaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaccagcattgtgtcctgtggggccctgggcaagaccccagaagcccgccaatggcgggattggggtaggagacagggtcagcaaaggcaggaagagttgctggagaggtgccctcatgctcttgtcccttcttctcccaatgtcttccatctcttgggtgacactcctgccaggactttggattcaacccctccttcccctcacctggcctcccaagcacttctaggcttgcccttcctaaactcggcaccaaaaggcaagagtgacctcatcactcaaggatcatcagtggctccccattgtcctcaggataaacttaaagccagctgcagtgactcacgcctgtaatcccagcactttgggaggctgaggtgggcagatcacgaagtcaggagttcgagaccagcctggccaatatggtgaaaccccatctctactaaaaatacaaaaattagccaggcatggtggcacacacctgtagtcccagctaactgggaggctgaggcagaagaatttcttgaatctgggaggcagaggttgcagtgagctgatattgcgccactgcactccagcctgggcaacagaatgagattccgtctcaaaaaaaaaaagaaaaactcctggcatggccttttgagatttgggccctcgccagcctcattccctcaagaaattgggaaagggccaatctgggagcccaggccaaacccagatctctgaggaaatcctccctgaataccactgcaggtgaccctccccccagccccccacacacaaatgggagctgtgcgatgggagggactcctttatatctgtatatataagatgctgtctttgacacagagtgcacacacatgtcaggcatgattaccactttctgggacagttcatctatgttgtgaagtaggtgatgcaatgattatccaccccgtttttcagatgggaaaatggaggctatttcctatcagaacagaaaaaggggactccagatccccatgctgagtctaaaggacacttgtgctatctctagcttgttctctcaagtttcttatgcccaagagcttggtcttcactcctggttcagagccctctgcaagggcacaataggtgggagttattggggtgtggttttggtcttggggctgggctgtgctcagggagggaagggacctcaagggttcagaagtcccctccacctagcaggcagcgatagaaaggcaaatgtttatttggtgagaggatttgcccagaaaaggggaaacagctgtgcagatccctgagaaagggagatggaggaggggagaggatgggccccgggcgccatcatgctggcatgcctgctccaccctaagtgcttagggagtcttgtgaagccaccctccctcctggtttcacagacgaaagcagcttcagaagctcacagaaggcactcacttgccccagggcacacacaagatgtaagcagagcagctatcccagccttcccaggagtatcccatccccccttacctcccatcttagtcccagagcccccaggcgggtggggctgggcagcctcacttctgctgtgagcgtcctcttcccactccgggatcaggccacgtgatgaggaggaaacatgggctgagtgtctacaatgcccaggctttgtgccaggtgctgatgtccgtggccacatctgtccccattgtaactcaccatcagagtcttagttgcagccatgggacaattagtatgctctagacacttttagatataatgtctcctaagcccacccaacaggtattcagctcattttgtgggagagatgcgggcattggtcaagccaggagacacctcttccccaagaaaaggctctggtgctgacatctctgctgaggaagcaggagcctgggcctgggcctgggaaagggggtgctgtgggcttgcctctcagtttctgactcgggaccccctctgccctggaaagttcagggggatggggcagaggtgtctcatctcccttcccc

SEQ ID NO: 15034 - DNA, 13693 bp, Human; identical to SEQ ID NO: 15033

SEQ ID NO: 15035 - DNA, 13693 bp, Human; identical to SEQ ID NO: 15033

SEQ ID NO: 15036 - DNA, 13693 bp, Human; identical to SEQ ID NO: 15033

SEQ ID NO: 15037 - DNA, 7711 bp, Human
aacacgccgggtgtggtggctcatgcctgtaatcccagcactttgggaggccaagacaggtgggtcacttgagcccaggagttcgagaccagcctgggtaacatggtcaaaccccgtctctactaaaaatacacaaagaagctgggcgtggtgatatgcgcctgtagtcccagccacttggaaggctgaggaacgagaattgcttgaacccaggaggcagaggttgcagtgagccaagatcatgccactgcactccagcctgggtgacagagggagtctctgtctcagaaaataataataaataaataaataaagtgaagaagtagatgcttattaagttcagtggcctggctgtacagcctggattgcagcctggaaccgtggtctctcaagtcctgacctatgggatttgcccgactgcttggtgctcacataacttggcacacacgaagtacactgtcctgaactcagagccaggtgctcactgcctgcccagggcctgcacagtgtctgtaaataccagagctggataagggatggcaatgagccaggaggcaatcacccagggaagtgcatggtgagcagcacaggctttgggatgaaaagagaactgggtttgaatccgaaatctgccacccacaactgcagaggtcaccttggttcacctctcagagcctcagtttcctcatctgtaaagtgtgagtaaccatgctaccaacactggcttctatgaggatccagcgacttcatgtatgtcaagcccctagtacagtacctggcacatgagcgctcaataaatgttagccacaaagcaacccacatgcaagcaacattgattcagggcccgctagaggagctagggagaagatagtcatgggaggagatgcagttgaagaagacatacacccagtcctcagagggatgggcaaagatggcagctctgcacccacgggggcggggctgtctggggaggcagccaggcctgcagagccagttcaggccctcttgtcaccccacctgcctgcaaggatggggaatggtttgaaaacagccctcccccatccgtccctgatgaccagcacttacccttctgctccccaatcactaaccctcttgcacccccttcctgatgtgcagccctccccacttcctcccaaccaccatcgctctcccacccctccccgaagatcagttctttccaggctgccccacatgcctgtccctccctctccgacgtccagcctagatgcggggggagggccacacccatatttcctggggtggggtgggcagtggctgacctggctttgcggatggagggatcccccacgttgggacccgcgggtgcacccgagggcaggccgatcactcggagggcttggtcacggactcggggccgcagaccacccggcacgggccgggcggagccggagtctggtctccttcaaaggcaggtgctgggaacagaaactcagaatctcataaagtcacgcagaccgggatgacgaagtctgaggctctaggaatcgcggactctccgaatgaagagcgggactggatttccacatagactgttttgataactaaagtgcacacaacaagtgctcgagggagcaggggtcgccgcggtactggggtctcggaatgggactacggacccctcaggggaggggcggggctctgggattgggtgacggggaccggggtgacactcacgataaaggaatatgggaaacagctagggctgggatcaccggagccacccttctcagacttctccggagcgaactacccgaaccccctttcggaatctctagcttcagcgcaccgcggtgccctgcttgccagccgtcagcctcaggcgcctgcccacaacaaacatggcgacaagggcgtctctggaaggccgggcagtgacgacagttctcgcgatagccgcgttttcctgcctatatctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaggcctcagcctttctgggccttagcttcttcacgtgtaggtggggagggaggactggaccacctgtggcggcttgggagcccgcacgccctagggtaaggcttgtctccgggcgtttcgccccactggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcagagacactaactcttcttttcccccagtatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaactagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaacccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcagattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaacaaaactgccctgtatgggctgggctgagctcagaaaggaagcctttctttcctttttttttttttgagacagagtttcgctcgttgcccaggctggagtgcaatggtgcaatctcggctcaccacaacctctgccttctagattcaagcaattctccagcctcagcctcctaagtagctgggattacaggcacgtgctaaaagacagggtttctccatgttggtcaggtcaactcctgacctcttgatacgcctgcctttggcctcccaaagtgttgggattataggcatgagccaccatgcctggccaggaagcactttttgtagactatcatgaagcctttcctaagaaatgctctaacaaaaccggaacacatggggagtgtagctctccatccccgaccaactgaagttatgagtgggttgggggcccaggatccattttgctagccattccagtgcacagccagggctcagaaccactgacctgaccactctccgagtcctggactaattctttggtcctgtgaaagtgaggttcacatcatctgttgaagtaactataaactgttactccaacctttcctctgaactcatgtggcttaaagtattttctgctgtctcacgtttctcaagtctcatcttcccacagttctgttccttctgatgaactttatagagcctgtgttcatcactcccttttgttttgcgatgaaccctaaagcactcctgagcagcttgaagcaccacctgggagaggattctgggtactggagtaaagggagttggaagttgtagcccagagaaattgatttcccctatatgactcatttctttgcacattagtttttgccagtgtctctagatcagtgcttttatgtcacctcaggttggagaactgccttaagtggaaaagactgactacctggacctcctgagttagggataggattctatttcagatacagtggcttgtgcctcaatcccagcactttgggaggctgtggcaggagcattccttgaggtcaggaattaagaccagcctgggcaacatagccagacacttttctccaaaaaactagctgggtatggtggtgtgtgtgcctggctacttaggatgctgaggtaggagggtgcaggagtggagacttcagcaagctatgattgtaccactgcactccagcctaggtgacgagagtgaggggctggcacaaaagcattccagtgtcctagaagggactaccaagtcaccaaggaaacagacagtaagcaggccaaaggcaaaaatctggatctataatacaaggggaacacaactgttctccatgagggagaagggagaatgaggagcctggggcagtttatgacacctgcctctgagtccagcatggctgtcacacacctccccattctcggggcttcctattctccatggaaaaggatgtgcctcttggttcattagcagcacgctctaccctcaacaccagtagcctctttttttgttgagatgtgtgtgctctttttttgttgagatggagtctcgctcttgcccaggctggagtgcagtgttgcaatcttggcccactgcaacctctgcctcctgggttcaagtgattctcctgcttcagcctcctgagtagctgggattataggcacatgccaccataccgggcaagtttttgtatttttagtagagatggggtttcaccatgttggtcaggctggtctcaaactcctgaccttgtgatctgcctgggtgggctcttaacagcaacaaactctacaaagactggccctgggtgtgcttttctcagttttggaacatcaaggaatgttccccacctcaaggagattgtggtatttcataggtggctctagaatcccttttct

SEQ ID NO: 15038 - DNA, 7713 bp, Human
aacacgccgggtgtggtggctcatgcctgtaatcccagcactttgggaggccaagacaggtgggtcacttgagcccaggagttcgagaccagcctgggtaacatggtcaaaccccgtctctactaaaaatacacaaagaagctgggcgtggtgatatgcgcctgtagtcccagccacttggaaggctgaggaacgagaattgcttgaacccaggaggcagaggttgcagtgagccaagatcatgccactgcactccagcctgggtgacagagggagtctctgtctcagaaaataataataaataaataaataaagtgaagaagtagatgcttattaagttcagtggcctggctgtacagcctggattgcagcctggaaccgtggtctctcaagtcctgacctatgggatttgcccgactgcttggtgctcacataacttggcacacacgaagtacactgtcctgaactcagagccaggtgctcactgcctgcccagggcctgcacagtgtctgtaaataccagagctggataagggatggcaatgagccaggaggcaatcacccagggaagtgcatggtgagcagcacaggctttgggatgaaaagagaactgggtttgaatccgaaatctgccacccacaactgcagaggtcaccttggttcacctctcagagcctcagtttcctcatctgtaaagtgtgagtaaccatgctaccaacactggcttctatgaggatccagcgacttcatgtatgtcaagcccctagtacagtacctggcacatgagcgctcaataaatgttagccacaaagcaacccacatgcaagcaacattgattcagggcccgctagaggagctagggagaagatagtcatgggaggagatgcagttgaagaagacatacacccagtcctcagagggatgggcaaagatggcagctctgcacccacgggggcggggctgtctggggaggcagccaggcctgcagagccagttcaggccctcttgtcaccccacctgcctgcaaggatggggaatggtttgaaaacagccctcccccatccgtccctgatgaccagcacttacccttctgctccccaatcactaaccctcttgcacccccttcctgatgtgcagccctccccacttcctcccaaccaccatcgctctcccacccctccccgaagatcagttctttccaggctgccccacatgcctgtccctccctctccgacgtccagcctagatgcggggggagggccacacccatatttcctggggtggggtgggcagtggctgacctggctttgcggatggagggatcccccacgttgggacccgcgggtgcacccgagggcaggccgatcactcggagggcttggtcacggactcggggccgcagaccacccggcacgggccgggcggagccggagtctggtctccttcaaaggcaggtgctgggaacagaaactcagaatctcataaagtcacgcagaccgggatgacgaagtctgaggctctaggaatcgcggactctccgaatgaagagcgggactggatttccacatagactgttttgataactaaagtgcacacaacaagtgctcgagggagcaggggtcgccgcggtactggggtctcggaatgggactacggacccctcaggggaggggcggggctctgggattgggtgacggggaccggggtgacactcacgataaaggaatatgggaaacagctagggctgggatcaccggagccacccttctcagacttctccggagcgaactacccgaaccccctttcggaatctctagcttcagcgcaccgcggtgccctgcttgccagccgtcagcctcaggcgcctgcccacaacaaacatggcgacaagggcgtctctggaaggccgggcagtgacgacagttctcgcgatagccgcgttttcctgcctatatctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaggcctcagcctttctgggccttagcttcttcacgtgtaggtggggagggaggactggaccacctgtggcggcttgggagcccgcacgccctagggtaaggcttgtctccgggcgtttcgccccactggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcagagacactaactcttcttttcccccagtatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaactagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaacccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcagattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaacaaaactgccctgtatgggctgggctgagctcagaaaggaagcctttctttcctttttttttttttgagacagagtttcgctcgttgcccaggctggagtgcaatggtgcaatctcggctcaccacaacctctgccttctagattcaagcaattctccagcctcagcctcctaagtagctgggattacaggcacgtgctaaaagacagggtttctccatgttggtcaggtcaactcctgacctcttgatacgcctgcctttggcctcccaaagtgttgggattataggcatgagccaccatgcctggccaggaagcactttttgtagactatcatgaagcctttcctaagaaatgctctaacaaaaccggaacacatggggagtgtagctctccatccccgaccaactgaagttatgagtgggttgggggcccaggatccattttgctagccattccagtgcacagccagggctcagaaccactgacctgaccactctccgagtcctggactaattctttggtcctgtgaaagtgaggttcacatcatctgttgaagtaactataaactgttactccaacctttcctctgaactcatgtggcttaaagtattttctgctgtctcacgtttctcaagtctcatcttcccacagttctgttccttctgatgaactttatagagcctgtgttcatcactcccttttgttttgcgatgaaccctaaagcactcctgagcagcttgaagcaccacctgggagaggattctgggtactggagtaaagggagttggaagttgtagcccagagaaattgatttcccctatatgactcatttctttgcacattagtttttgccagtgtctctagatcagtgcttttatgtcacctcaggttggagaactgccttaagtggaaaagactgactacctggacctcctgagttagggataggattctatttcagatacagtggcttgtgcctcaatcccagcactttgggaggctgtggcaggagcattccttgaggtcaggaattaagaccagcctgggcaacatagccagacacttttctccaaaaaactagctgggtatggtggtgtgtgtgcctggctacttaggatgctgaggtaggagggtgcaggagtggagacttcagcaagctatgattgtaccactgcactccagcctaggtgacgagagtgaggggctggcacaaaagcattccagtgtcctagaagggactaccaagtcaccaaggaaacagacagtaagcaggccaaaggcaaaaatctggatctataatacaaggggaacacaactgttctccatgagggagaagggagaatgaggagcctggggcagtttatgacacctgcctctgagtccagcatggctgtcacacacctccccattctcggggcttcctattctccatggaaaaggatgtgcctcttggttcattagcagcacgctctaccctcaacaccagtagcctctttttttgttgagatgtgtgtgctctttttttgttgagatggagtctcgctcttgcccaggctggagtgcagtgttgcaatcttggcccactgcaacctctgcctcctgggttcaagtgattctcctgcttcagcctcctgagtagctgggattataggcacatgccaccataccgggcaagtttttgtatttttagtagagatggggtttcaccatgttggtcaggctggtctcaaactcctgaccttgtgatctgcctgggtgggctcttaacagcaacaaactctacaaagactggccctgggtgtgcttttctcagttttggaacatcaaggaatgttccccacctcaaggagattgtggtatttcataggtggctctagaatcccttttctca

SEQ ID NO: 15039 - DNA, 47030 bp, Human; identical to SEQ ID NO: 13037

SEQ ID NO: 15040 - DNA, 47030 bp, Human; identical to SEQ ID NO: 13037

SEQ ID NO: 15041 - DNA, 61158 bp, Human
aacagcaggacctgcgaaactctgaggccgctttgtgaggtcctcctctgcgcagcacgccccccacccctctcttggtgccgccgcagctactccctagggggctttgctcttggtggtacgcacccgagaccttcttattcccctgcgtcaccatccacataaacaagagagcaccctgcttgcgccgctgtgggccactgcggagacccctagagtgtgatgggggtgggggctgttaaagtgctttaccggagccaacctcagcaagtgacaaacaaaagcagcaaaaagtacacccaaggcatttaaaaaacaaattgcgtgcttgcatactcggcatcccctctccctcgcctctctctgcttctttggtgggctcacgaccacctgtcgcatccctacgcgtgcctgcgccccttcccaggcaccaaaagccttgcgctccggactaggggcttgagatccggggctgcctggaggctgggggctatgactcagagtttcaggggtatcctggggtgatgaaatccttcttcagtcccccctcccccgaggagtcggttgggttggggagggagggtttcagctcctgtactccagcgttccgaggcccacgtcttgcgtcacgtgtcccgcaacgcaggagcgctttctctggccagcggagaagcgaggagaaagactccaaatcagtcagggagaggagtggaaggagccaaaacgtccctgcgaggcctgcgctcaccagcccccttacccaaagtcccgggcccctggcgccaggagcaggctcctggagccggagccagctcggcactggaaccggcgtcctctggtggcagagagagagcgctactggcgattttcggaccgaatcggcacgctcgtcagatccaagcaggcgggactggcctggagcaaaaagaaagagagaggagggcgtaaggatagaccaaggaagaggggctggggggcagcctgggggcatgaaaagtggccaggaaggagccaagactccaccagcaacaattgagttgcttcagcctcagtctagggttccttccaggccttgaaccccccaacctcacaagggttggaaagtgaggccggtgaactttccagctggtactttgattttaaaataataataataattttttcaccctagttcggttgggtgctccatcttacggagccccaaacttattttgagaggccgccaccgtgttatgggcgtgcgcaactgcctctacggcaataatatgtcaggacaacgcgatatcccccctgaaatcggggaacagcccgagcaaccacctttggaggccccaggggcagctgcccccggtgctgggcctagcccagccgaagagatggagaccgaaccgcctcacaacgagcccatccccgtcgagaatgatggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtaatgcggcggactctgcctgcgggcagcagggccgccggggaaccggggagggggtggcagggctgcctggtggggctaggggctccgcagtgggaggagggggtccagccaaaggcgggaagaacttgctagaaagttccagggagggaccctaactgccctgggagcgggaggggatctttggtggattcgggtggccgaagtatatgccctccagggagaaaagtggtgccgagcgacactgagggtcgtttccggctggacaggccagcgccagcaaccgtaagctggacaggcaggggcttcaggtgagccaggaactgccggggaggggccccggggccccgggactcccctggctaggctggtggggtccacggtgggctggggtcattggggaaggcgcgccccgcctcgcctggcacggctgcttggactcagacagcttgtcgttggtgtgtgttggtgtccatattctgtgttcgcctgtgcatgatacgctgaagtgtcccctgttcctatcccggcacccccaaattacccgccgactgtgtacttgtacttgggaacgggctgtgttgtggtttgcgccatggcccgggcaaaaaactttcgctgttcgcacactctggtggtacctgcgcccgggcgctctgcggcaagcggtgcggaggacacgcggggaaggtggcggggcctcccgggaaataagcggggcccttggcctgggggagcggggaatcgcttttcgccggcctccgcgtaaccttgtttctgtatgtctttctctctttttccttttgcgctaagcgtttcctcacttctcattcgttcgccaaaccctcccgcctttacagttgaaaaaccagacacacaggtatctggggcgcccggggctgcacacctcagttcggtattctgcacacacacagctcgcctggtcgggggatgggggaaaggggaaacacaacctgctgtaggcaagtccggatcccaaaccacttgggggctggttccaagggggtgggcgtggctgtgtttaaaaaatatgaaataatttttcttcctagcgaagagcccgaggtaagccaatcatttttacaaagagtacagtaggaggggcttggtttaaaaagatgggggttatgtgttgtgagtggaatgtcacctttgtgtttgaaatgcaactaaaataaaagttttcaaaaaatgctctgagtgtatttgaagtgtgtggacaaagtatggcaaaaccgtgaatatgacttgtgaaaacaagtaaatgtttgcatgtgaattttttcaggcagctttagctgggggcaaagaggcttgtcaaaggtaaggtcttctgcaaattggctctggatacaaaaaatatataaaggtattttgattacagaagttaaaaatcatgatattcttgtcaggagggtattttggtggccttctaccttccccctcctcctctgctcacatttccccacctctcggtgccctcccctctccaggatccccctcctcaccccacagcaagaccctctcctgtatctcccagtctttccctggccattcccagttccccaccctccccccagccccccaagacttcttaacttcaaatctggggcattaaatatttttgccacatttaaacaaagcatcaattagcaatggtctgaatatgtggtttaaatgaaaacttccaaacaaacttcacaagcttaatttttacattttattctctaagactttctctaagaccttccaagggatttcaagatcacagtttttaaggctgcgctacatttgttaaatatgttagaatgtgtgatggttttttattaatggcattattggcatataactgtgctattgtgatgtggctctcacaaatcacaattttaaatgtgaggatcattttgtgtatgcccatccaggtagatcatgacattgtcatttacctaaagacatataatatggtcgttgttttaaatttcaaatgtctcaactacactaaagctaccaaacattaaatgacaatgcactggtttccctgcagacaactgattttgccataacagacccatttcaatattccaagcacagctctgggaagcaaacctgtagattgggggtgggaggacataaatgcatacagacaggagacccaagtgacagtgtgcacctgacccctaattgtcaaattggtgatgtgccttacatgcggggcctcagttgcctcctttgtgaaatgaagctttcctagcagatctccactaaggaatgcttttgcaccatgatttgagtcttctattcttcctggaggtggggggtggaggagacacagtctacttacatcaggactggagacttataccatagattgtgcagccatcaatcctgcagcaaactgtccatgtttgggaccagtcttaagaatattagaagtttcctttgtctccccttattttgtcaccaggagtaaaaattaactttaagaaaaggaaatttgctggggtcaccttgtaccttgtcctggctttgttctcgggtgctggtagccaaacacctttggatgcagcatagtccagaaggtgggctggcaaaccatgggccatgtctaacataagcctgaaatatgatagccagtgttagctgctagctgaaactgtaccactgcagtttgtcaaagcaggctacagtttttgaccaggcttccttttgcagaggtgacgtacctcttctggacctgaattattgatgggggacagggagaggaggaaggatgaggacttactcacatgtaggacaagactttttactaactttttagtcccaacatataaaacaagacatccatacatccctaccactgaaaatgcagatcaaatggctgtcctttgatatggttgctaatttgtgacatgcagattcatctgttgcttgaaaaaatgtatgttcatgtgcttatcctttctgtttttattgccgggacaatttaatctcattacagggaatcctaagaaatcaaagagagagagagagagagaaagatagatagaaatcagtaatatgattaaaattctaaaatatctaaagagttctttttaaagaagcctttttcttactcaacactatccaccaatagactgtttccatgtttctgttacgtttttaaataattttggtggcttaaacattttttaaaacttcatttaggtgtgatttcctccttaagaactgaatggggctaatagatcagagtttcttagtatctgccacatttattaaaattgtgtaggcaaatgctatatataataatggctattctgctatgatgctttatttatacagtgaatcacaattaattgtatgattatttatgccaccaagtgcaacagtatgcattgtattccatcttgcagaagcacctttttatttttcttttctctctctctctctctcttttttaacatacagccatttttttatattctaaatgcctccactgagcttttggtgtggtaggaaggacatggcttatcaggccacaaaattttggagtccagatagatttattattttctcttttcagtctcctagtaagattcatgcttctcaaagtctgaaattctaccttggttttaattcttacagatttctctcaaaaaaaattttcccatataggtagattaatgtttaaaatttacccccattatttacaatggaaaactggttttaagcaaaaagaattgggggtcatccccttactgtatgtatcctcctaacttgaaaaggaaaatctcactgctctcagtatgattagtaaccagtaataataataacacattctgattacattttttgtttgtttgatttgaaacaaagtctccctctgtcacccaggctggagtgcaatggcaggatttctgctcactgcaacctctgcctcccagattcaagcaattcacctgcctcagtctccagagtagctgggattacaagcgtgtgccaccatgcctggctaattgtttgtatttttagtagagatggggtttcaccatgttgttcaagctggtctcgaactcctgacctcaagtgatctacccagcctcccaaagtactgggattacaggcatgagccactgtgcctggccacattttacattttttaaagcctttcatctagtcatatttgtctcttgaaacagtcctgggcaataaaaacgtgatagggccccatttcataggcaaataaaccaaaagctcagagattaaatatcagacacttttttttttttttttgagaaggagtctcgctctatcgcccaggctggagtgcgatggtgtgattttggctcactacaacctctgcctcctgggttcaagcgattctcctgcctcagcctcctgagtagctaggattacaggtgcatgcaccatgcccggctaatttttgtattgttagtagagatggggtttcaccatgttggtcaggctggtctcaaactcctgacctcgtgatccgcccgcctcagcctcccaaagttctgggattacaggcatgagccatcgcgcccggccataaggcacttttactcaaagactgcaaggtaggtaaaggatcacaaatttcaaattcagataatgcttaccagaaatgtgatgataagctataaagcattatttaaatgtaaagcatgattattctaagtatactatgtgctcttaaaatcccttgccaaatgacacgtgtcgagtagtctgctactttctgaattatagcaaaacgcacagatccctggttataaatgtccattgagtatacatgaaacatgagctcccccatttctgagatggctgtcattgctttggtaatatttcatttacacatttgctttaactcatctgccagcactgcaacgttgcagtcttagtttgttgggctactgttttcctttttttttttttaaatgcaggtttttttaaaagttttttggtttttttgttttgttttgttttgtttttttgcagggtctaaagcttttcttcttgtttaggtttccactaaataataattaatcattataataataaaatgcagttacttttctgcatagctctattataagtatagcgttagaatgtttagaatcctggtctggatctcatgatcttatcaaaataactctgctccatagtctttgtagtgatttttttttaaaagtatgccttacttctagtccaggctaatttccatttagcaagagtcagtgcgtggtcttagaaatcacctttgacttttatgcaggaaggttagttgttgttgttgttgtttttaagatggagtctcgctctgtcacctaggctggagtgcagtggtactatctcggctcactgcaacttctgcctcccagttcaagggattctcctgcctcagcctctcgaatagctgggattacagacatgcaccaccacacctggataattttttgtatttttagtagagatggggtttcaccatgttggccaggatggtctggaaatcctgacctcaggtgatctgcccaccttggcctcccaaagtgctgggattacaggcatgagccaccgtgcccagccaggaaggttagtattaagcaaaacataaatttatttttagagaaggtaacctagatttgaaattcccaaaggcagccatgctccttcttctttttagagttagtttttcctccaaataaaacttacccccaaccccagcaaaattgtggctcttcaaatgcctctaaataactctcaggagacacatcagtagtgaacaacaattcgtttctacacttcttggtttcttttagctgtagtagcaaatgtgaggttcctctcaaacccactcacgccatttgcccatttaaaaatcaaatttctcaggaggagtagcaattttcaagagagaagggacagggccaattgatgtcacaaggtcctcaccatcaattaagacaagtcaacggagggaactaaaagcactgggcagcctaattgaccatctctgaccccttggaatagggactaggagactctggccctaacacgcaccttcacagatttcattaaattagactgaatggagcttttgttcccatcagattcctgttctggcctgtggtcaccctaagcataagatcatgttctctttaggaaggaagaggagaatggacctgagcctctctttgggagttctgctgaaaagtctgcaagtcctaagtggcctttatgcaatttagagactggaaggaaggcacgaatataaattgggggaaagaagcccctgaacaaaggagaggagaggtatttcaaaaagaggatatattcttttttttattgagacggagttttgctcttgttgcgcaggctggagtgcagtggtgcaatcttgtctcactgcaacctccgcctcccgggttcaagcgattctcctgcctcagcctcccgagtagctgggattacaggcatgcactaccacgccccactaattttgtattttttgtagagacggggtttcaccatgttggtcaggcgggtctcgaactcctgacctcagatgatctgcccgcctcagccacccaaagtgctgggattacaggtgtgagccatggcacctggcctttttttcttaattcccccaaaaagagggccagctactagaagcagttacaatttgagaaatctggagtcttttttaaagggtaacatgttcaacccagtgcttggcacatataagtaccccaaaacatgttttgggttttttgggttctttttgttgttttttgttttttgagacagggtctcactctgtcgcccaagctggagtacagtggcatgatctcggctcactgcaacctctgcctcccgggttcaagtgattctcctgtctcagcctccccagtagctgggattacaggtgcctgccagcatgcccagctaacttttatattttttagtagagatgggatttcaccatgttggccaggctggtcttgaactcctgacctcaggtgatctgcccaccttggcctcccaaagtgctgagattacaggtgtgagccaccataccaagcctcgacttttaattttagaaatttattttcctcctagatttttttttttctccctgctccaagtgaggttttgggtttggttagttttctgttgttgctgggttttttttttgtttgtgtctttgtttttctgttttttgcatttctcattagactattaacatgtaagttctaaaagtgccagccatctcattctgtctttctgtctccacctttcagagtacattctttgtttacattttgtaaataaaggtcaactcaagcagtagacgaatgccaccttgccacatttataattgtgtgaagtcactctcaggtgaatgatgtgccagagagagatgaggagataacttactttttgacttgtcctgtaaaagtgtcacctgtcacccctgcctatccagctcccccttctgttttgattagctcctaactataaatcaactcaataccgaggctgagctcaaggacctgagcttggattgttctatggttattacacatgaaaaaaaaaaaaaaaagaaagaaagaaaatgtgtttagtttcctttccaacagccagatggtgaaccaggccagctcatgggaattgaagatgaagagacctccaagaaagaggtagggaacaacacaacaaaacaatgtttgacttttcattatgttgatcgtcacatgctctttgagcacacacgagtcacacacctttcaagttagaatcagtggagcgcttttctacatgcaacaactgggagctatgctatgggaagaatgttaggcaactgatctgtgacagggcaatggaaattaagggagtgtgcctctgttgtacttccttagagtaaaatcccaaattgcattgcagagtaatttgttaaacctcaggagtatttaaattcaggagtattttgacttgtggagttctgcccacagaactgcacattcgatcttactaaatgttttttaatgattcaatttggggcgaggagagaggtataaaggtagtataaattgttatccaatctcaaatttattatgagtcagtcaatgtttccgacattgtcacacacacactgtgtgtgggacagagtaagtacttttaacttcctttaatgagttgataatgggaaggaaaaaaatctctgtactactttctaaagagtgtcacagttgagctttcacaagctcagtgtcaccactgagtgagcatcgattcttacaaggaaattaagacttgggctgcaagagcctcgcctctctcttctgatttatctggctcttgcctctccccctccatcaaaagaccacactatctctctcctcttttccatttgaacgattttgccattcatcaaactgattgctaatgtgcaaattacatgatggtatttttacagggaacctgcattcaggtaagtttgaagctgtgggatatttgagggggaaaaaatgaataatgcttatcatgatccacagaaactaaagtcaggcattgtaggacagtccagaacccaagaagggccatggacaggacccttccaaaggaaagagaatctcgtgtcccgtgtgttagcgagtatccattccagctcccccagggctctgggacccacatatctgtgcctccatttttctagggttgtagtagctggtggtccagttgaaaaaaatgaaaacaggaaacctgtcaagaatagatagtgttatttaggaagtatataggtacttacattactgagaccacttgaacacatccttttaaatagataccttttttaaaatctatggttatgtaacatctgtgtccgagggatttaagcagaaagccctgtgggtttctcttttcaaaagacagaccttatttataatcagcccctcgatttttttgggggggccttcatgggcttttgaaatcttaggaagtgtccatcctaattccttatagctgctctttctgtggctctactagggccttcaagatgctgaattcacttattaattaaatcattgacgtcattcagggggttccttttgcccactgccccccaacatgggaatttttaaatgactggctctagaagggcccaaagatggtgaaggtgaattgatatttcaggtgaccactagatggtgagacagtataaggcagaaaacaggtggcacgtgtctgtgaaaatgagagggatggccagggctggcaaaggcaaagaagggtcccccttgacttttaatgccagcccccaccccaggacagaccttggattcaaataggccccaaagctttagccagaccagctttttacttttacgctgtgacttctcctagttagctatatgccaggattttagaagcattttggggggctcagtctaacagaggggtcctccaagtggctttattgacattttttcatggggtggttgtcctatgcactgtgggatgtgtagcagcatctctgacccctacctaccagacacacacacacacacacacacacacacaaacacacacgcacgcacactctctctctctctctctgacaaccaaaactgtttctagtcattgccaaatgtcacccctcattgataactactgccctaacatcatcagtatcaaattctggggacagttcaagatcatacatactgtaacttgcgtatcttaaaaatatatatattggggctgggcgcggtggctcacgcctgtaatcctagcactttgggaggccaaggtgggcagatcacctgaggtcaagagttccagaccagcctggccacgtggtgaaaccccatctttactgagaatacaaaaaattagccgggcgtggtggcgggcacctataatcccagctactcaggaggctgaggcaggagaatcgcttgaacccgggaggcagaggttgcagtgagccaagatggcaccattgcactccagcctgggcaacaagagcaaaactccatctcaaaaaatatatatatacacatatattttatattatatatatatcatatataatacaaaatatatataatatgatatatcatataatatatacatatataatatatatcatctataatataaaatacttttttttttccagagaaaagtttgtccactgcagttacttttttttttgagatggagtttcactcttgtcgcccaggctggagtgcaatggcatgatctcagatgactgcaacctctgcctcctgagttcaagtgactctcctgtctcagcctcctagtagctgggattacaggcatgagccaccgtgtccaaccctgcagaagtaatttctagaaatctcagagaagaaagtgacccagatgaccctaactagaatagaaaaggaaattatttcagggaagtaaatagtgagctgactttgattaaccaagtcagtcccatagctaggctaaatcaatgcttaaatagcctttacccttaaatgatcacatcttccacttagggtttcttaaggatgccttttcctgtagcaggctaggaattctctctctgactggtgcacactcaattaattcactctgcattgtagagaaggatgccaagacacgaaggacccatctgtcagatggctgctgacaacgtatcagctctagggtggcaggagccccactttatatgtgttccccaaaacaacagcagagcctttaactgataatgtgtacacaccagcaagcagtgtgtgggccccagttgctgggtctccctagtctcaggcccatagagaaccagcctactgcatggaggtgacctataaactttcagcaactgatctttcaagacagacagttagattgcaggagagaggggcagtggaaggaacggctctgaatgactggactgagaaagagcataagatctctcaggaataatacatagctaagccaatagaagtaacaatccaaggacatttcctggtcaagagtcttgcgcttggtctctgataaagtggacacccccttctccatcctagggcagactctgtaaccattatttcttggaataatcataataggactaaattgtgatcttaattttaaacagtggtctaagcccctaatttgcatctgaccagcctctctcaagtaaccattatggaaggggactttataacttctttgttatattttgacataacacatttacatttttgcccccatttggtctttctatagagttttcagattgtaacatctgaattcatctcatcaagttttcaaattgaaacatctgattgtaacaactgaaacagattcattagggatctaattttttcaaacaaaggagatttttttcttttttttttttccctagggagtttcaaatttatgacctctgacttcattgcaaaggccagaaaaataaataaatagatagacaatgaccactctccactccagacatgcaggtgtatttcaacactttagcttttactatcaggatttctttaggggaaggtgtagaaatatattggtagtttgataaattatatatcagacatgtaaaatttaaagtatcatttgaaatcaaaacttgtctgaagactagctttttatgtcacaagttcagctaagcaaagtgtcccctaactataaaacctccttactgcagaatcctagaaattaccaaaggcaagcttcttgaatgttgattttgaaattttgcctgcgaaagtgcaacatctttccaagcaaatgcttagaagactcagggcagaacccaaaaacaaatgccagacgttaggggaaaatttttaaaagttggattgccagaaaacttctagctatttataattaagcatttttagctgctaaaaggaagcacattagatcattttgttttgcaaaacaaatggccagtgtgggttttaggatggacactcccaggagggctcccctttctgagtgggagtctttggaaatgttcctgatgggatccagtcattctggagcgctcttacgaaatcgttcatcctagggcagtttggtgtttgtgagcttacagcgtttactccttgctgtcttctaccataggtctgatctgatgggggaggcagtgggcagaggagctccagctctttgggagggtcctagaatagtacaaacagcactgggttagaagttgggggttctcattcctgggaccttggttgattatagaactttattctaggattccatgaatttgccaagctgacatcgggaaaaggctaaagtttgattcttgaaagtattgacaaggccccatttaggaatgattctgccaagtattcctggggtcctgccatggtcaggagagcaccttaaatttgatgagttgtcagggaagaagcagagggtatctctgtgttcagctttatgtatgagaaagtcaagacacaagatgggggcaggacagggacagcttgagaaaggaggcttgagattgagacttggaactcaggtgccagggatgaatccaaaaggcttgcaggcatctcagcctcagacttaagctaacatatagcagatagtggacacctctcctgtttctttctttcttttttttttttttttgagatggagtcttgctctgtcacccaggctggagtgaagtggcatgatcttggctcactgcaacctccacctcccaggttcaagcaattctcctgcctcagcttcctgagtagctggtactacaggcgcacgccaccacacatagctaattatgtatttttagtagtgatggggttctccatgttggtcaggctggtctcaaactcccgatctcaggtgatccccctgcctcagcctcccaaagtgctgggattacaggcgtgagccaccgtgccctgccaatatttgtctttttagtagagatggggtttcaccatgttagccaggctggtctccaactcctgacttcagatgatccgcccaccttggcctcccaaagtgctgggattacaggcgtgaaccaccgcagccagctttttttttttttctggccctgcaatcttgattccccagagttagggtctgatttcagatgttaaggcaggctcaaagtggggcatctgctcgccacaagaaggtgagaggtcagaaagaagaagcaagaccattagggctgccttagttgaagaaagggggctcatctctcattttctcagaagtttcacaatccagaaaggggagaacggaaagcagcctcctaaggagttctcgaatttctttctcacttttcctttgttttctcgctctctcactctcttctaagatttatttttaaatggggttcttattttggggggactttctgagcaggaactaccttttttttggagggaaataaatgagaacacaaattattcagggctgggaagtggaaacaatgaaagaaagcaaggctactcagaaccggctggcagatggcgctcggcttttacgattgacagcctggctttcaaaaattcacccttgcgccggcgcctaaggcagaacccgcatccccctccctaaatcctccttcccaaggacacggcccctgcccctaaggctgaggaatgtttttaaaaggtttcagttgagcaattgacatctaaggacaaatcccggcaacttttaacgagtggatctgaagatcttagccaaggcaggaaagcacacgatcaggtaacctccagattcacagccctggtgccccggttctcctgggaactggtcctgagatcttggacaaatccctggttctagtttttctcaattgaaaaaacaggagggatgtctttctcactttaaaacttatttaattatcttataaagtttcaatagatgaggtatgccaaccccctatccaacacaaatttttttaaatgtctgttccaaaatggcagattgtataggaaatcaaatggtagggccctctgttgtcctttggtaaataattaatagtttctgggtcccaatcaccgggagaatctttgtgggagcagagtttggtggtaaactctttcacacctcaatcaagggctagaaaagaggttcataggtgagcagagctccagtttccaccagggaaatctaaggggcctacctggagaagttagcatttaagacaatatggagagatgaagtagaatttgaggtgcatggtcaatgattgtttacagagaagggacttgctagggatacatcattgcttttccattcatgcaagtatcattgtgtttttcaggatctctgagacctcagggctagttttaagttcttcccctcctcaacccctctccacttctcagtgcttcacggcacactggggcattctcactagcgaaggtgtcctctctaaggatgggacccctactgtccatctcaggctcagcactgccttggggcaggccacttctggcttctttaggcctcgtttccacgggaggggaagctgggtccgatggtgtctgggtcaaattccttggttccaagaacaggtaccgttgccattcccttccatttctgccccctgcaccaccccacccagcagctggaaaatgatgaggtcatctatttgagaagggccacacaggcctcccacacaaggacctacaaagtcctccaatgggaatttatttctttctgatcaaatttaccctccataccccattcatatacacattctttctcccctctctcttaagattgtaaagttaaagaaactgaatacacagggttgatttaaggtaaacgtccctcccacccatctatttaaaaaattttcttttacttgataactttcctacaacatgattctcttatgcccatattcctctgaggattctttaaagcttttcttgcactttctcctcctcacagtccctgacttctagccctgagtggtggctgagggcaggtgaccctgtagaccgtggggaacagaggaggccagggcaggtggctgcctctttccaacctttcctgggccatgggagctcctccccaccagaggtcagcagagagctcagaatggctgggtctgctctcagaaattgggatcttggaattctctagatgaaatgtaggatgcccaaatggaaaaaaagccccatgtttccagggtgttttggttggggctctcatcctgtcttgggtcccggggaccttacttttaacaccaatacagccattctgtgcttttctcaggggaggggtggttgggggtttggtctgtttatttggtggctttcttggtcagtcttctccctgcgccagacgcacaaatccctcccttagagggaaccacaccctcttagaactctcccttctggggcccaactgcccactttcgcttcccacatgacatggaacccacatcccacacttggccgggcgccttttcttctagttgtatttattgttaaaatgacatcataatattacaggaaatccccccagcctaccctcaccctgctgtgattttactgatcattatctccccctgttctttactcaggtgtatgcatagttttgagagggcatgaatcatggtgtgcagtttcatattaatccccctgctccacaaacacacactacaggacagtttccttagagctcttccatgttcgccatcgtccttccacagttctttcacttgttcagtcctttcgctagcggggaagagcagggaaagaattgaggttccctccctttgtttttccttctctgatcttttgaaatcccggggtccttgtgaacgactcagaaattaaaaccaattccctttggccagttgtttattgttgaaagagagagacaaagagaaattaaggtgcaaacggaaggaaagaagtaaatagagattaaatttaaaaatttgaaagggagcagtggttcacgcctgtaatcccagcactttgggaggccgaggtgggcagatcacctgaggtcaggagttcaagaccagcctgactaacatggagaaacatcatctctactaaaaatacaaaattagctgggcatggtggcgcatgcctgtaattctagctactcgggaggctgagacaggagaatcgcttgaacccgggaggcagggtttgcagtgagccgagattgtgccattgcactccatcctgggcaacaagaatgatactccgtcgaaaaaaaaaaaaaaaacaaacaacaaaaaaaaaaccaaaaaaattaaaagggagagagaggaggaaaaaagagggaaaggaaagagagaaggaaggaagaaggaagggagggaggagggagggggagaaaagaaaagaaaggaaaagaaaaaagagaagaaaagaaaaaagaaaagagtgcctttgccaagtttagctctaagcaccaaatggggtccttgccctctaggaacttctagtccagaacagaggagaggatcaggttgcaagtgattatccttctaccaggcagggggtggagcgctgccaaggagggtgtggctggcacagctgaggggccaggctggctagaccggacaggagtacggggaggagaggcaggttcacaatccaggctggggcatcctctcctccccatctcactgccccatgaggtcccttgttcgttcaagtgccaaccagaagagctgggacagaggcctctcttgtgtgccaagacgggggccaccaccaccctctgagctctgaccactgccctctcacctcttattgctttcccaagtgtttacctcctgattctaaaacgatggtccaatttttgttttattttaaagttaggaacacactgcatgtagcacacttcatggagcacaagtgttttcacatgccttatcccactaagtggttttgttttgttttagaaagtctggcacacagagaaccttctagttctttaaaaaaaaaaatcataaatttttaaatttgataattatccagaacaaaacaaagcaaaccctaaggttaaaagtgagcatcctataagttaagtatagatctttgatgttggggaaacctttgaattttacaaatcgatgtccttgagaattgggttccagccagacccactgtaggcattgttttctttttttctttttccttccttcctcccttccttcctttcttcctcccattccccctccccactttgaaaaacaagttttattctcttgggttatgttcattagagagggaagacaattctgttcagcaaggaaaggtgaggggaagagaaaaggggggaattcagccagaggagaacagggacaaggttgattgctctgtgctggggtgagggtggggggcagagagagaacatcacagccagatgcaaatcacaagagcagaccttcagcttcctggcattggtggggaaaatattccgtcagctgcctttctatgtcctgggcttcattcatcagctcaagagaaaaaaaataaaatcaaaatttcatcctaatttgttgtggttggaccccattctcccacattttggccttcttgtaaagcacaaccacaaaggcagaagtggcttcctgggctgacctgcctctcagttcattctcaaggcgttagcctcatcccatcaggaggagttcagactctccccaagcaccaagagttagaaatgtgttgctaattgatttgagctaaatttgtgttgctttgagacttagcaaaatggctgattaggggccagtgttggggaaaataattgctgatctaatagctatgaaaaggaactcattcacaaatatgtttataaaatgggccttctgtgacattttggaattgtcagggagttaggggtcacggtggttcttcaggaagaaagaaatgttgttgggaaatgtttagtggaaatttagcataaaatgacatgcctaatttaagaaaacagttaaatccatcatggttccaagtgaaaacagttgtcacaaattaatttttcaaatgtttgactattggcaggtctgaggtttactcatctgtaggttatgtccaacttggcaaaagcatggaatcctgcccagtccttggtacacagggactagcacatgtacccattttttctcactgataagttatttcctaattttttggttaacttgaaggtcgaaatagccttactcctttttgtctgtctagtagcatctctaagcttgcagtagctgctcacgtgtctgccacgccccttagaaggacgaatccttgcctggtcggtgagtttgcctcaattcgggcattttcatttgttcattcattcgatatacatgtattgagtgccaaatatgtgcccttccccgtggggaagacaaaagtatgagacactgctactcccttgatggaatcaaaacaaacccaggaagttaacaagagtgggcagtctctgctaagcgattacacagggaataaataaggaaagatggaaagattgtcaaccaaaagacttcaacaacctgctaagagtcttccagcccagttgagcacaccaaatcagaggttacctaaaagtgtcatgagtgctgataattaaactgcagaaaacctagaaggatctgctggggtcaaaacaagcaacatttgacaggcacagccattcagattttcatgccactctgaggctgaaaatttctgcacaaacagcagtgactgaacctttgctagtcacaggatagacctccctgttgatagggtagacctccctgttgataacttgtcagtcatgggactgaatgaggcctttctccaggaggcacagcccagagggttactggccatgctgaggaggcagtcttgcttccaggaggggctgcagaggcctggcccaagagtggtgctgagaactgccttttgccaacttctttctttcattgtgcactctctggagccaaactatgccttccaggatctttcaagactaaaattctcttaggaagatgggcccaatatttcccacctaaccttagaaatcttctatgtctaggattagtgttttgagagttagatgggaaagtgtagtttgcagccagatccttatgtactacagagtgctttcaccttagtgctttcatcctccatcttagctccaaccctccatcttagctcttgggctggcccccgtcttagctctagccttacatcttagctcctggcctgccctccatcttagcttctggcctgccttctatcttagctcctggcctgccctccatcttagctcctggcctgccttctatctttgctcctggcctgccctctatctttgctgctggcctgccttccatcttagttcctggcctgccctctatcttagttccagtcctccatcttagatcctgagctttgggtctcttttgttttgttccctaatgcagatagagatagtctatattcaaatactataattaatttccagccattgtggaatgaaaaacacattttaatttccagaatttaatttccaactttcctttcacaaatacttttaaattatctatttattacccttgaaataatatgtcttatggataggtctctgtaactatcacagcatatgatagtgacctttatgtttttttgaaaatatctgtgtaatacagattgctagctattttttatgttaaaaataagacaagggaaggttgtctggatgactgaactgaaagaactctcaggtgaactttgctccatagtgaatatgattgagatttatagaattattaagttgtggcttcttaaaaattgccaccgaaacaagaatgcctgaattttgtgttctgggtgatcgtggatgagcacatggcacatctgaaaagtgatttggccccaggcctccttacctccctgcaggtggctgtgttctcttcagttaatcccattagctggcaaaggctgatgaggctactcgtaagggacatgtgcattttcataaagagctttagaggcccaaaagcccagagagtcacatttttaatagtggggttcctaagagtagcattctaacaagaggcattggggggaacaggggagagcatttgggcagtcaccccctccccacttctagttccagccccataccctgttttcccaacccaagtctatggctgcctagcagccctctaagcaatgagttgactttcttccactgtgaccccaggacacgtggacccctcacaccagatctccaagtagcagcatagtgcttagtgttattctgcctggcagcggggtgccccccccaccccattcagtggcagtcaggttcagatcgtagccttcagggtgcctgactcattccggctccggtcgataatgacaagccccatgtttttctccagcgtccacggctatgacacatacaacagtcaggaaataaaagaggcttgagtactatacggttgctttactttctttaaaaaagaaatataatgtgaagggcatgggggaaggagcaaggaggcaggagtccaggccagcaaataagccagcagcaaaacaaccttgttgtttgtatgttacataaacagcccccccaactgtcctgcggttatatccttaggaaaaactggggcttagtggcgcttgggttgatttcacaccttagcttagagttactcagaggtgtattaacagctaatgattccattgagggcggcccagattgccatcttgacttgccagatattagcaatactcttatagaaacccaaaagcctgccaattaagttccccagtgtaagttaaaaggggcctttctgagatgcgtgatctttaggaaaaggaaattaaactaattttgaaagctcctaacactcgagtttccttataatgtaagtaggtgacagctgggatgaatattatgagtccctcccataatgtgtatttgaatagatgtcatggattctaatggcagagttcaaagtcactcagaggggcgggtttttatttttttaatgtcacccacctgaaattattttcagaaagttctgtaatggctaacaggattagaatgacattgtcacaaaatgatatgaggtgttaaaaagacccctacatgatgcggtgtccacaacgcacaagaagtacccccccacccaagcatgactcagtaacactcagtgaggaggagagcatcgaattatataagttacagttttatttcagacacacaagcacgtaggccagcagtgatagtaaacatgcaggcatgctttccctctgagcatgagaggcgtttggattttaccctcccagatgcagaacctctgtacttctaaacagcttcctcctgacccttagctaagtcaacggggaaaatcagcctccaagttttgctaaattgtgtaccatgacagtgacttgtatttaggagaccttgcgtggatctaaagcccagaagtagccaccaccaccgttcctcctgatgaaaatggcctcaccagcacctcgctgcaaacagacaccagctcaaaacattgattttctccccaccctcgcagggttaggattctgcttagaactctgctttaagctaaaatttccatcaccaaagggcctgatttcaggcagagaaaggaccactttagcaaatgagagaagcgaagaggagtggaggaggagggtcatttcaacagcagcaaaactcagccatgccattttccctgacagcactttaattatgatgaaagaacaagattttttttttccggtttttacagaggaggctcgtggtggggggaaaggagggggctctgaaagagatgtgagctgccaaggtacagagtgcaaagcggctgtcactgccaaatgacagatgcagttggagagggggagagaagcccttccctgagcctgtgcaccagtggcctattctgtgggggcccaggactagtcagccaggggcaaatggtgaataggatggcccaaaggagccacctgctacatgctagcttccccctttccttccgtgagattttaaccccagggctggttctcctagttgtgctctgctccaccagctttgaaagccttggaggggtttcaagtggtcacataccttattgttgaaaaggatgtttttctttaaagtcaggtgctaagtcaggtgtgaggttgaaatggacacttaagggcttcagagcaggataaagggacagagcccaggaagcccaggactgatgctctgatgggcagaagccagccgtgttttaggaatggggaaagagttggagcaccagatgttaagaggctacagtcagctcaagcaagaacgagagaacggcgctgtcactgacttcccacctcccggccttgccggtaatccctgctctgattggaggcatggggtccacaggaggcacctattgtgttgccacaatgcccaaaagtggcctgagaattctgggctgctagtgtttagaaagagatataagtgaaccctagactctcacagctggaaaaagcctttcttcctgggaatgggaagtaacaaaatgagtccaggttagctgtggagtccttagagatgaagggagcagagagggcggaaaaaaaacaaaaacaaagaaggtgcattattttgtgtttcctttcacctccctccttggttttagggccctttcctggcatgcaacaggaagtgcaggctgtgttgagagcctctggtgcagacttacgcagagcacaagagatgatgtgagcctgcttgtctgggctgcttttgtgtaactgaattacacagtatctatgttagaagtgatgtcacccaagagagccccatggccttgaactaaacaccaaggggcatcgggccccggccccaggaggcctgctatgcagcaacttttctgaacaatttgtgattttctgttcttattcccctcactaaattgtcatgctgctagagacacttctaatttgatggttattaatgggcagctggtaatgaaacagcaaggacttagggctttgcagtaggtgaattacggacatttacaagtaaaacaactttacttcttacatttagcaagaggtttaacaagcaaagtgcaacatctgcagaatcttatgggaggaggcagtggtcttgaaattgtgaggcagtactgcagggatagagatcgcctttccctagaacaactgcaatctccccatcagagccaactggaaatacaaatttgctcctatctccatgcgtggtgattctgcctgctacagagatggaggaacagtgatctggctgattttaatgggcccatttagggaaaaacacttaaaaaatatgtgaaaatgcattttccccctattccttctggaaagcaacattagggtccggcagttctgtctggaaggagggagatgcaggagcagcatcctggcttatgaccgcgtggctgcttagtggttttattttagaaagagttttaatgcagaggcagcggtggtggtgggggtgcgggtggggggggagggagacaaatcagatgtagaggtttgcagagcctggaggccaaaggaagcccacttcaggagaccacattttcagcatcagaataagtaaagtatttgaggatttttgtctcctcttaaaaataggcactttggaaaaggaaaatatgcaggcttttgagaaacacagtgaggtgatcagttaatgtgaggtggtggtgattgtaacgtcggaagaattggtctcatttttcatgtcacaattaatattgtttgagattagatagcttcttaatttagaccatttacattttacagagcactaaaaagcaagcctccaagccactttctggcagcacaaagccaaataaatgggaacaatataaccttaaaaagatccattctttcacttgtagctttgctctggtcaatatcgagtcatttagcacaatctaaaaaactcacatttttcactgctagaaatatgtaattcttcctactattcattgcctgcagatgtcctgttctggggacctttttgacttgggtttttgtcttcttgacaccaaagcatacaatcaatttggtcaaaagttcaatcgtgaaaaagcatctggatgttttgtctataaacaaccagtttgcctgaatatttgagaggatcagctcagccaaccacctgtcctgatgttaccccaacacagcccaaatgcactcagaggggtgcggaaggaagggtacacacaaacaaggtgtgggggtctcgctttctctgctgcagccatctgaaatcggctgcagaggaggggggaaatgaagcagcaggctagtccttctaggcagacgtggagagagaaccgtgtggaaagatatctttatggctagactctcagcaacatcactgtcagaatctggtgcctgcagccatcttagaatttagaggaagctgaaggcacctgcccacattttgtcttaggttacaaccagctcaatccagccagcaaaaaataaggttgagaagcatttcgcttttacagaaaaagaaaaaatttccatgattctgttccttgaaaaaaaagctgaccctccccaacccaaaccttttatttcaaagtcaccaaaactgagactagataatctctctctctctctttttcctcgtgtgcatagccagtttagactctcttggctggaatttttcctgatctctcagtgcagtaaaaagccaggcagatgggggaagaagggaacatggagaggcagaagaaggggcaatggctccttggcacatctccctttgtagttcagtcttacacagtccatttttatttgcaaatagctcagcccaaaagagggtattgatatgacccccagatgctgttccgaatccatcttacttattttccctcgggggtgcaggcagggcagagcccagatatgatcagaccttcaaagcgcagccttgatcctttatttttcatgttacagtcacagaccttgaaaatgtgttttcagcagtttaccacataccgagaatttcaggaaacaaaaggtcaagaattgatgacttagatttattagtggccccattaagcagacctcagaattctaatgatgggtctttgctagacaaatcaatgtcatgtttctaaaaggacaagcgtgacagctgggtgatttcacagaattatcaggtattgggaggaaggttaagcaggggttcaattactatcaattacaatgatgttcttgtttgtttccctggggttttcatgctgctagttgtgtattttttcccttgcatttgcatatttgctgttttgctttacatgttttagaaattatccatctatttttttttttcctctcaaaatctcttctacctttggcatcaattgtagaaactaaatgtctgctgtagagttctatcctttagtcatagttttttgttctgttttgttttgtttttaaacaaagttctcttctctgcctccccacccaataaactgagtggatgtatagttatgccaagttgtggaaaacacatttaacacatttaagaacgtgccaggtatgaaatataaagtatgttatacctaagattaaaatattaattcgatttggggattatgccagtcaacattttggttttacatgcattcattcaactaacttatggtatcttgttgaaatgatgcatttaaaataattactgatttaattaaaagaaaactaaggaacttttcaggctgagaatgacattaaattatcctgttcttgagcgcctcccagaggcgtgggttaaataacaccagaatatgaattgagggtcatttcggcttttctagactttgggatgcctccaatggttatgagtaaaaggagtggtgctttaacttagagattagatgtctctgggtcccaattaagttttatatccatttcctttgtatggttgagctatttggcaccatcttggcagaagacagggatccagggcctttgctaccagtggaagggattgaggaaagcttcctctgtgataagtcttggcttggcaaaacatagcctagccttcttccttccctctccagaccagggcaccacgtggagatagcgccgtttgcttgggctggccttggacatttcagagttcccctcttactacatgctgacatcatcccgcaactccccatgtgccttccctcactgttgccaagtgctcttgaaagtcaaccaccttcctgggtgactgctgctttctcacctcaggttaaacccatggacccagtgaaagttctcccaggggctcccatacccgggggtaatcataccttccatatgtgaagggctagttttccagagtttttatttcttggtgttaggtcactgcaaccctgggataaaaatagatgtaattagcatgttgcagatcagactctgcacttgtagctttgtgccactttctctaataataccaattttggtgacacatttcctagaatcctggacttgcttcaatccctaaaatcctccaagagctgaattgtaggacaaacctgtttgctttagaacctagaagggctttgtcccagttagattgtctcttttccctacctttctagacattgcaggtccatctccattttcttttttgtttgtttgtgtttgttttgttttgttttgagacggagtctgggtttgtcgcccaggctggagtgcagtggcgcgatctcggctcactgcaagctccgcctcccgggttcacgccattctcccgcctcagcctcccgagtagctgggactacaggcgcccgccactgcgcccggctaatttttttgtatttttagtagagacggggtttcaccatggtctcgatctcctgacctcgtgatccgcctgcctcggcctcccaaagtgctggcgtgagccaccgcgcccggcctcatttttttgtttttattatcagggagcaacggctccattctcccctaaggctgacatttttgttgaaggctgagcacgcatgtcttccgtgcttgtggcaaaaggccctttcctggctggctccagaatcctcaccagttaattgggaaaaaatttgagttaggcatcacaatttcagccgagctgggcaaacaacgagtacacctgtcactcgagccagtgtccaaaactcagccccatggatcacagctgtagcgttatttcagcatgagcaattcagtatttaatgttccttagaaaaaaagtaaatcattccaagctgctactgttcacctattaactctttcaggatttcatggtggtggggtggaggtggggagtaatctataatttgcttggctagcagagataatacccccttcccaagtctgtctttcttacataatggccatttcttacataatggagaagaggggctgcaaaacaatatcctcttgatctgtggcagccactgccttccagaatgagaagttagattttcttctttcgtttcatttatatttttacctgcgcagtacaggtactgcttcctacgatcagcagcttccatttcttccctctttccacggtagcttaaattagcccatcatcatcagcaaatcttaatttacaattaagtgctgggaaaaaaaaaagttcgtcattaatcagaccttctcattttatgtaaatggcccccaaaagcaacacacatttttaatctgtcctgccgatagctgagcccttctgtcatttgggtcctaataaatgaattggccatctgcaattaatctgcatagtacaaatcattggaaggccgagtctgtctgccttctgaaagaaactggctatatttagttttttaagcaagtctgctttgtgttctttgtaaagtcagcgacattctttcaattttttcggtgtaattagcacaaaaggagccgtaatctgagaaggtagtagagactaaggcaaccgaaaaacaggaatgttcaagaaagcaggcagaggcagccttcccagtattgggcggcgtgacagagaccctgggacgtggctgtgggtagagctgaggtctgtagctcataaaaaatctccttttcatctgatccccagactggttgcaaacgcttgccgcttgggctgaataattttccccttctcataacttccagtggtcagcaaggaccttagaaagacacagtgccatctgggctctgctgttgagtgggctcctgacaggccagtgagagttctgtgcacactgccaagccctcaataaactgctgagtgggagagcagagggcatagccctgagctccccagcaaatgctgaatttcaaccaactggaggctacatggaaatcaagcagaggaaggctgcagtggccttgggaaggagagttagagcctgtacgaaaagagggggcagccctcctcattgggagctgtgcagactgtgccccgatggttagttcccccctcaaaataaaagccagggaaataggtggagctaagcggtaattacacatttttcaatttcaactaaaacgtgtgggcaaacacaaaacgatgaaaaggtatctacatttctagatgaattaaatgtgtgactaattatgtcacgttaattgcttaattcctggtttaccaacagcagatggaagtgggactggagagggggttttagctctgaaggcgaatgacacctgaggcccagtctaaatctcagttttcccaaactgaggctagaccataacggcagggctgtttgaaaatgatcacctacatttggttggcaggtagataaaatctgaagatgtaaaacttctatttagcagtcgtttcatttgtatatgtccacaaagcagcatttaactaaacaaaatgaattgcctgattaatccagtgtttttaactgtctaaactccaattctatggagctaaatttgaagaagtgaataccatgaaaaaaaccctaaaatctttaaaataagaacaattataaagggcttcttttatctaaggaaattttattagaacctcaggcctcctgactgggctcaatatcacatctccaggtgcaccaactgcctcttattttttcctgttgtcacttgtttagtaagatgttggatcaaagtgtcatttaaataaggcatcttgtaaataagcaggaaagtaaactggtccatgtctatttttaactagtctccctacattattctccatcctggatgagtttccatcttcaaggccaagttaaaagttctaagcaacaggttttcccattaccttagtcctcatgaaaatttttccccaagggaagtgaaggatatttcagtttaggaaaattagctttcctgccgtagagcggcaaaactcttaaatatttttttctactcaattaagagctccattaagtgggtccattgatctgttattgatgttgatgtacctcaaagaaaatggagcttcctcagtcttctcctggatttgactttcagttttggagttacttgtggaagctgccgcctgtgttctgctgatgggtctgccttttggtcctgctagtgggtttgttttctgctccctgttgatatccaagttgtgtgtccacctagaatcttcaatgaagggtaacatgtgcatcatatcatttaggcttctaaaaggaacaaagtaatacatgtcatctctttttgttagcttcccccttcttgaggtagatggtggttttgttaaaagtccattcctgcccacgctggggctcatggggatgtggtgagaaaggcactgatggcctggggaattgggcgtctgtccacagagaccaggaagcctctctcacagatggtgcctccccatcagagagtcaggaaagatcaagaagggctgcaaaacgtcctctttgccctcatattatgtgccatgcttttaagtagatgtttgaacagcatctcaaagccactggctcaagaaattgggtccaaatacactggccaatgtacgtccacattctgtttgaattagagtatgttctgaattaaaaacagatcattttaaaatgagttgatggataataaataggaaaatgtcatatggccatgtagttaattcttcagtaattgacttcaagtcttctgaaatgaagttttatatcatgtttagttttgaatacaagtttagggttactttatggttggagttactaactagtgaatatgacaagaaaaaaaaatgtcctagataatcactacattcgatttctaagaacttttatggtctaaagtaatagagccttcttacaaggattaactgagactaggaaatgctttttacaattcctgctttcatcatctgcatgacataggctttgatattcatttgcaatagcagtttcagtcattctagctaattaaagtgcagaacgtgctttgaagacaggaaacactgtggaagtgctaaatactattattaaaaccttacagctaaagtttctgtttcagtggaaacctatttattgtttcctaggctattaaaataatattataattacatttgctctgggctcttggaagacaacttaaaatgaccccaactaatgaaaggccaaggataacattcttgtccaaaaactgagtgacagcattaagcagaacagtattttcaagattctaagctgtagcaagtccactgcttcaaaaggtagacaaggcattcttactcagaaaggaggatacccaggggccaaggaacacaaactgcctttatcaccacgaagctgacaagaccacagaattcaaaccctgatgtgggacgttgttcattgttgtcaaatatggaatgttggaaagaaatgtttcgaggccatatctccatgtagtgtgtgacaccatctgtttaaacaagttttttcgttaggtgacctagtgttttaggttagggatgtgttatgatctcaactggctggcttgggcatgaagcaagtctcctgagccagagatctgtgctttccttgggcattttatacccaagatattctgccctttgtccctccctgaaatctccataactcccttctcttcctgagccagacgaggggccccttccattggaaagctctctcatctggactgttccaagagttatgccaatagattgccccactttcaaagcataaactaggtacttaaaacagtaatgatcaattaaattactaactcatatgaaaaggtcacacatggtagcctccaaaactaaaagacttgaaaaaaaaaaatcacaacttttagggcctcaagaggtcaaatttgaggccaaaagctcagtaaaatctcttctttcactttgtgtggagtgaaaacagacagcctagctgaccacaaaccagcttgtgtttcagcactctgggtgtcatttgcttacctgtaaacccatgattccacctgctgtcatttatttacaaagtgaatgctttatttatccatcagtagttagtcataataaaatataggtgaaacctacacttaaaaaatttttgttttgaagagtggcctcatagattgagagctgaaaggagtaaagcctgatcttgcgttacccatttctaggacaatagtcccaattgtgccttgcctaggacgcatgttagtatatgacatggggcagtttcactccttttaaagttcaggtgtgatgtttatctaaaaggggaaggtggtaatggagctcagagatttccaaataaggaggctcttcattatattcattgtataactttgtagctcctggcataagtatctaggttgtatttgttactatttaccttgtacctcttaaagacaatgtatctgtgctttgccacagtagaagcaggaaggaagatgcttttgaacaaatggagcataacaaaaatgtctggcctattcttccctcttacaagtctttaacaatttttaaaaatgacaatcaatcaaattcagccaggaatttttaatttaccatctaaagatatagaacctgtgctgtgtcatcaagcggttctaatttaggtggtggatggtagtgagcctcactatcactagtacaggcagcctaggaatcatcgattctgaggccttactgctgagttctcctatgagcacattcaggtgtatctgcacaatatttttatgcatctttggttaggtgaaaagcatcaacctaggatagttcctttgagcattttcaaaataaggtgtatttttgtgtggaagagaggccatccatgatcaggagtgtgacaaaaacctggccccaacttttcagccaagttcaagaaagtcaggggtctgcagcagcccagggcaggacggtgtctaggctgcgcttcctgttcttaattccaagtgttgtttggtgactttgaatcgccctctgttgtcttttcagattcataaaaaagaggccttgtacaatgggggcagcagtgtacctgaaggggccaagaaaaataatatgtggcatcttcatctgtcacaccttttcttactcgaagtggagcaaactggggaaaaggggggaatttcagtcatccggttgaatggctaacagtgtctttttattttcaaagctaacttaaaatgatacaagtttgctcaaggcctctggtggtatcagccgccccatacccctggggactgttaaatgtgtttccatttataggtagacttttcttttttctccttctccatcaaacatcttaagtttcatgggctctgttaagaagtcaaagaaaaagttggaagacagtttgtggactttgcatatctgggctttccgggacgtaggcctgtgtcccatccaagacactgctcacgtcttagcctgattacctggccgcctcggctcacctgggcacatggtgagccgcggaactggcaggcaccaaacatttattgaatgaataaaccgtatcccagcagacaccatggtggcagcagatgacctaaccaaggtcccaggaaaggcgggctggggtcaactgcttgaaaatttagtaaccctgctcctaatcccgtgcactgctatatcctagtgtgcggcgggacacttgagagttttgaaagaaccctcaaacaagttcacgttccgtaaactacttttccctctgttccagagcccccagggcgcccaggcaaggccgccacctctcccacctgggaggacgcctcgagcaccgactccacagccacggccaccgctcctcggctcccgtgacaccggcgcgcctgctgcttcgagcaggggaggctttgcactcccatcgcacttttctcgtccgaagatacgaaactccgtccgggcgtcgcaaataattcgaattcggctctctgacacctacctcggcgggcgcgcgccgctgggagggcggggtgggtggctggaggtaaggaggcgcacagcaggggtaagcgccgccgtcgcacactttgcacgccgcccagggctacaccactcaccgaaaattgggaggcaggtctgggaggcggggttgagcgcccaccgccttgggcgcgcccgcgccccccgccatcgcggcccccgcgcccccggcccacgcccgcgcggtcccggcaccggcctgcacccccagggtgcgcggcggcccatttgggtgcgtccccggtgggccgatttttcgcgcttccccttcggtttataggggccgctgctatgggtcggtcctctgaagaggctggggcgtcatcggggccggttagaagctctgctccccggcggggacactcagtcgcgtcggcaccgcggagcgggctgcgtcaggtggctggccggcgcggcgctcccctgctctctggctccgggctgcggcgcggcggctggagcgagcccctgtcccggcgcggggcggcggcgggcggccggcaggcgctgccttgcgtgtgagtgcacctcactcacatgtaagtcggggagcgccggggcctcccgcggaagtgcgagtcgcccggcgcaggcaagagccgccgggtccgggacaaggcaggggcgcccgggcgccgctgccttgccccggggcgcctccgggcaccccccaattctctctcttttctcttctccattggcgtgcccaagagccaaaccaaggagcgcctgagggtaaacagactcctgccatccgcgcctttgcacttttctttttgagttgacatttcttggtgctttttggtttctcgctgttgttgggtgctttttggtttgttcttgtccctttttcgtttgctcatcctttttggcgctaactcttaggcagccagcccagcagcccgaagcccgggcagccgcgctccgcggccccggggcagcgcggcgggaaccgcagccaagccccccgacacggggcgcacgggggccgggcagcccgaggccgggggcaagcagggagcccgggccaggcgcgagccgagctccccgaggtggccgggccaccatgctgaagatggccatgaagctcaaagcccgggcggcggagagcgagaagaagacggccgcggcggctgccgaggtggctgccgaagctgcggcggcggctgcggcgttggccgagccgagagagccgctcgcgccgcggaagagcggggaccccgagaagctcgcgaagaaccccaagaacccggcgcgggaggcgctccccgaaaagttcctaacagacaaggagcgcaagaagctcgagaagaagctgctggagcagaggcgaaaggaggagaagaagaaggagaaggagaggaagaagatggagaagatgctgaagaagaagaagaagaaggtgccagaagcccaggaggaggcccgatgccccgaggccgccgccgccgcggccgccgccgacgacgacgagggcgccgaggagggcgccgtcgggggcgccgaggagggcgccgccgccgggggcacgagtagggcctgggctgactgggacacggactcgagcgacgaggacgacgcctactacgcggcgccgcgcgttgggggcatcgtgtggcggcccgggccgctcaaggctggcgcgctgagcgcccacctgcccctcgtggtgttcctggtcttctcggtgcgcagcccctcgtgggtgctcaacttcctgctgcagaagcgcacggagcagggccgcggctgcggcttcgtgttcggggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttattcgtgttcgtgtgtgtgtgtggacacattttccttttcggttgctctgtcctttggttcgtgctcgcctcgctttttccacactcctgctctctggctctctgtgtctctcgctctttcgaaaattttcctaagtccgggcgcgcgctccctccccttccgcccaccccagcccctcggcggcgcccgcgggagggggaggaggcctcgggggcgccgggcgacgcggtccggggggtggagcgttggcgtcgtgcgaggggtcgtcactggcgcggagacgccccctctcccccctcggctcagccgggctgctgcccgagcccggggggtggggggcgtctccccggcccgtcccgtccccggccgggcgcgggcggagggaccccctccccgggctcccggggggccgcctccctccgccggctcccgccctcccagccgccgccgccgccgcggccgctcctcggccctcctcctcctcctcctccttccacccccctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgctcccgagccccccgcccgttcgcgggctctgtctgtggggggcgaggccggaagggggacccaggggcgcggattcggccgggcgggggctcaaaaacggggcggggggccgtggcgacgcgggcgcgggtccccctcccccggcctgcccgctcagtgtctctctcttgctctcgctctcgctctccccctctttctctctttctctctttttccgcgaggcctacacgacgccaggggtttgggtgcgtgttggggagggggagggggagcccatggggctccggagactgcgacaaaaagagggtttcggggacaggaaaccgggtggcgggtagagggagggggacccgcctccgtggggtgtgagatttgttgggagagggaaagaggggaagaaaggggcgaggagaggagggggtgacgctggggggcgccgtggtggcggagggggcctcgccaaagggaggctttggcggggagaagtggccgaggagagtgggggggctggtgacatcagcccctcggaaaggatcggagcggtaaaggtggtgcagtgggggggagggggcgcaagggagtcgtggcgccggagtcgggaggggggcggcgaggggaggagggagggcggttgccgctgggcgcgacttggtgcgtttcgggcaggaccgactgactgtgtgtgcgcggagcagacgtgtcccgggccaggccgggccgtggaaggaggagaaggagagtcaaataaaataagaccaccccccaacaccaaaaaatggatagagttagtacgagaagtgcccagtgaagccaaatgacacgtcattttacagtgtgacctttttttccccttccagacttgcaggctttttcaaaagcagagcggagaattaattgtagcagctgccccccccacccaccacgagcagcgcccccccaacactattttaataaaccattaaaaaaaacacattttcctgctggctggccacattgagagtgctttgtgaaaagaaaaaacaaagacattcacaaatcagataaaactggagaatgacatttgtctgtaaatggcttcttggtctggaaatggcgtggtttctttttttttttttttttttttttgtcctcctcaaggtgggaggggggattgagagtgctctaaggagacttttcctccaggtgggaagagataaaaagacattaattagttgtttatcaagtgacatttagttgtttggttttgggttttctttttttgattgcgatttttcctctgattaaaaaaataataataaaataaaaaaaggttaactataaggagatggcctttcctccttttttttcttaaggtgctgttttgggggaaaaaaatgtaatgaaatgaccaaaagaattacacagcattaattaaaaatggaagttttccacttccttgataatttggctatctgaataaatttgtgaatttgctaggttaagacctagttcgtggtcacatttcaacaaaacagcttgagtataaagaaaataataaaaggctgttcttatttattttcctttggtggcttttggtttgctctttttgcataggtcatgactttgttctcctgggtccagatttataaaagcagaaaattactaattaagtcaaaataagtgtctttggtgtttatgcatttgcaatttcagtaattaaatggtacatgtgttgctgtcttgtctaaaacttttaaaggcagaattatgctgttgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagcttaagccagtgacacaatattttgcatttttaaatggtgattctcaccaaataatgcctccccacaaaagaggaaacctaataatgccccaaatcctctttttactccatcttaatgacataaaaattaagtgaattagagaactacaatgatcttaaaataatttttcagccacatttcataaatgtggaaactgaggcacggatctgtttttgcctatgaaagataggtcctgtaactgttacacagtttaacacttctgaaattagaatattagagatcctgctaaatattacgtattgtttccttggcctctcttaatagtgccatttatatttttaatttaccagagttaggctcattaagatagtgtttgctttgaaatcaatgtttctgtggaaactaattttaacttttacagatattgattacgggcttgtgaaaaggcaagtaaaggaggaatgctgtgctatctgggcattaaaacaaaacaatacaattaaaagttaaaaagaaagaaaaaggtaataacagatttgtgtggaaggagggcaaaaaaacttcacacgtggattatctgttggagaatgtgcattgcaaaaaagatgcaaaatagcaatcctccctctagcttgatggaaatgtgttttttccatgaaacatatatgtatttttacaaatgaaagatgatttaaaatggaggcatgtgtttctactctttgagttgggaagggcttggaatctttcaaattcagtacttcccagggatagttttccttttgattaaagttttgttcttatgttactttttactgttgtttttgcagtttacctaatgctaatagggtctcaggaactgtatttgatgttaaagtgtggtttttccagaagatgacagataattgatggtctccccttttcctcagcaacatagttgtacccagagggaatttatctttagaaagatatagtttgtgaggaaagaggaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaacaatcaaaagaaaaattaaaaccagcaaaccttaaattcttgtttgttatttggatggtgaaatactgcaggtagacactgaattggacattgatttccttttctctgcgtcgaaatgtcaaggaaagttgcaagtctgtgattttgtgtttggttttttgcatgttgcttctatggaaaaacaaaacaacaacagcagacctccctgcccaaagtgttaaaatgcctccttcataacctgagacttactttcattttctaggtgctggagaatctggtaaaagcaccattgtgaagcagatgaggatcctgcatgttaatgggtttaatggagagtaagtgtcaaatctgtgcaggggggcaccaagtaagaggaacagactttatactaacctttaggaagtataggtgggctttgggggctgggcagccagttttcacttaatttttcctgatttacatattagaaaatcctgggaagggctctttagggtccctcaccccccacccccttggatctttggtgcaacaaatactactgatgaaagcaccagtgtttgtgacaaacatctccctatcccaagaaaatcgtgcctggttgcaggggacgcttgacagcacttggccccgtgacagcccctctccgggccaggtccctgccacagtcttcggacatcactgcagtgtcttcaacgtggctttggccgccccctcgtccggcccacgctgatcactgcaaattcaccccaccccacctcacgcagatttcaatgtaatgaaccaacacaggatgttttaaactattagggaaacattgtttccataatattctcaccagaaacagatgtggaagtggcagcccgtgtttacagtttctcattttttttgtccccctttaaattaccattatgggtaaatcattgtttccctttaaaacaaaaaacaaatcagtacccctgcctacagaaaagaagagggaacatttatttaaaggatggaaagactgggagttaggcactcccagcctcactgaggggcatttttgcctttgagaagtcctcccaggtatcctggtatagcacaatgtggcaatccgtagtgggaatgaagattaaacaggagagactttgtattagacctgtgagacgagttaggaagccctgcctggcatggggaatgcaaacagggaacattcaataaatcggggaacttgcttttctccccaagaccccagatggggcctacccatcgttctcgtgtaacaaaacgtgtaaaaaaaaaaaaagaaaaagaaaaaacaaaacaaaaaaactaagttgaccagtctgttttcactggtatgagagcattaaccgcactagatttcaagcacctgaaggcactagtttgtaattactagctggttggcacagtcctgttccctttcttaaacttggattcgattgaaaatttaaccttgagttgcttcagcttccatttcaaaaggggagttggagtcaaggtggtagcgtttaattataccaaccaccccccaaaaaaacaaacaaaacaaacaaaaaaacctttactagtcactaagcatccaggaaacaaaggtgaactttttcacctttcagagcaaggcaggcagctccttatagagaattctagaatttgttagatcaaataattgtttagagaaggatgacatcacccatacgaatagtcctgttagttgaggatgctttttctactttaaccctgaattcagaaggattggttgggatgcacagggggcttcttcactcatctgattatgactctcaatgggttatcaacatgcacatacgtgctattgagtaagtcagcatcacttgtcaccaaccaattccgaaattaattcttgacacacccctcgataaagccctgccagcggagactgccatcctgacaataaataaataaccctgagacagacttccaaccatgaatctgtcatttgaagaaaaatcttgcataaattttccccctgcaacttgcaggagtacttacttattcatgagagtagttaagcaaaaataatttgaccatgtatcctctagataaatattttgatgaaaactggacatggctagcatttttcaaagatgcagcagccactgtttaccttagcttgagtcggatggaagctaagtcacctttgaaataaattactgacagcttcattacagattgccctaaaatttaaaaatttttatagaaaggattctcctccctaagcgagccagcctgtaacaccaggcaagggttttaaaccagaacttctcttttctgttttctttttggaaagaggaagcaacattcccagtttgccttctttgcagacaagggcacagatacgttaaatttagcctgtgagagggtttacaggggtattcctcatgggagcctagataccttatttttatctcatccaactgcctccttttttctttttcctcactgcggtattgcaacaaaagctatttccttcttaactaggaattccctatgagacagtgacatctgtccctaaagggtggtctgggtggtacagggttcttcctccctgatcttgcgttttgttagggctcggctgagctattaaatttgccttaactctctgcgggctgccatgctgattacatttttaagagtaagataatactgatttgaccttcagaaatacagaggttggatgcggattttctaactcaaaactaactctgtttcttacatttagtgccaggaacaaaacaaaaacaaaacataaacaccattaacattggttgaactaagctaatcaattaccaaactgtagaatgctgcccttcggccttcaaggaggaattcctactgtttatgaagatcgggtttgggtttttggttttttttttctttttcttttttccgtggtggtggtgggtgggcttttgttctttttgttttttctgtggtggtggtgggtgggcttttgttctttgaaattttttttgctacatcacagtccagacatagtttaatgacaatttatggggaacaattatttataaataaaaccattttataggtagtttccttccactgcaagaagtgaggtcattagttttgcaggaaatcctgggcagaaatctcccccgtttatgcctttatgccttaagttacaaccttgggaagattctgacctgggagaattaggagccttatgcgctgccatattctccaaagaattgtgagataaatcactgctttagctccctaatgcgtgtacgtttagtgaaagcacaagaaaacaattatccatccctcctgtctccgaccagagtctccagagagctctgttaatactgcagcaaaggtgtgggattcttcccccatggcctgcagtctcagtggatgttccaatttagccagaaaggcgacctaagaattgccgggaggatggatggctggcgcgcgaattgttgcttttgctcttggctgatggttgaggaatgtagagagactgtgtggggtttgtgtgacactgcggtgccttgcagattaggtgagctttcaatctctctttaaaaggggcggcgaagaggacccgcaggctgcaaggagcaacagcgatgggtaggcacattcaaaaccagaaaaaattgttaacaaaccaaacaaacatgaagatcatactgggaaactgaggccagagacccgggaagaaaataaaaatcatttaaaggaccatcagccatattggcatacatttgtgaataacacacaatttcctgacattttggagcaagtaaagtgcgtaacataaatttttttggccatgcttaaagtagaatgagatccagctgggggaaagttatagatttcagccttggatgatcagtttaggattttgagaattgatgtttttccatatggtttctgttttcccccagctctccatttgaaccagctgcttgttttaaaactatctactaaattccatctacccactggttggtctgattttaaaatttcagacctctttgaaacaaaatttgtttcctttattaaaatatgcaatgctgcaccgtctttaattttgaaaaacgccttggtaccttgcagcaggtcgttaagaatcatctcgaaaagcctctggccttttaaaaatgatcaaatttatttgaatcaaaggcactttacgttagcttggtggataaggaaattcatgatggcatcttttatttttccattcattatcaaattattttttctttgcttcctgcatccccacacccatcacacacacacacacgcacacacatgcacatgcatacacagacacgcacacacatcacacgcacacacagccacacgcgccgcgcacacacacacgcatgccaggtaaccactctagctctgctgtgtatttagcatgcagtggtggagtggctatttctcatgagaccatccagaaccattgacttagtttagggcatctcaaagaaacagcttctgtggccggggaggggaggggcaaagatattggggtctggggacaaagtaactgacacatgtttgttcatctgtttcttttagaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatggactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaatccctgtatctcgcgtctgtcttctgtcttccttcctttgtctgtcttttcccaccaaagcacaaggattaaggtggagacctgaatagcttcccccaccacttagttagctgaagcggggggaggggaggagctcttaaaaactgaacgcatcccatctgctgtatacatagaagggggaggaggaggaaccaagaccctaaaagtacttccagccttagtcccaattttgtagcgaatcagaattctagctaatggcatatgttttgcctttgttgagtagtttaaagacatctaaggaattttctctgaatttcacaatcaacgttaaattcattaagcaatagtaaaagtgatgataaacccgccaacccccagtataatatctccatctacatagtaattgcttcaatggaagaattttatgttttagtattacacacccgaattagattttagatttctattttagctgttttatacttgatatactcccacacctattcacatacgtagatgaatactgaacacgttctcaaaatatccgtattttaagacgggaagttttccaattatcatactactgcttagaccaaaatatcaaactgaatgaaagaaacttgtttctggaaatactttctcttgctgtatgcagatttggatatttagtacccgaatgtatttaattttactattgtggaacctcaaaaccaaaggttaatagctttcattacctgtgaagtggagcctgcttttaatgaatgggaatagatttgccctagggggttttgggtaaattctgaattcaaaagtgaacattggggaccatcaaacacatgtccttttaatttataacatctaaataatcgatgttagactgtaataccaaggccggggattcttaatttcagaaatgagctttgattctgcacatacaaagcagacagtcgcacagagcggtcaggactcactccctttcactctaaggtggttgctttaagagtctgggggccagaatcagatttcagatttgtacacaaggcctgaagctcgctcacctccctgtcatctgtgtttctgagattctccggacctgcagcacttttacttaaatggccctgaggggattcctggcaacatctgtcccccctccccaccccagacaccccccaccactaatgagcgtggcccctctgaacttccccagctcttcacccaatgtagaagagcagtggtgcagtgacctgtgaaaggggcttcacgtaggaagggggcgagatgggatccttcagcaggtgaaggcccagaagtacacagacatttattcagaaagaataaatttgtaagtataattctttgagaaaggaaagaccaaatgatttgtggaaggcctgtcgacaggcccgcacttgaccccaccgtccgtccccgccccccacccctgctgctccactgactgccctgccctgctcgtctgctcgtctgctcttgctaattaacctcccttcgcctttcctctgccttaactgtcgtgttctagtctggagagattatatgttttaatttctactccagtctatgaattggtgaatcagccaagtgaatgcttcaaaaactgggactctcaaaagattaaaaaatatatatatacaaaccgtgaaaaagataaactctgtcccctccatctcccattggtttctgcctcggtgactccccccctcttggcctcagtttccctgtcagagaggcaggaccgtagcaccttttttccgcatgacaacgccctcacctcccagggcctaacaggtacagcaggtgtgctgtgtgtgctggttccatttttgggctatagacctgatgagatacatactccacacaagaggccttttcttgccctctaaaaacataaactcgagaaccttccctggctgtgcttctaatgaaggctagtttctgaaaaacatacagcatttggatcagtgtaatgtggtacaaaaattaacattctgttatggtccccagaagccaaagggtgtgtcctttacctgtgggaccagtgaccctgaatatagatcattccataaagaccacgcaggccatcccatgtggctgagttaaactcaaggaaaagctacaaaaccttcaacctctacttaccagagggatctgacctcccctcccccttagattataaggccttctagggggtggaatcttatttgattcctattgcacatggaccaacatgcactaacatcatgaactagaagtttcattgctgctagctgcagtgcctggagcatcgcacatacgacttttttttttttttttttttttttttttgacagagtctcactctcgccctggctggagtgcagtggtgccatctcagcttactgcaacctccgcctcccgggttcaagcaattctcctgcctcagcctccctagtagctgggattacaggtgcatgccaccatgcccagctagtttttttgtgtgtttttagtagagacggggtttcaccatgttggccagactggtctccaactcctgacctcaggcagtctgcccgcctcagcctcccaaagtgctgggattacaggtgtgagccaccgcacccgggctcctgtaatgaactattataaacaccaccacctgtgctcactggttctctcagtatgctagcaactgagttaattccaagtcaaaccatgggactgttttgttccaccccaacctcatagtgacctatcactccagcctcacccctacccagatgttgataggaccaggagaagcctttaggaagtgttagtatgtagtgtgggggcttcaaacccatgaaagattaaatgagctgcatgcaacttctggtacagtcatgattgctaaggcaatttgctaatctgccccgattgggcgtgtcctcagggcacatttgggaggttataatttgcaactatgtttattcagctacctccaatctttgcacagatccgaacccacaactccctgaagaacagaatactatgctttttagtcgggatgtctttatgaaagcagtactcctaactgacatggtgcaatatgattttcttttcttttcaatcccactgcagtgagaaggcaaccaaagtgcaggacatcaaaaacaacctgaaagaggcgattgaagtacgtgctggctccttgtgctgtctgtcttgtagcgccctcccagccagtgctgttccctgaccgctttgctaaatcattttcagaccattgtggccgccatgagcaacctggtgccccccgtggagctggccaaccccgagaaccagttcagagtggactacatcctgagtgtgatgaacgtgcctgactttgacttccctcccgtaagctacaccccgacttgtgtggccttagccccgcccacctgagcacagtgtccatataggaacatgagtgacagccctgcacatgggcaggagcatccaaaccacacttcaggcaaaactacatttcagtgatgtccatccttaggaaaaagttaatttcatgtgtaaccttaatttaataataataatcattagggctttgttcaagatggatgagcaaaattctgtcaccccttctacatcttagctcacctgtcctcacaaataaacatcactcttgaatactacaatctcactttattagattgtaaatttttatgaggaaaaaggtcctgagctatggcaggcttaattattccctcattcacatcttaggacaaaactgtatgttaaatatggcacacaaatactaattgtccatttactccactggaagtgccctaaggtaccttgggatgcctcagtgaagtgccaaatggaagacattctcattttaaacaggtgacctttttattaagagttttctaaagtccttggggcaaatgaaatcttttctcattattaaaaaaaatgaaatatatctaaattataactcaaaaatcataaaatagaacatatggaaaagactttcctctggatgcacgacactgttggctccctaaagaactacttttagggaacaaaaaactgttcaagcccaagcatataagtttaggccccttcgtggggagaatggcttataagcggggaacgggaaacgagatggaaagatgtatgcgtttgtaagacccacagggaagagacttgtctacagctaaaacaatgagttattgttgccttttgtcaggctttcgtgggaatttgtgtttgtatattttagatggacttggctgcaaacttaaattggagaaatttagtggtatatagttagtatggatagctaaactttttaaatagcattattttgaaaaaaaagcaataaacacaatatgtataatataacccactgactttcttgaaatatgattctatatttaataggaaaaggaaacagcagcctattaaaaatgtatcagaacaataactttttattagtcctactaacatctgaacttttatgttcctacctacaagtcccccatcatcattttttttggtaagattcacattttcccaggaggaaaatttagtcccagcacatcttacaaatgaagtttcttattttcacaacattgaaccatttattggcatattctaacacatttagtgtatattcttcctaaacaattctgtgaagaaactaaattactcagtagcttaccccattccccctacacacgagaaaagaaactacccaaaaccagtaattcacaataagacccagcagctaattgcgtgaacttttgaatatgtttaacgtgttgaattaaagttctttgtgagcattaattcattaattgggctcaaaattcaaaatcacaccaagtgtcggtcacatagggaactctggtctcagggtttgaatgacagtgttgttgattagttcaagctcttgcctttctctaaactttcttgtgttcactttcaggaattctatgagcatgccaaggctctgtgggaggatgaaggagtgcgtgcctgctacgaacgctccaacgagtaccagctgattgactgtgcccagtagtaagtaaccgccacccaacccatcagcacataaaacagacaaaaacaagaaaacatgaaaacctgtgatcctgctttgaaagttacttgttgatgattcctttcttagaagccaaccagttaccccactggcagaaagttctaatctgattcaattgtttatttataaagtccttaattgcattttttttcttttagtgcagcgacattattttacataaacatttaaagcctgttagagcaaaatgatgatgagtttcatagtattcctaattagtaggaagtaattaattgaattgaccctaagcatttagggaaatagggctgtgctcacattttgaataatgtaaaaatactatattttattgctgtaattttaaaacataacaaagaggaacggtgaagacatagctacgcctcctctctccttggtagttgttgattgatctatttctgctctcaggtaagcgactctagtagctgcctagtgttactagatcctagtgactctaggtagagtttgtttttgtgttgtcttgacttttgaactctatttcatatccttatttattccttctcaccgggtcttgattcaaggatggtaagtggtcaatggattttaaatcctaaactgtacacctaagcagtacaataccgtggtggggttattttcaaataaaacaaattactacctgcgaggaggacaggttaaggcctgcagtagcaatgggaaaagcatctttctccaaagtcactcataaaggtgggctcacctggttggtgtgttggcaaatgaagaagggggaacttaaaacacagactttattgcacaactctacctgatgcccaggctgcttcccttgctgcctaacacctgacttaccattgcctcagggatcgccctctgtccctgtcacccaccatggtctctcccagaggacatcgtacccgatagctagaaagttgcctttgaaatagtttatggcttccctcatcttgcacatgatatagcaagcatgtggtggtcagggttatttaaaaaatatgtaaagattattattatttttttgaaacggagtctcactctgtcacccaggctggagtgcagtggtgcgaccttggctcactgcaacctctgcctcctgggttcaagtgattctcctgcctcagcctcccgagtagctgggactacaggtgcctgccgccacaaccagctaatttttgtatttttagtagagatggggtttcaccatattggccaggctggtctcgaactcctgaccttgtgatccacctgcctcggcctcccaaagtgctgggattacaggcatgagccaccgtgcccagccaaaaatgtaaagatatcttctgtttgttgatgctgcagaaatgcacaaagcagtctcagttaatgatattctgaagtaggagtgtcctgtgacttggggcaggggagtctagtagaggtttgatgttttagccatccttattacaagtagctgaaactcggaactgattttgctataggaagtattagctaatcagaaccaaggtgccaggctgactcaccaagggctaagattgctttacttagtagcctcaagcccaaggaactgattgtgaaaaccacctgaataaacaggagggaggaagaggtaatactgttcatctataaatcatataagcctctgttagggtctgcgcaatctatcaaccccagccctgccttcccataggaaattcctttattttcaattgccacatacatagatattccacggtttaatatacaagcaaatgtgtatattttttcaaggaacagaaaaaaacagtccatcttggctggtccctatggcccccagcccccactccttcttcaacaaagtccctgattttctcaaaagttcgaaccaaaagctggaagcgctaattatagtaacgcaaaacaaatggaaatcctggaattgtttgcattttgtattttggatccaagtcagaagttaagtacaggtacaagattaagagagtttaaccaccccagttttgaatgctgggggggcagggagacccagtttcgttaattaacagtagcttagccagattgttgaattttgtcgggtttcgttttctctctcaaatcatttagaagtttttggggtttttttaagcaacacttaattactcctgaaactttgtctgaaaacgcaccatttgtatagatcatgaaaagttttaaggaaactcagagaaaaagagaacaacgcagcttaaaacttttaaaatgtcctccctcacccgtggctcaaacagccctgcatctgccgtggccggcacgtttctggttgaactgcctttatgttaaagttcagatactggtagtgtgcccatttcttaagctgtctatttttatttgttgagctggggtttggctggctccactccagatgtctctctcacaagatttggtgctgatgatctatttatagaactgtggttctgttgccatggtaacatgctggaggccagggcggctggggagctatttctggactggtgctgtaatgtaagattgattgggcaagttagtatatcctctaagccagactaactctgaactagtaaaaaggaagaggggaacagaaaacttaggcagtttctttaaataaacttttctctctttatgattttcttttctcgttagcccgctttaaaacaattccaatctctacatgcccctccctccaaaaaataactggttttaacattaattttccatattaattaccccaatctttcaaaagtaaattttcctgtgtgtctagtcaagcaacacaaacaagatgctttttttaatgaaaagcgtaatatctggagtgttctatttcatggaccaaacagaacggaagagaactttgtgtttgtttcctgttcaggatggctagggcgagaagggcccctttgtgccaacctcttttgttctctttaatcaatgagattcttaaaaagtaaaaaggaagggatacagattctcagtaactaaaacaatctcgtgtgcccttgaggggaaagtccttgatgtttttaagaatgtcactttattgttttttaactgaatgatacagaggtatacaattttcaaactgtttgccattttaatcaagcaatttgaaaattaaaatgtttttgtcaggcattaccaaatggcacagaatgtgataggccagcctggttttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgcatcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcaggctgactatgtgccgagcgatcaggtgtgcaaaacccctccccaccagaggactctgagccctctttccaaactactccagacctttgctttagattggcaattattactgtttcggttggctttggtgagatccattgacctcaattttgtttcaggacctgcttcgctgccgtgtcctgacttctggaatctttgagaccaagttccaggtggacaaagtcaacttccagtaagccaactgttacctttttatataacagagatcatggtttcttgacattcaccccagtccctctggaataaccagctgtcctcctccccaccagcatgtttgacgtgggtggccagcgcgatgaacgccgcaagtggatccagtgcttcaacggtaggatgctgtgggcttggctgttcgtaaagaacgctttgcttctgtgttgttagggatcagggtcgctgctcacgctcttggctttgctctctttggttaagatgtgactgccatcatcttcgtggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgcaagcattccagacccctggccgaaagcgcgcttctcccaagcattcacacggcctcccttcttgtagatggctgcgcaccatctctgtgatcctgttcctcaacaagcaagatctgctcgctgagaaagtccttgctgggaaatcgaagattgaggactactttccagaatttgctcgctacactactcctgaggatggtgtgtatggcttccactcttgctggctgttcattgcggtggttctttttcaaacggtcaggctgaaaacccccatccccctcccaccaccaaaccataaaggatctataagagaagcaagaaaaacgcactcccactaattctcatatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctccttttgcttttgttttcatatgacatcagaggctggctgacagccgtccctggtaggtgtccccatcagggatagggtggttcctggcgagggtgtcactgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaatgatgggactcccgtgagttatttgtggttctgagcaaattcccgtcattcatggttttgacttggtccttaggtcaaaagttgggaggccccaaggtgaagtgggtataaaatctcaccactgtatgttttctggtgaccctaatctgtaggtgtcttgaaacaatttgcagacaataggaaaagtccactcctgttcctcctaaatttcaccccatagtgaaccactatgccccagtcagtcacctctgcattttgatcattgccatcctatccaaagattctaccaacaactcacaccgttacgtcatcacacagtttgcctgctgacccaggcttcccaagaaaagtagtgtatgttttgctataagataagatagggactaaattatgtggaggagaaatagaggagcacagtgtttccaatcaatggggttattcaagaaatggtgtagccatttggggaaaattgaggctggatccctacctcattgcacacaccaaaatgaatttgacataagttgatcacatacatctaaataaaagaggtactttttaaagtggctattttataattaaaaccttgggtttttaaagggcctctctgcagcataacctaagacctaaaggccataacggggttggggatgactataaaaacgaaaatcacacgtaaaatttgaatgggggaagggcctgggtcaggtagaaatttaacaaagggtttacttctctaataagcaaagagttcttatgaattaataagcaaaaccatcagaaaaatgggcacagtatataagcatgcaacttaaatacaaataataagcctctggggatatgtgggacatcactcataaatattcaccataattgggagtggggatgggggtccacactcacgggttgaagtgtggcttatttctgaggtcctgtgggttccctagactttcacccctacgcttatcccccaaggtgtagtctcatatgtggtcacttcctgggtggcttccaggaagggtgggaggaagtgatcagcatcaacgatggtgccctctgaagctggccaaatgggacttcaagttcattctgtaatccaggtcccaaatccacttcctattctagtttccagatcaaattactctcacccaaattaatcatatagtgtagctcaccagaggtgagcgatgagccccacgggggggcagaaaagtagcaaatacctgcatctccatccaactttcacgtaacattcagtccacatgttcttgctatgcaatttttagtacaaagccctcaaaagccccccaaatataaaatccaagtaaaaatcggggcttgctatgcaaatacagctgaaagactagcccacaagttcccataatcctccaaagcaccccaaataaacacacataaaacctggacagtggctatcaagtgcaaccacaagaccagcgtgccacacaaacattcatccaggtaaaggctgtgctcagtgaaaatcaaggttgaactccagcccctagctcctcttccaagatggctccctgtatgtcccttttacatagaaattctggaaccttcttagcataatccacatgagattgtcacagctctagccacatatccatcaaaattagaaaacacaaaattcccaggccagagatgccaaggaaaatgataccacagaaccccaccttgttggtcataactgacagagacttcatggtatcttctagaagaagggtcacaaaagtcacagttatcaggtatctactagtgctagccattacccaatgggataggttcagctgctattttgacaatgagtaaaagaggcccagagagaccccaagagacgtctccagtgagcagggaagatgcgcttcaaactcaagtagccaaaggccactgcttggtccctacaagatactgttgtcctggaagatgcaggagaaaagagaaaaaggtctcctggtgttcttcccattatgtcagttatc

SEQ ID NO: 15042 - DNA, 45840 bp, Human; identical to SEQ ID NO: 13903

SEQ ID NO: 15043 - DNA, 46559 bp, Human
tggtggcacacgcctgtaatcccagctactcgggaggctgaggcaggagaatcatttaaacccaggaggcagaggttgcagtgagccaagatcgcgccattgcaccccagcctgggcgacaagagtgaaacttcgtctcaaaaaaaaaaaaatctttctgaaattctgaaccatcatacacaatacatggttatcaattagttcccagaaagaagtgctttggtaattttttacttctgtgctgttagcaccaagcacaatccagagaaaaagaagggtgctaggcactcctaggacagcagagggcgcggtggaacagcacagaacgctcaggcaatagaccgacttccaagaaaacccagtgcacccaaccttaatcaaacacgccaagctccgcctccatcccccaacaggtggagtcaggtcagcatcaacagattccctccaagtccttttctaagtcattccagacagcctattacccatctcttcttctagacaatgggtttctatgtcccctggaatcaaccacccaacctcttccacacctttcccccaagtggcatcattcgcctgagggttccactggtctacaagtcaggtcatcattccataaatgtctgtagtcagcctcctctagtaatgccgcccccgttcgcagcccattccaggcaggtaacaacttccacacgcaaagccagagtttaaataaaacgaccgggcgcggtggctcacgcctgtaatcctagcactgtaggaggccgagaagggcggattacctgaggtcgggggttcaagaccagcctggccaacatggtgaaaccccgtctctactaaaaatacaaaaaaaaaaaaaatttagccgtgtgcagtggtgcgcgcctgtaatcccagctactctggaggctgaggccgcagaattgcttgaacccgggaggcggaggttgcggtgagtggagatcacgccactgcactccagcctgggctacagagcgagacttggtctcaaaaaacaacaacaacaacaacaacaacttctaaagccagccagccagctcatctccaatggaactaatataatatgaaagactaattataaactaatggaaccgtgcactgcaaataatttggcatttctgttctctaaatgctaagcctggtcccgaggccactctcaactcctctgcccaggcaccacccaccatgcacccagattcccaccaccagggtgcccgtgctccctctggaaggagatgagggattaaacgaagaggaacagacagtaagatggaagggaaggcagggacactggagaagagtctaaggaaggagcgagtgactctgacagtcactatcagcaagtcagccccatgaggacaggactttctgtgttttgttcactattcaatgcccagcgtctaaaaatatttctggaatgcaaacgggtgggagggggagatgctaggaagtaaaagaaataggatattcccattcaacaaacatttcctgattacgtactctttgtcaagccctatgctgggtctggtgtgggtggaaatcaaacacaaaacacagatccccccggaggccccagagcgatgaaagcaacaaacaagatacgaccagagatgggttttgaaggatgaataggagttagctgagctgtcaatagtaagaagtaaggttggtccaaggcacagcgctttctgaaggaacaggaagtgaaaggaaggcgagcggctatgagagaccgcgttaagcggcacggggcgctttaggcgctgcccagtcccggcccctccagcccggggcccgccgctcaccacacgcaccggaagcgctcggttctcccggaggcagaccggccagcacactaccatccagtcacgttccgacgcgacgccgcggccgccagccaatcagtggcggcctctgccccgcccccgcgcgaacagccaatgacggcgccgtcgggccggaagttgttccgtccggacggcgtttccacggacgcccaggagacagccggttgctgagccgggagcgctgactggcccggctgggcagggtaagcgaggggagtaaggccggggcggagtgaggaaacaagggagggagtgatggagggacgctggcgcggcgcccagtggcctggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttccctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtatgtattgccatctttgccaggcttagagcttgttcgtgtttttagcaaagtgctgaaaaccttggtttagggggtcaggacttgtgtcttaggattagggtgttatgcattttacttcttccattgacccaaagttcaggtgattcactgctcccatagggaacagagatcctggctgagcagtcgcgggcttggatccgtagcttgcctctcagcaccgtcatgctgtctgtcataattttcactgatgcaccctccttctgtgctcaacatcagaacgtattgtcattcttattgtgacacccaaaagtgtctcgtgcctggcttcatagaaattaatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaaggtattgtcacctacactctggggccaagatagaaaggatggtattctacctcctggtggtattccagggatccagaaacactcctgggccacattctcttctcagctgctccagaattggctgtcttgatgccacccttccccagattgcagaatcagcgtgtcctgatctctgtgagatgattttgatgcaacccaagtctttatcatgttgttctgttaaacaattctatagtcctttccactcctcatcccaatacaatacccagtttctttaagtgcctattatgctcctccaccgcagtggaaactttcagaatgagcacaagattcaagttcttgaaaagggggaactgggggttaattttcaagaggctttttagctttctccttgaaggtctgctgtgatctgctgtggagtaggcagttttgctctttacacgcccagtacttttgtttagggaagataatagagtacttcactggttataactgcatttctttgtttcagagtgtactatttgttaaacaggtgaatctacttctcttaacaaagtctcaatgtcctatttgcaatttatgtggtaaacactgaagacaatggtccttaaccttttggcatctcagcctcctttcgaaaggtaagaaagccaggagactgctcaaaaccatgtacataccaatgtacttgcaagcattaatgtaatttcagatgttcctgaactccaagttgaaaaacctctgaagttcaactcaattctgaaagtcaacaaagaaataaaggaggatgtcaataggtagggggaagaagaacatttacacaagaaatggggtaaactcataaatgcgtgaaatgaggaagatggtagttccattctccttgtctctgaccacacagaaagttgcatcatacacacacacacacacacacacacacacacacacacacaagatttcaatagtgtggatgattcccacgcaaagtatatgccttgtgatcatgatcatctgctatttcctcagtctaatttcattcccatgtgcttcttaaatggagttctgatatttatagacacatgtttttccctgcaacatggaccctaaatgcaagtcctgtttatctagctgatcctctagcaaagaaacagttatctattctattgcagtgggagattggctgtcctgggatcactcaggcattctacctggcactttcccctggaatttttaaggataatttttatacttgattgacttcaaaaccttactgctgctgccttgttgccttcacgcggggcaccacattttttggaaggacagggtaaaccaaaaggaattccaaaaatagtgaccaggatggtgggcagatgttagcagagggtgaagaaaacagactaaggttgggagacctggaggagaccccaagagaccagcctggctctccttagatgtgggaaagctcaactcagtaccaggacgttaaacaagaggccatctaaagtccagctgggggaatcagtcttcaactggaacaagtaaagacattctaaggataaaccttagaggaaaaagttgaactagatgactaaggagattcattcattaggtaaatattttttgataagctgtgtgccaggtactagaggtacatggaagaataaacccagggcttacctttgctgtctgctggggaagacatgaataactaaactgcagtgtgagtgctttcataaagttactaaaggagtgtttggggatcacaaaggatggagcaaccaacttgttcccagaagcataggtgtcaggagaggctgtgaagagctgaggttcaaattggaaagataatcaatcagcagagttcaggcagagaagggtgtgagacatttcaggcaggcaggcaggcaggcagcagggagcagcagggattctgagagagcacatgagcaagggggcttgggaatcagattctggcttagctactccctggtaatggagccatcagcctcttgtctgctattgcagggcacatagagtaacacccagctttgagagttgggagaattcaggataggtttctggacatgatgattgatgatttgtggctagaagtaattttcatgagtttgatcgttatttgatatggacagagaccttagagagaaatggatttcgactgatttgctcagcttgttgctggggagggaatgggagagcctgagagttctctctagccctaggcagagggtactccggcattcctccctaaactggatgctttcttatctgagtcagttatctcaccaaacctccctttctgggaactgaggtggttctcatcaaggaggagaaagaaactggctgctgtcctgtcccggttttcagtattatagtttcattgaattaaataagttttgatttacatacttttttttcaatttttgtttttttattttataaaaattttttggagagacagggtctcactatccatgttacctttcactcgtgtcactcgtgtccgtgtgaagagaccaccaaacagggtttgtgtgagcaacaaggttgtttatttcacctggctgcaggcgggctgagtccaaaaagagagtcatggaagggagataggagtggggccgttttataggatttgggtaggtaaaggaaagttatagtcaaaggggattgttctctggcgggcaggtggcaggggtcacaaggtgatcagcaggggagcttttgagccaggatgagcaaggagaaggaatttcacaagggaatgtcatcagttaaggcaggaacaggccattttcacttcttttgtgaaggaatgtcatcagttaaggccatctggatgtgtacgtgccggtcacaggggatatggtggcttagcttgggctcagagacctgacattacccaagctgctcttgaactcctgagttcaagcaatcgcctctgcttcccaaagcacttggactgcagttgtgagccaccgctcacagcacccgtgatttacatactttttggaattttttttgttttgagacagagtctctctctgttgcccaggttggagtgcagtggcatggtctcagctcactgcaacttctgcctcccaggttcaagtgattctcatgcctcagcctcccaagtagctgggactacaggtacatgccaccatgcctggctaatttttgtatttttagtaaagatggggtttcaccatgtgggccaggctggtcttgatccaccctccttggcctcccaaagtgctgggattacaggcatgagtcaccacacctggcctactttttttttttttttttttttttttttttttttgagacagaacctttctgtcacccaggctggggtgcagtggtgtgatctcagctcactgaaacctccacctcctggtttcaagcaattctcccacctcagcctcccaggtatttggaactacaggtgtgcgccaccatgcccagctaatttttctctatttttagttgagacggggtttcaccatgttggccaggctggtctcaaactcctgacctcaggtgatccacccacctcagcctcccaaagtgctgggattataggcgtgagccaccacacccagccaatttacgtacttttaaagcaaatatttaacaaatggataggatagagtaaaataaatgacaccacaaatgtatatgtttggttcataaagataagtcatttgtaagataatggttgaaagtgtaggctctagagtcaaactactagagtctataacgcatctctgccatttccttgtgatgttaacatgggcaagttttattttattttatttttatttttagagacagggtcttactctgtcacccgggctggagtacagtggcgcaaacgtagctcactgaagcctcgaactcctgggctcaagtgatcttcctgctatagcctcccaagtagctgggattacaggcccaccaccatgcccagctaattttttttttttttcatttttttgtagagtctcactatactgcccaaagtgccagggttgcaggtatgagccaccatgcccagccatgggcaagttttttttaacccctctgtgcctcatctataaaatggagattacaaatctatttcataggactgctgcaaggcttaagtgaattgatacatatacggtgcttagaacaataacaggtacagaggtgttcaaagttagcagctcaggcactagccttgtcattttccttctccaaggttttacagcaagttaaaatgaagctggagttcagccaatctttggaatcctaagaaacacaagaaatttaataacagcactcgtaacgtagttacatcttgctttacagtttacaaagtgctaccatgccttttttttctcattttgttctcataagagcctggggtagatgaagttcctggtggcgccattttataggttaggaaacttgactcttaggaagtgattgagccaagaaaggtttgatggcgatacagtctctgtctgccatgtccccacttcctgcaagggttataatgaatcatgactaataggaggtgcagacacaccttctgcaaaggcttgtagttaaataaggcagcacgtggaatggacagactggagacagtccttacctcatgtggaacctaggacaggtaaggccctgtcctccaccccagagctcactttgtctgagagcagctgaccagcagtggaagacatttgctcagcgatatattagttatggctgcaaaagcccaagaattcatccccaaggcaattaagataaaccacaaatagaggatgggtgccttggctcacacctataatcccaacactttcgggaggctgaagtgagaggatcacctgaggtcagaagttcaagaccagcctggccaacatggtgaaaccctccctctactaaaaatacaaaaattcgctgggcatggtggcaggcagcctcaggaggctgagacagaagaatcgcttgaaccccagaggtggaggttgcagtgagccaagatcacaccattgcactccagcctgggtggcagagcgagactccatctcaaaaaaaaaaaaaatcaaatagtaatttgccaaaagtttttagcaatgaacttaagttcattaaaacacattggtatttataccctgagcaaacaggagtcctcctgtgttctgggcactgggtgggggcacaggggcatcaccagatgcaaacttgatcttgactaggagggcccctcctagtcaagtagattcacaccttaagtcagtaaatcctagccactcctttagtcttcatcactggcatttgatggttttcctcttcttcatggccccaaatttctggttctctttttattatattatctatgtcctttactgtaactcacctcacaaccttttcggaaaaaaggactcaatacaggaaaggaaaaacagccgcgatgttgtgttaacctctggtttttcctctctctccttccccgcccccaccccagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggtacatgattttgctgggttctccacgaaggcagctgagcctcccaagtctgtagggttgtgttcctctagaatagatggtttcctcaatgactgaggtgttttggttataattttttattttttgagagggaatttcactcttgtttcccaggctggagtgcaatggtgcaatctaagcttgctgcaacctctgcctcccgggttcaagtgactctcctgcctcagcctcccaagtagctgggattacaggcatgcaccaccacacccagctaattttgtatttttagtagagatgggggtttcaccacgttggtcaggctggtctcaaacccctgacctcaggtgatctgtccaccttggcctcccaaagtgctgggattaccagcatgagccaccacgccagccttggttatagttttaaatgtatttttcctttatcaacattgggatgcctgtggtctaaagagtcaggggttctcaaagcctttgtgaaatacagtggccctccagcccacctctccctatttcctgctcaattcttttagccgatcttttggttatgtactccccatatctgtaaatattctgcttatcatattgttccttgttgattttcaagttggggtctttcaggtggaaatgaagcattcgtaccttcacaaccacttcccgtccaggcagtctccccatctgtattgcagttgtagttaggtcagtatctgtacactgacattattatgaccatggaaatagacgtggacagctgaaccatcacggatagaatgagtactctaactttctcgcccagcttttgttttctctggagttaatatttgtcttaatatctgtttgcttgacttttttatgtcaatgatactaatgataatgtatctccaagccctttccctgtccagtgaatctcctttcaacacacatcaactagtctatcaagttcatcttcttgaggcgatctctcccaaaaccttctgcctgcttccctctgaagtgggggctcttgcttcctacactgcccatcttggcgtctttcttcactgtcgacccaaggggttctttcacccctgtcgattgggtgccccgtttcctgctcctgcatctttattcctctttgctttactctttgggcagagcaaatcttccaattgtttctgaaaaaaatattgcaaaggaaatatttctagggggatcttgcccatctgaaagcgtatttattttacctaaaacatgattgatagccaggctgggtgtagggttctagcatggaagtgatttcccctggaaatgctgaagccactgctctattggcacctagcttctgggcttgctgcagagaagtcagttgccattcctttgttttttctttttggaagttagcaggatcttctttgttcccgtgttctgaaatttcatgggatgcaggttcagtatgcctttctttttttttttttttttttttttgccaccccacccccgccccccgagatggaatctcactctttcacccaggctggagtgtggtggcacaatctcgactcaccgcaacctccgcctcctgggttcaagcagttctcctgtcttagcctcccaagtagctgggattacaggcatccgccaccataccaggctaatttttgtatttttagtagagacggggtttcactatattagccaggctgatctcaaactcctgacctcatgatctgcccacctcggcctccgaaagtgctgggattacaggcgtgagccaccacactcagcctgccttttagactagaaactcatggccgttaattctcagaaatcatgatttctttgatctcttctgttttctctcttcacagacttttttttttaattcagagactgtttctctgattttctaaccctcctattgttttccatttctgctatcatttttaacttccaggagcatgtatgctccctgaagtttcctcacagcactctgccctgactcataggtacagtaccacccttttctctctgagatttttttttttaatcttattttactgtattaaatcttactaatattctgtaagggacaaaccagacgagtaggctacagtgaagaaatcttattttggagagttaagaaaccactatgatacttccaggtattatcttcagtgatgcttcttatctttattcagggactccaggtaatattcagctcctacagctaccacaaatgcagcaaatccccatttgaatcctttaaacaatacatcaaaaaaggaaacactctttgcaaagccacccatgtatcttcaagcttcattgtggccccacggatcccttagccctttttcagccagcttcttctggatagtttctaatggtgtcccttctgtcttccgttgtctgtaatctagaagttccattttacgatgtccatgctcatgtccatgtccatgggccatgtctgacagcaatctgacctctcaggacactcaactctctctctctgagatcttaatggtagttttccatatgtcctctacatcctttataacctcagtttcttccatcttaatttgttttctacctgcctttcatattagaggcaattctcaactgtttggtgtttcttggctatttgctggtgttttggggggtgcactgaaagctgctggatgcactcttcattggggaagagcttatcaacataggttccacttcctggagagtgaccaggctgctccccttttgttggggaatctttcgtgtcaaggtctttagatcttttctttaaagttaagtgagattccccagagaaagctcccccagtccactgttcagagggggtgagtcccgctgccagagttctacggctgagtgggagagaagggctgggctgtgggatccttccccgaagctccctattctctgtgtgctgccagtgccccaactgtgcagactgcccccagtctaggcacctgtaactctgtcctctcttgacatgaaaccttggaatggaggggaaactgtgacactcccttggccgaggggagagggattctcaataactgcttcttgaagagacttcaaccagcgctcctgttttcataacccgctttcctgcccccactcctgtaagtgcgcaaggtcactaaggcccgaacctttgggtgattccgtaacagtgtacactcggtcaccttccagtatttccatgatgtcttagcatttgtttttctctcatgctgttaggcactgatcattcatcagctttctggcttctgaaaccttgttgctgtcatcctcttcttgtttcctttgtccttgtgggattatgctttaaaaaaaaaaaaaaaaaagaagatctctgcttttgttgtagtagatttcagaaatatcatcatcaatacgcatctttaactagaacataagcatttcatttccttctggggtgactccactccggcttctccatgacttccatcactttttttttttttttttttttgaggctgagtctcactctgtcgcccaggctggagtgcactggcacagtcttggctcactacaacctctgcctcctgagttcgagcgattctcctgccctggcctcgtaagtagctgggactgcaggcgcccgccaccacacccggctaatttttgtatttttagtagagagggggtcttgccatgttggccaggctaatcttgaactcctgatctcaggtgatccgcccgcctcagcctcccaaagtactgggatgacaggtgtgagccaccacgcccggcccgacttccgacacttttaactcctgttatctgttatcttttcaaacaccttgcttgtcaccagattgtgtcaaccatctcacattccccagtagtttactttgactatttgggaccctgatttaaatcattatttgtgtgtgtgtgtgtgtgtgtgtgtgtgtgtgtgtgtgtattttttgagacagggtctcgctctttccacgttggagtgcagtggtgcaatcctagctcagtgcaccctcaaactcctgggctcccaccttagcctgccaagttgctggaattatagatgcaagccactgcacccagctcatattttaaaggaaataaatagtactgaaagaaagtaatgtcaaaaaaaagttacttttttacagaaagagatttactcaccaggtaggcctcaaacgattaaaccaagttgttttaaaacaaaattataaaataaataaaagacccagtggggttatgtaagcccatcattttgggaagttgacagtggtatttttgtccatttaatattaaatttgaataacatttagtaaatgtttttagttagtaattcttagtgactgcagttatgttcattattttagtcaacttaatacattttataataactcttccaagtgtattatttgactaatgcaattggctggcacacgttgaagacatcagaggttgcacaatgagaccagagttaagtggtgaaaaattcagaagtacatttgtatctgaccctgaaatgtcttggtagtagaagcacttgatgttttggaaattttaaaaattaacttttagcaaaatagtgtgagccacattgggagtgccagttctaagagagggcaccttgagctctttcttctcctgccatttatctaggccatggaccttgaaggtcttttctgctccagtgtatctaaagaataagatccacatccttcagtagcagcagctcattaaagcggcaagtttcctagggggaaataagtcagcatctgagggctgtgaggggaaatagtttgagcaggactaaagaagcaatgctaggtcttaggtattaagaaagagagcagagcctttttcttcttctcctttttgtttaagtaacttctaaaatcaaaatataccattcatatagaaaaacatgctgatcataagcacaagcaggcacctcactgaattttcacaaaatgaccacacctgtgtaaccagcacccaaatcaacagcaagcagagagcacctagaagccaccctcacgcgcctcagcctctgccatgactcctcccaccaggggtagctctacctgggtttgaactgtatgtaatacagtcttgtgtctggcttttttttctgaacatcagcttttggcgaggctccgtggctcatgcctataatcccagcacttaggaggccaaggcaggaggatcgcttcaggccaagagtttgggaccagcctggataatatagtgagaccctgtctctacaaaaaatttaaaaattagccagacatggtggcacacacctgcagtcccagctactcaggagactgaagtgagaccctgtctaaaaaaaactgatgttctgggttttttgtggggtggggatctcacttcatcacccaggttggagtgcagtggtgcaatctcggctcactgcaacctctgcctccctggctcaagcaatcctctgacttcagcctcccgatgagctaggaacacaggtgtgtgccaccacacctggctaattttttctatttttggtagagacagggttttgccatgttgcctagggtggtctcgaacttatgagctcaggcgatccgcccgccttggcctcccaaagtgctgggattacaggtgtgagccactgcacccagctaacatcagcttttgaatcctgtttcagtgtcctggttcagacactgattaagactgattataagaaaatagacaaggtaagcctgcttgtcttattttggtgctattccaaaatgcagatggtccttgagcagggacattggttaaatgtttgactttcgcagagcctcctagttacaagcagaattagaccagatagagtatgaaatgtcaacaaagctagttattaagtgatattgactgcagtgtacttcaaagcaaggtaagccttcccatagataattggatagattatacgtactaaactgttattttttgcaagtactgagcctaggtactacagaaatgagatgggtggaacatacttaactatctaacctgggcaaacatctcatctatgaatcgtatccattgggttactgattccacaaatctggctcattttaatgatgagtctcagataattttgtagtttgaaacacagattactccagaatcacagtcctttatggcccaagtgctatatctgatggaatagttatctctgaatggaggttggtgtttatagaacattctgtatatggtaaaaggaatttaaggagatttaaaagaaagaatgttctgtataaactgtaagtggaaatgtttgtatttcccttggtaagcaaattgggctgtgtatattctttgtttgtgatctaatccagcaaggccaattaccagaatagagctttagggcatagcatgactaatcagcttaattaggcctgcttttctaaacaccaggcttccaggggtggccactatggactcctgcaaaagagtctttaatacatttccagactacccaagggtacattttacctttgttttttttttttcaagatagtttgataagactccaaaatgtgatgatgtaactatttcccagtgaatccctccttaatttataacctgagagcctacattttttgtccttgcttttatctgttttagttgctcttactatccttagtggcatcattggttaagttaacgtaaatattcatctcaacctgtgtggtatgtaaaaactagttccaatgcagaactccaggaatctcaattaaaggagcttgtcacacacgttctctggcatcagtggtgtttgagaaatctttagcatatgaactttgtcataaatgacagtgtatattgtgtcactgctactgtcccaaagtgttcatggtagcactagaataacagataaaaatgaagtgttttcgagccaatgacttgctgtgattctatgggtaagctcctctacctctctgagtctcagattcttgagctggaaaaggacagtgacaacaatacctgccttgtagggttgtgacactaactaaggtaacacgtgtaaaagcatttaacacagtgcctgccacagaataggcattcagcacatatcagctattagtaatacttttagccatcccttttatttcctctctcaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattggtacgtcctctgctttcttcccagaaaaagctgcaacttttagaagtggtcccattgagttgattccattgatgtttttaaattttgaattaatcataaattcagtgaagcttcaatgccaagaaaaaatggatactaaaatcttttggttgtgcattatattcccaaaggattattttaaaataaaataacaatataaaatatatttcaaaataatgatctatagtagacagcttaatagaaggttttccctttttttgagcacttcagaacttgggaaaggtctattgaaatggccatttataacatttagtggctacaagtcaatcatagattacttaggtttcacctccagtgatactgactatggacctagaaggctggaagtcagcttaagagcagtgacttctcacatcgggcaagttcttactgtcatgcccttccttgagggccttcctgctcaggaaagactgttgccattccattgaagtctttactctgagatcattgctaattatcagagaagaaacagaactgaaatgttttcatctaagtcaaagccattttccatgatttcagtatagactatcaatgagggaaaattcacttgaagaccgacattaattcagttcaacaaataaagaatgtgagaaatcatggttgtcaatgaatataaattttaccttaataaacaaatatatatatatatacctatttatatatgtatatgtttatattttgttgtcaaaagttgctagctggactgcattctgaatatgtttcccatcagaacccagtctcaggcaaaacagcattttgtgttgtaatttatttcctgttttgttggttgtgttgatctcagctgttgttttaatccaaagaccttttacttcatgttgggggtaaggacctttagcagaaggcctaaagaggtttgtgttcattaagattgtgcatggatcactcacttttcatcttcatttcagtaatatctgatcactaaacctcctgccacctaagaaagtcatcttttctttttttccagttcggtttggaagtagtaaaattgacaaagagctaataaaccgaatagagagagccaccggccaaagaccacaccacttcctgcgcagaggcatcttcttctcacacaggtcaggggctcttcaccacaggccttctcacctgtcctcttcttttagttcaaaaaaatcgtaagacactctcttcataagccacctggtactgtgggaaaagtgatggccagctgtggtaagactgagatccatcctctgtcctgtcagtaacccactgtgggatcatgcttgtccatcaccctcaggctcttagttttttcatttgtagactgcccacctcacaaggtgggaatcatattaatagcaggtgagattcttcccagattacaggctgtaaagaaattataaaatgtcatgaaaacaaaagagaataatatgtccaagatcagcatttcccacatgacaaacagtaggcttcctgaaattccaaaccctcttcctcctattgtattgacttgctcataaacaataccaacagacaaaccaacagagaatgcatggaacagattatctgtaccttaggccgtaaattccacgcagataacgtcaagatatgggcaggttccaaaagagtttctgcctctcccaacctacagttatctgggctgaggcagccccctttttgaagctgtgtccatggaatttatgatctgatgtagggttgttctgttctactggcacttcacggttacaggagaacaaccccaggacagagcccagcagtctgcccaaacacttcaaattctacctgcaaagaactccaggccttgctcaacccactttctgggtggaatataataaaaaattttccttaattcacatactataaaacttatttttttaaatgtacagttaagtgggttttagtatattcacaaggttgtgagaccatcaagactatctaattccaaaacatttcatcaccccaaaaggaaacttctacccattaacccatttatgccagaagttgtaaaaattttttgtgaaaaatcagaccttggcaatcaccttgagcagtaagatatcaataactcccacaagtttagcattccaattttggaacagtaggtaggcataaatgggttaacagtcatcccccatttctccctccccactggcaaccattagtctgctttctctatatctagatttaggcattttatataaatgggatcatgtaacatgtggccttttgtgtctggcttcttttacttggcataacattttcaaggttcctccatgttgtagcatgtatccatactggattcctttttattgccaaataatattccattgaatggatatacctcacattttgtttattcattcattagttgatggacgtttgagttattttcactttttggttatcaacaatgctgctctgaccatttgtatacaagtttttgggtggatatatgttttcaattctcttgggcatatacctcgaaatagaattaatggcttatatagtaattccatgtttaactctttgaggaactgacagacttttctacagcaactgtatcattttactttcccaccagcaacataggaagcttcccatttctccacatcttcacccactcttgttattttccatgttgttgtgttttatagccatcctaataggtgtgaagtagtatttcattgtggttttgattgtatttccctaatgacaaggatgttgagaatcttttcatgtgcttattaacaatttttatatctttagagaaatgtctattcagatcctttgcctactttttaattgggttgtctttttattgttagttataatagttctttctatattctggatactagtttcttattcaaatattacttgcaaatatttgctcccattatataggttgtctcttcactctactgatagtcctttgaagtatgaaagtttttaattttgatgaagtccagtttattttatctttgattgattgtgtttttggtgtcatatctgagaaaccactgactaatcgaaggttgtgaagatttacacctatggtttcttctcagagttttgtggttttagctcttacatttcagtttctgatcctttttgagttaatttttgtatatttgtgaggtacagctccaacttcattcttttgcttgtgggtatccaattgtcccagcactgttttttgaaaagactattcttggctgggcgcagtggctcatgtctgtaatcccagcactttgggaggccaaggcaggcggatcacgaggtcaggagattgagaccatcctggctaacacggtgaaaccccatctctactaaaaatacaaaaaattagccaggtgtggtgatgggcgcctgtagtcccagctactcgggaggctgaggcaggagaatggcatgaacccgggaggcggagcttgcagtgagccgagatcgcgccactgcactccagcctgggtggcagtgagactccgtctcaaaaaaaaataagaaaatgtgagtactcaaacatggttctttttcaagattgtttaggtattctgggccccttgcatttccatatgaatttcagcttttccatttctgcaaaagcagcagctaggattttgatagggattgcactgaatctgtagattcatttgtggagtattgccatcttaaaatattaattcatctaatccatgaacatgggatgtcttttcacttctttgatttctttcattgatgttttgtaattttcagtgtataggttttgcacttctttgcttagatttattcattagaattttatctttttaatgctattctaaatggcattttcttaatctcattttgattgttcattgctactatatagaaatacaactgatggccgggcacggtggcttacacctgtaatcccaacactttgggaggccgaggcgggtggatcacttgaggtcaggagttcgagaccagcctgaccaacatggtgaaaccacatctctactaaaaatacaaaattgggcaggcatggtggtgggcgcctgtaatcccagctacccaagaggctaaggcaggagaatcacttgaacccaggaggcagaggtggcagtgacccgagatcgtgccattgcactccagcccgggcaaaaagagcaaaactccctctcaaaaaaaaaaaaaatacaattgatgtttgtgtattaatcttatatcctgaaattttgctgagtttattagcgctaatgctttttttctttttgcagattcgataggatttcctacatataggattgtatctcctatgattagagacagttttacttcctcctttccaatttggatttttttttcgttcctaatttctctgacttcaactttcaataggatgttgaatagtagtggtgaaagtgagcatccttgtcttattcctgatcttaggggaaaaactttcagtaaagactgaatatacaccatttagtataatgttagctgtgggctttctatatacccttcaacatgtgtttttattatgaaaagatgttagattttatcaaatgcattttctgtgtttattgagatgatcatgtgggttttggcctctattttattagtatggtgtatcacactgataggtttttgcgtgtttaatcaaccttgcgttcctggaacaaattccacttaatcatggtgttgaaaatcaatttattttcaatcatagtgtataatcttttttatatgttgctggatttggtttgtgagttgctgaggatttttacatctgtgttcataagggatattggtctgtagttttcttttaatgtctttggtttggtatcagggtaatactggcctcatagaatgagttgggaagtatttcttattcaattttttttggaaaagcttgggaaggattggtattaattcttttttgaacatttgatagactttaccagtgaaaatggggttttgggcttttctttgtaggaagttttttgattactaattcagtctttttgtttgttccagatctgtgtatattttctatttcttcttgggttcgtttcagtagtttgtttctaggaatttgtctatttcatcaaggttatctaatgtattggtatacagttattcatagtattcccttatgtagtaatcctttttattcctataaggtcagtagtaataccccttcttatattcctgattttggccgtttgagtcttctcttttattccacacccccccccacacacacacacacacccagtcactttggttcaaagtttactaattttgttggtttgtagtcagcattttttatcttagcatggcatggttcttctcactgcctttgtgacttatttattaactgcagtatagtaatactgtagcctcttggcttaggaaagcataggacctgagtcatttgcccattctcaaatttcaaactgcccctctgtctaattttgtcatctgtaaaattggggattaaatgagatctactatgcacagtcaagcttcaagtggtgggcaggtaactgggttcccttagtagctgaatgagtctctgctggaatccatcctcataaaacatgatctcaaaattggaacccagtaaatttctgcacgcttgtcaggagcacctcaccccaggaccgagcacacagtgagttctcagatgctccacataaacacaagaaaagcagctcatggcacagttacatttttttctcttctgtaagcccatatggttagttgtgagaaccaaagaaggattctttccttccaaaattatgggttattttctttccttatttcaaaagcagtatgtgagcatttcatggggaaaaaaaatgaaaactaagcccaaaaaccagaacacccacaattgtatctgtccagagataagcaatgttgacccttggcttggggaatataaggagaagtcactttcagaatactgttctctagattctcctatccagacctctggaaaaggtagttattcctcttgtatttggggacactttacccagaaacaaaggacattcatcctcgagcgttggtttcccaccctgctgaacattggaactcctcacggagctttttaaaaatacaaattcccggccaggcgcagtggctcacacctgtaatcccagcactttgggaggccgaggcaggcaaatcacgaggtcaggagtttgagaccagcctggccaacatggtgaaaccccgtctctattaaaaacacaaaaaattagctgggcatagtggcaggtgcctactatgcccagctactcgggaggctgaggcaggagaatcgcttgaacccaggaggcagaggttgcagtgagcagagatcacaccactgcactccagcctgggtgacagagtgagactctgtctcaaaaataaataaataaacaaacaaacaaacacattcccagagagcacctcagatccattgaatcagtctctggaggtggggcgcaggcagctgtgattggaagcagcctggtagggagggggatgactcttgagtgacttgcagatgaagatacctagtcccaagctggctgaggggcccagatagatctccaactgggcacttgacctctgaactcccagaggacaattcttactttccctgctaagccaggactgtctggtcccatgcagtttgcctggtattggtctgagagtcctcggggctgggtgattctgagcaaggatcatatggtgttggcctggtatccccagggaagtgtaccaagctcacagtatgtcggcactgatgtttggagggattccaggagtcccagtaactgcatagctggatccatcttttaaacacattattccaaacctacacatcttgtcttttaaaacactcacaggagaaaccatttcagtagaagtttcctgtctatatttatatcataagcaccaaaggtaacaaattctagttattatccatgttgtttcgtctctgtctatattttccatttccaaaagtgcattagtgccttgatatttttctcagaaaatcacactcttcctcttctcctttttcctttagagatatgaatcaggttcttgatgcctatgaaaataagaagccattttatctgtacacgggccggggcccctcttctgaagcaatgcatgtaggtcacctcattccatttattttcacaaagtaagtattggatcttatggcttttcttactctcttagtgaattgagaatgttgcttataaaccatgtttagaactgacaagatcatgctagttcatttgctgagcaaccaagatgtcaagagttggcacttttttggcttccattcactttgttcctgggctcactttagaggaccatggagtgatggggagagcgcagctttggagtcagccaggcctgctcctcttctcatcctgctccctgtccgcatggccatgggcctgctacttctctgagcctaagtttccacatctgcaagatgagaatgaagatacctacctcatagaactactgtaaagcttcaaaacaaagtgtgtagagcagctaacacagagcacacagggccacctggtcgataaatggtagtagaccttatcattatccatagtcaaattcatatcacaattcaaattgtgattttgtaggcaaggaagttttaacatacgttgtaagtaggagctgtgttttcagatgcacgatggcgttcctccacaggggagatgagacgtcagctttctccccctgtgtttctttaggtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggtaaggagaaaacgtctggctgccttttcaataggtagaggaggatgtcaagttgtcatgaccacagctaaattcgaaacaactgaaatggtcttaaggcctagtaaatgttcttcttcctttattaaatgctatgagtggccagccatggtggctcacacctgtaatcccagcactttgggaggccgaggtgggcgggtcacgaggtcaggagttcaagaccagcctgaccaacatggtgaaaccccatctctattgaaaatacaaaaattagttgggtgtggtggcacgcacctataagcccagctactcaggtggctgaagcaggagaatcgcttgaacccgggaggtggaggttacagtgagttgagatcacgccattgcactccagcctgggcaacagagcgagactccatctcaaaaaggaaaaaaaaatgctatgagctggtttattggttttatttaccaataattttgaaagtgaaaagctgtgtatgtacatagaaaggattaagtgatatcagtatcttaaagactcgattattgtctccataattacatttacagaaatttaaaatatgggctcagccacagcatgatggcatctcagatcttcatcctcagctgtgccaggaagtcctgccttgcagtttcttgccaaggatagtcagtcttccagagttatgtcttcctccttttcaacgcaccttttcctcacagagaaaagactcagtggttacacagtttcctcagtctagttcttttaatcagccatttaataaaccaaaatatttcattctgaaaatccttcaagtttcatcccaaatgattaccaagaaatgtgttagaaaaataagactttggtcaaccatcacaagaaggatactatctagctcaacaaatatttcttgagcacctgagttgtggtactcccctaaggtgagatactcttctaagtcatagtactcccctaaggcgtggtctctcctaaggcatggtactcccctaaggcatgttactccactccccaaagacgtgttactcctcccctaaagtgattccccaggaggagtgggttcattgctatgctcctgcagcccaggctgggctctgagcaggccctcccatgttagctcaccatcagggaccatgccgaggcaggataagagggacactaaaggggcaggtgagcagtgagcacaggaggacttgcttagagccgcatccccagaacgttccctcttataagaccttaaaactgagtagtggcagccaggcgcggtggctcatgcctgtaatcccagcactttgggaggctgaggtgggtggatcacaaggtcaggaggtcaggagttcgagaccagcctggccaatatggtgaaaccccatctctactaaaaacacaaaaattagccgggtgtggtggcgtgctcctgtagttgcagctacttgggaggctgaggcagaagaatcgcttgaacctgggaggcggaggttgcagtgagccgagatcatgccactgcattccagcctgggcaacagagtgagactctgtctcaaaaaaaaaaaaaaaaaaaaagaaagaaactgagtagtggttttatatccattgagagcaatgtataccctgataggaaatctcgcccttctatcagccagtaaaactgttagctttttctttttctttttttttttgagacggagtctcgctctgtcacccaggctggagtgcagtggcacaatctcggctcactgcaagctccgcctctcaggttcacaccattctcttgcctcagcctcccaagtagctgggactacaggtgcccgccaccatgtccggctaattttttgtatttttagtagagacggggtttcactgtgttagccaggatggtctcgatcttctgacctcatgatctgcctgcctcggcctcccaaagcactgggattacaggcatgagccaccacgcccagcacctattagatcttttaaaattacttctcttggttcagccatgtgagcatggaggccctgtggcatccttgaaggaaggaaaatagacagggatccagatcctggcacctgggtttagtggctgtgtgtcatagcagccgtgtccatgaaatgggatcaaacaagaacatagatgtcatcattagcataattttcttttttttttttttttttgagacagagtctcactcatgggttttgccatgttggccaggctggtcttgaactcctgacctcaagtgatcctccccgcctcagcctcccaaagtgctgcgattacaggtgtgagccaccatgcccagccgtgttagtataattttcatggcactttatttccttattctcaccccattccatacaatgattcaactgattgaacctctgcagagacaactgtgggttctgcttctccttttccagtcaggcagtgctgctggcattgcccagtagctgctatcctcttcccacaccaccactgcccccaccagccagtgatctccctaaaactcagagctaatctcatcttccacttgcgggtctttcccagctctcctccttagatgacattgagaattctcacctttcacttggcacacgagccctttcgtgattggccctgtgttcctctccagcgtcactgctacctccagctcagtggaacagcttgcagttccacatccttctcctttgtacatgctctgtgctgcccagaattcccacccactctcctgaccctgccacccccagcttagctaattcctacactttcttccaaaggcatgatcaagcatcaccttttcctaggagctttccctccccacagccaaatttagatgcccctctctggtcctccatcaggctgggccttacctctgccacatctggtacagtgtggccctctccccactagctgagtaagacacatagttcctgaatttgtgctctctgtggcccatcccctcctgggccccacagacacagcagaagcaaagctgagccgcttcgttgatggatataaatgctggtggtgagacaagagcaagtgcctataatagtccatgaagctgattcagccaatagatgcacgatggggtagatgaacttttgaacagtccatgtgaaaagaccaccacctgagcaaccccactttcagcgctctctgaacgtggagtgaggccgccattcctcgtgctgtctctttggcaactgcggttgcagctcctgaccagcctccaccttcgctaaataagaacttccttttttttttttttttttttttctttttttgagatggagtcttgctctgtcgcccaaactggagagcagtggcatgatctcggcttactgcaatatctgcctcctgggttcaagcaattctcatgcctcagcctcctgagtagctgggattacaggcgcccgccaccacacccagctaatttttgtatttttagtagaaacggagtttcaccatgttggccaggctggtctcgaactcctgacctcaagtgatccacccgcctcgaccacccaaagtgctgggatgcgtgagccactgcacctggtcgggaacttcctttttccttacaaacatggggtaaagatgaaacccagacagtatgtcaaccaaaagggtcgatgatatcttttcttgaaaggcattttatattgaacctaaagtgaggagagacattttaaagggtaaatcctctattcaaacattttactttaagagtttcttctaaacatttgagcattttacttttctttcttgaatttaactcaaaatctatatctttggcttaataaagctccttcctggtgtttaggagctggaaattcaacaaagccagccatcgccctctttgagtgggagggaggtggtgaggcctccatgagggaggaggccagtgcagttccccctgcacattgcacatggccccagaacggccttcctgcccagggccctgagggatgcaaaggcactgagctgggagtctgaaaacttgtgttccagacccagctctgcccctgcctggtcttgttcccttgggcaagtccttaaatctctgagcttccatgttcctgtgaggaagggagctgggtgctagtggggggcagcatagcagaggttgcaagtgctctgcttgacggccgtccgctgtgtggcctgggcatgggaggagccttccactgtgtggcccgggcatgggaggagctcctctctgcctgctttcttcactctgctcctttgttctacaaatatttattggacatctgctatatgccagactcatggtgggggtacagcagggagcaaaaccattatctcagcagctgtgtaaagcctctcttctaatggggagaatcagctaacaggtgatcaatcaggtgataataagttctatggtgataatagggacaaagggcaggggtagagaagactgtggtcaggagatgatagtgcctgcactgcatataaagtgcttcaagccacgcctggcacctggggagtgctcagtaaatgttgtaatctaaaatctcttcccactttaaaccctgtctgagagtgaaaagcaggtgccctccctggggtaactggtggttcagccacatgtgatatacagttaggtgtgttcactgcagccagtgagaagcctccatgtgccggcactggcatggctgctttgcgtgatgggtccgtcccagctgtgcagggggacagccgtcccttgaggggaggatcacacgtgctcacggtgcagcacctgcattcaccctgcagccagcacagtggcagcagcttgcagcaagtaatgaccagtcttctaagaaagggcagcgtgctctaactcagaaataccagtcagacgccgtgaagctacagtcctgccacagtttgggggtactggagactttccctccttgtaggggttagggtgtcccaggtgcctcaatcccaagggcgcatggagtctttgctgcagcccatctccccaggtgacagacagctgctgtccttactggctgtgagtcctgctgcggtgcccaggagggaccctccctgcctgcggtgttcttggcttgcttggcaggaggacaaaggccgcatctttccaggcagtgctgctgttggctgtgctcttgctctctgttgtttccattgtgctgagtgggtgacacagatgctgggttctcctggcatgccccttcacagtactgcgcccgccctctccagtgccccccagggcctgaaactcagccggctgctaggcgaaagacacagtccatccctcacgtgctgcctctgctcaacctggacaggccttggcactgaccttgaccgttacaggcctcccagcattgtgcttcgcccagcacaaacggccagtgttcctgcactcctgacaccccaccccacctgcacaaagacattcagtagttctccaccctgccccaaaagtctaaactcttctaaaggataagatgtggtgagaaaagcataggctttggggccaggtgaatctgtgttgggatcccagcccctgtactcactgggcctgtgactatgaccctgaacttctttgagcctagtctaactgtaaggtggaggcaatgctactactttgaaggggattttaggagtattgacacatacgcagcatctagcacagctcctgccacatggtgcaaacacttaaaagacaccagccttcccccttttccctcgtagtgtctaacacatggtagggcctagagaaaaagctactgaatatagtaatacaaagatgcaatataagaagccacttggctgggcgcggtggctcacacctgtaatcccagcactttgggaggccaaggcaggtggatcacctgaggtcaggagtttgagaccagcctggacaacatggtgaaaccccatctctactaaaaatacaaaaattagccaggcatggtggcgagcagctgtaatcccagctactcaggaggctgaggcaggagaattgcttgaacccaagagatggaggttgcagtgagccaagatcatgccactgcactccagcctgggctacagagtgagactctgtctcaaaacaaaaaaaaagaagccactctgggttctgccaaacccctacaccccactgtgtttgcttcttcttcagcctagttccttctggtagcggaatggctgccacacattcaggcctggtacccacacccctcaccatccagaagagagagttgggttgcttgaatcagccactgtggcctagccctgttgctgtggatagggttagttctgcccaaacagcaggggggagcagtggccagagactaggaggaccagctgcactgaaacaggccttcctccttctcgggccgtgggtttctatccatacgctcatccgacaacaagcagatggtctcccacaacacagtatgtctcagctaagaagctcctgggggctcccagacttgagctccacagcccactgaactgctgaccctggcagaatttaaatttttcatgctagctgcaagtctctgaatctgcttgtgttcttgccttgtttgtatgtctgcttcacgtcggtttcacactggtttctgcctttcccagtcaactccacaggtaaacgtgtgtctgctttgcctgatgcaggtatctttgcctacagatgacttcctggcaccttcccagtgcttacgtgttgaccacaatgtggccccgagtctggcccatgccactactcattggcatccaattttaataactgtgactttgccttcagtgaaggccgccctccgtttgggatttcattctcgttgtctttgcaggatgagctcaggtttctacaaaaatgtggtgaagattcaaaagcatgttaccttcaaccaagtgaaaggcattttcggcttcactgacagcgactgcattggtaagaggcccactgctgctgtggaccactccctgcacccttcaaaaaggagcagagttctggaggagacacatgcctggtttaaatatctctgagatgttagcgtttgcaactgtctctttaagtaggatgcccaggcgtgggtgggtcatcgttgtcctggaatctgactagctagtgtaatgcattgagcagcttctctgggttgggtgaagctgcacttcaggatgtgagtctgtccctctcttgtcacccgtcttaaggtttagaagaaagaaaaatctaaggatgactttggagttccaacagctctggtgggaccccagtcagtgtagggtggccttggatggaacccaggggtgatgaagaaggacagctgggtctgctgcccatgagagggcctttgagtctttgtctccctgggcctcagtgtccccacatgtaagatgaggggcttgacacgaggtcttctggagccttcccacccctgccctgctctccttccatggctccaccccagcagatgtgcaaatggtttgcctcccacgtgcatgccttcatggccctctccataaatttccatgtgtctttcagatgcattggcttcgtagacttttagacttttggtccttgagacttgtggctgggccttctgatcccctcctctacttgatgtttggtgcgtggcttcaggcatagcaggcccttgaggccttcagtcagctgccagccgagccagctccctgggatgcgctgccggggctctccgtgaggagcgttcaccctgcttggagccagagccacagcggcgtgtgctccacagcgtcagggtcacgctgggccagccgcgtgcccagggcccggaaacctctgcgctcacccaagggtctgggtaccgccacttggtgggggctggcgtggcaccacctgtcgggccatagagaggtcaaaagttctgcttctgcaggtctaagcaaatactaatgacagtaataacagcaacaacatccaaaacactaaacacttttaaatatcaaaatacattcatcataacttctttttttttttaatttatttatttatttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtagactcagcacatgtttcagagagcacagggttgggggtaaggtcacagatcaacaggataagaatttttcttagtacagagcaaaatgaaaagtctcccatgtctacctctttctacacagacacggcaaccatccgatttctcaatcttttccccacctttcccgcctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgaccccgccacctccctcccggacggggcggctggccgggcggggggctgacccccccacttccctcccggacggggcggctggccgggcggggggctgaccccccacctccctccaggacggggtggctgctgggcggagacgctcctcacttcccagacggggtggctgccgggtggaggggctcctcacttctcaggcgggcggttgccgggcggagggtctcctcacttctcagacagggcggccgggcagagacgctcctcacctcccggatggggtcgcggccgggtagaggcgctcctcacatcccagacggggcggcggggcagaggcgctccccacatctcagacgatgggcggccgggcagagacactcctcacttcctagatgggatggcggccgggaagaggcgctcctcacttcctagatgggatggcggccgggcagagacgctcctcactttccagactgggcagccaggcagaggggctccttacgtcccagacgatgggcggccaggcagagacgctcctcacttcccagacggggtggcggccatgcagaggctgcaatctcggcactttgggaggccaaggcaggcggctgggaggtggaggttgtagcgagccgagatcacaccactgcactccagcctgggcaccattgagcactaagtgaaccagactccgtctgcaatcccggcacctcaggaggccgaggctggctgatcactcgcggttaggagctggagaccagcccggccaacacagcgaaaccccgtctccaccaaaaaaatccgaaaaccagtcaggcgtggcggcgcgcgcctgcaattgcaggcactcggcaggctgaggcaggagaatgaggcagggaggttgcagtgagccgagatggcagcagtacagtccagctttggctccgcatcagagggagaccgtggaaagagagggagagggagaccgtggggagagggaagagggaagagggaagccatcataacttctgataattaaaggtggaaggtggctagagaatggttaaatgatatgatacattgacaggatagaatatacttagtaacaacatggatagtcattacaatgaaaaaggcaaggaaggccgggcgccgtggctcacgcctgtaatcccagcactttgggaggccgaggtgggcagatcacgaggtcaagagattgagaccatgctggccaacatgatgaaacctcatctctactaaaaatacaaaaatcagctgggtgtggtacgcacctgtagtcccagctactcgggagcctgaggcaggagaatcacttgaaccccaggaggcagaggtagcggtgagctgagatcgagccaccacactccagcctggcaacaaagcgagactccttctgagaaaaaaaaaaggaaaagaaaaagccaaggaaagaccaaatatagtgtaatcacaacaaaaatgcatagagtaaaatatataaagaaaatggatgaaatcagacacattgcaactgtacagcttgttctttctacttttctgtattttttagatttattttaatgattgttttataatgggagaaaacctgtttttgttcattcctttattaactaagcagaacaggaactcatctcacgtgtaaaaatactttttctcattttcagggaagatcagttttcctgccatccaggctgctccctccttcagcaactcattcccacagatcttccgagacaggacggatatccagtgccttatcccatgtgccattgaccaggtcagcaggcagaaaagcaaggctctctaagtctggggcattgacagcaggttcctcttactcttcagcggggagaggtattgaaagatatgatgggcagccaggcagggtggctcacgcctgtaataccagcactctgggaggccaaggcaggcggatcacttgaggccaggagttcaagaccagcctggccaacatggcgaaaccccgtctctactaaaaatacaaaatttagccacatgtggtggcaggcgcctgtaatcccagctactcgcctcgcttgaaccccagaggcagaggttgcagcgagagcgcatcactgcactccagcctgggcgacagagcaaggctctgtctcaaaaaaaaggaaagaaagttggggagtggggcaaggggagggagagcattaggacaaatacctaatgcatgcggggcttaaaacctagatgacgggttgatgggtgcagcaaaccaccatggcacatgtatacctatgtaacaaacctgcgtgttctgtacatgtatcccagaactggaagtaaaatttaaaaaaaaaaaaggaaaagatgaaggggaggagggagtgaatttctttggttggaagcatgagagccttctgggaagatgctcacagggactgctcatggctgaaagctggcatgttttctggccgccctcatcagggtccttactctccccacaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtgagcagtggcccaggcagagggcagccagcgggatcagaaacatgccctggggggcacacgcacacacacaccactgcgcagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaatattttgaatttttttttctttttttccttttctgcttttcttatcagcactgttctgcaggcaaagtcatggcaatttccttaaagttataattagtgtggatgttattaaataatggaaaagatttgtgtatatttctcatcatcagctgtgttccagcggctggacccggtgccttatttatgttttctcatgtttcattctcactgggaggtggtggtgctattccctttaaagatgagatgatgaggcttagagaagcccagccacttgaccaagtttccaccaccaggaatcagcagcactgctctcctggccctgagcagccattaccaagcaggggttatgagctggtcttctcccagagagcgttctcactgagagacatagaacggagaaacgtccatccacgggacagtcctgctggccccaggagggatgcatgcagcaggcattcagcaaacatttgacaaatcactagagaaactaaaaggagaagttagtttgagcttccttattttgcatggccccagttctgttgcctggttcctcaacagccagtgtatatataattgcctcactgttacacaaagcagttgacattttctttggaatcaagtgtgtgtttgcaggctagaagattgcagtgggaatgctgggaactgtatttgaggcatgtcacatgccctctgagtcactgcccctgaccgttctggaaagtcccaagcaggttctggttgacaatggggaagcctttcatatcaaaacttcctaagacatgccctccaccaactctccccactcagttggaagctggtataattgaagacttttctttccctttcacttctggccaaaacttccggagcacagggtgcagagtggggagggaagcgccattggaaaagtccactgttttattttgcttctgagaagttgtttggaaaaagttgtttatggccaggtgcgatagctcacacctataattccagcactttgagaggccgaggcaggtggatcacctgaggtcaggagttcgagaccagcgtggccaacatggtgaaactcctgtctctactaaaaatacaaaaattaaccaggcttggtggcaggcacctataatcccagctactcgggaggctgaggcaggagaattgtttgaccctggaagacaggggttgcagtgagccgagatcgcaccactgttctccagcctgggcaacagagtgagactccagctcaaaaaaaaaaaaaaagaaaagaaaaaagaaaaacttgtttatggatctgggacatttatcattcacttagggaccagtagagccctcgaggtgagcagttagcatgaggtcaggaaaaacagaggcctacagacggtcactgggcctgcaggcttcttgtggggcagaacagggcccgcccaggccctcactctaaatccccgtgcccgacttcagctccaaaatcagaatctccacactagaaaagagagggcacatctgctccagcctcctaaaaataacaggttcaggcagggcagtggcacgtgcctgtagtcccagctactcaggaggatggcttgagcccagggattcaaggctgcagtgagctactattgtgcctgtgaatagccactgcaccccagctggggtggcacagtgaggccccatctctcaaattaaaaaaatcaaaatagtagcacagtgctgacgactcaggtggctttgctgagtgagtacctgccacctgcacacagtaagcctgtgttatctaactttattccaactaccaccctagctggctgtgtccattcggcatcatttcctgtcacacagagtcacactggtcacccacttccatcatcttagttgctggcagcagtgctccatacccacccccaagtcagccctccatctgttttcctgtaagtcaggcctggtaggctggttcctgcatcactgaggactgatcacgtcaaggaggcagaactgagcccctcagttctcgagctccacccagaagcctggtgtcccaggagccagcctggtcctgccaatccctgtcacatatggcaggttcctgacactctgggcctgatttccttcacctgtaagatagagacatcactacagaggtcattgggttgttggggataaaatgcatgtcataaccctaacagcctccacggatggcacatctgctgtgtgcctaccgtgggaaaagcctggggagggggagtgtgcaggtggtggtgacgccagcacatcttgaaaaacatgcagcagacaccagtttccttgttctcctctcagataaagttctgggaactggcctttcaatatcctcttcaaactgcccctggaagccaggacctgtgttctcagactttcttcctgacactgaagcttcttccccaaggcccagcagggagggctatggccaccacatagcagtgactctatcaggcacttagatgctaggagacaccactactaggtggtttttttcttcctcctgtttattggtattttccatagtttttcattctataactttttttttcctttttttttttttttttttgagacggagtctcactctgtcgcccaggctggagtgcagtggcacaatctcggctcactgcaagctctgcctcccaggttcacgccattctcctgcctcaaggctcccgagtagctgggcctacaggcgcccaccaccacgcccagctaattttttgtattttggtagagacggggtttcaccgtgttagccaggatggtcttgatctcctgacctcgtaatctgcccgccttggcctcccaaagtgctgggattacaggcgtgagccactgcgccagcccctcgcatgggccttgcctgagcctctcgcgtgactgctgctttccctgcccagcctctcagcaatgccctgccaaaatggagacaggcgcctttgccccaacactcatctgctccttttgcacaatcccaacttatctagttaggactctgctctagaattctgtgtgtgtgtgtgtgtgtatgtgtgtgtgtgtgtgtgtgtgatggagtttcactcttgttgcccaggctggagtgcaatggcacaatctcggctcaccacaacctccgcctcccgggttcaagcgattctcctgcctcaacctcccaaatagctgggattacaggcacatgacaccacgcccagctaattttgtagtttcagtagagacggggtttcttcatgttggtcaggctggtctcaaactccttacctccggtgatctgcctgcctcggcctcccaaagtgctgggattacaggtgtgagccactgcacccggctgctctggaattcttttaaggaaacttactaaacataacaacttagaatttattgactctgcccaccttttttcccattaaaaaaaagttaagactgggcacagtggctcatgcctgcagttccagcactttgggaggccaaggcaggcgaatcacctgaggttgggagttcaagaccagcctggccaacatggtgaaaccctgtctctactaaaaatacaaaattagccgggcatggtgacaaaaaaaaaagttaaggggctgagcacagtgactcacacctgtaatcccagcacttcgggaggccaaggcaggcagatcacttgagcccaggagttcaagaccagactggactacacgacaaaacctggtctctacaaaaaataccaaaaaattagccaggctggtggcacacacctatactcctagctactcaggaggctgaggcaggaaggtaacctgagaccaggaggtcaaggctgcagtgagccatgatcacaccactgcactccagcctgggcaacagactggagatcctatctaaaaaaaaaaaattagggtgacattttctcagatgctcactgaaagaatgttgaaggagtttcacctatttgttctggcttttattagccttaattaccccgtgattatctttaacaattcctaaaagtcattgtgtttctgagtttttcagctctgacagtgttgcctgtttgtaagtgaagacctgcctgcaggcccctctccctgcacagcacttctcgtgggtttgccttcccttactgccttaccctgtgccttcttgttatgctttctgtgtggggctggccactgctttcctgtccccattaacactgcagtacctatccctaagagaggctgcccttcctgccatctcccttactctgaggatgacttactcatcctttttcttttatttatttatttttttagtttttattattttagaaacaaggtcttgctctgtcgccgaggctggcgtgcagtgatgcaatcacagtccactataacctcaaactcctgagtctgagcgatccttccacctcagcctcccgagtcgctaggactacaggcgcacgtcaccacaccagctaattcctttttttttttttttttggcagagaggagggctcactaagttacccagactggtcttgacctcctggcctcaatcgatcctcccccctcagcctcccaaaatgctgagattactggcacaagctaccatgtctggccttacccatcctttttctgacgcttgttacctgaggaacttgtctgtcccaggtttcagttcaatcagtgccttggctttcccaactctattctcctgtgtctccgaggatggggggttcaaagctcatctgcccccacctctcctgcagtgagccccacagtagctcacacccaagcctcacaggaagaacagcagtgggtcccccactggctgtgcgcccccgaccggctgtgcgccttggcctttccctggtccagaatctgacagcactcacacctctgacttccacacttgggcttctagccagtgtccaggcacaggatgagcaggactgaggagcgtgtctgtgtcctcttctggtgcaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggtgagcagggaaccccaagggcccacagccgcctcctgccacccactcctgcccatggggcctggaaggctccaacagccaggcatgaaggcttggtcggaggtgctcaactgaaacaaggtgaaaactgagtagactcgccctcatggtttttaggcctgggctcagaagcctcatgaacaaatctcgaaagagcagatacaaatcactattcatttaggagccacccaaaacagtcttgctttattagtcatcagagaaatgtaagttaacgtgatcaaagctaagacagttgagtatagaattagtaggggcttttgtgttgccattgactattttcagtgattatgaagcagatgcttcaaggcacactcaagtgagcagagtgtttatcagcacagcctcaggaagcagtttggtactgggtacaaagagcccaaaaatgttcagagcttctcctcaggttttctcattcttagattttttccaaggaaataatcctgagtaagagaaagctttccacacaaagatgttaaaaatgataatagcaaaaagttcaacacagactcagtacaacagaggaaacgttaaattagaattgttacagggtggattattatgcgggcatgaactattttaagtgttcatatgcagggcatggtggcacacatctgtagcccctgctacttgggaagctgagacaggaggatcccttgagcccaggagttcaaatccagcctgggcgacatagcaagaccctcatttctttcttttttttttttttttgagacagagtcctgctctgtcacccaggctggagtgcagtggcgcaatctcggctcactgcaagctctgcctcccgggttcacaccattctcctgcctcagcctcccgagtagctgggactacaggcacccgccaccatgcccggctaatttttttgtatttttagtagagacagggttttaccgtcttattcaagatggtctcgacctcccgacctcgtgatccacccgccttggcctcccaaagtgcttggattacagctgtgaccaccgcgtccagccaagaccctcatttcttttaaaaaaaaaaaagttttagtgacacaggaaaatatgcctatgatagtgaaaaaaggataccaaatgaaaactcagggaggagttaactatgtttaaatgaaatgcacagggaaagaaatgtgaagaaaatctaccaaatgttagcgggagacccacctctgggcatttttcaggtgggcaatttgtaggtgatttttctttactttgctgctgctttgtggtttgggtactttattaaatttgcttaatgagcatgcagtacaatcagaaaaagaaaaaattagcaagatttggctgggcgcagtggctcacgcctgtaatcctagcactttgggaggccgaggcaggtggggggagtggatcacgaggtcaggagatcgagaccagcctggccaatatggtgaaatcccatctctactaaaaatacaaaaattagccaggcgtggtggcaggcacctgtaatcccagctactcaggaggctgaggcaggagaatcacttgaacctgggaggcggaggttgcagtgagctgagatcatgccactgcactccaacctggcaacagagtgagactccatctcaaaaaaaaaaaaattagcaagattttacagaagccataaggctgccaggaattgttgttgtttagtgcctgggggaatggcccctagcatcggtaggggtggggactgccctccccattggccctttcactgtgagaggccaagtcatggctatcgtcagagccaggtttctagccgttttaggaaaagtgtagctgaaggtataggttattgttgtggtaacaacagatctcacttctgagtgccacccacgtgccaggctctgcatgggtggtgtgggctgagctggtgcccgaggcaggaaggagccgctcaggacatgtggagccatctctcacgtggctgtctccctccgggcaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgctcttgtcattgtgctctgtctgggaggtctgaggagggagcagagacccctcccctcacccttctgtggatgaccttgagtctgctggagtcaaaatttggggatgaaagcgcacagtcccaggaaccccatggtgttgtgccacagctcccaggaatgggcttgtgctgggagagcccttagcagcatcctggtgcgggctccctctcacaccacatttctcatttccagcagctgatggagaatgcaagcagaggttgtcctcgcttttcagaggaggggctggccgtggggtgcttagtggtgctgtgtagtgacggggagcacaggctgggagccaggtcgggccccattcacatgaggcccagggcagaggccgagctgcaagggagccctgggctcattctaccggcccatccttattttgcaagtagggaaactgaggcttaggagaggagaacatgacttgtccaaggccatagggtgactctgatacagcgagtctgtcctgactcttggtgctttccacacacatacagagggaccattttacaaatgagggaactacggttcccaccctggaggctggaggcctgggctcgagtcccactcaggtacccgggtgcaccatgacctcaagtaggcttcctctcccggtctcgactcctgctggcctgggccccacccctgccctcccctgctcacctggctggctatggccagtgggggtgagccacccacagaggccacatagctcactagcctgttgccttgggcaactaatatgactcctcgtcgctctactgcacctgtgacgcaagtgcaatgaggggtgacaaatggagtcagtgacagctgctgctgtcattgtccacccagccacagcatctattggcagggccctggtgagaccctggccccagggaggagtgagccaacaccaaccagcttctcccctcaccggctgtgtgactctggccaggtcacttaacctcccaggacctccatctcctcccctgtaaaaagcagtgatgcctcctgtttagggtcttaggaggggtgccctgggtccaatactcaggtgacttgcccaaggccactgctggtcaggacacaggggagccacatgtctcccaagcctccccagttttgctaaaaaccagtggtttctgagagaaatgttccctgaaagacatgggcgtgtctggattaggatggacaggttgcagtggccccatgagtgtttggggatgaggcatgaggccgggtgcctgcaccaccgtggtgccagaggctctgccggaagagcactcctgctctggctggtaatgtccacttgtcagacagatgtggggccaacccagctcagtctctctgtcccgtggcccccagcctggaggagagaccagctgagcctgcctgaaaggagatggtgcctgagaagcacacaaaacagcactgggtggggaagcagggacaggaaggagggtggctgagcacacgggtggctgtggaacagctcgttgctccaggacggcacttggcaagcaacaggcctgcctctggcccccagtgcccgcctgcagcaccagcagatgtgccctccccagggtcacactggctgggccttgaggcccaggactctctggtcattaccatagaggttgtaaagacagtgaggacagccagacgcggtggcttacacctgtaatcccaggctgaggcgggcagatcacgaggtcaggagatcgagaccatcctggctaacacggtaaaaccccatctctactaaaaatacaaaaagaaattagccaggcgtggtggtgggcacccgtagtcccagctactcgggaggctgagacaggagaatggcgtgaacacaggagacggagcttgcagtgagccaagccgagatcgcgccactgcactccagcctgggcgacagagcgagactccgtctcaaaaaaaaaaaaaaaacagtgaggacagaggcctttcc

SEQ ID NO: 15044 - DNA, 87869 bp, Human; identical to SEQ ID NO: 11744

SEQ ID NO: 15045 - DNA, 87869 bp, Human; identical to SEQ ID NO: 11744

SEQ ID NO: 15046 - DNA, 87869 bp, Human; identical to SEQ ID NO: 11744

SEQ ID NO: 15047 - DNA, 87523 bp, Human; identical to SEQ ID NO: 12670

SEQ ID NO: 15048 - DNA, 87523 bp, Human; identical to SEQ ID NO: 12670

SEQ ID NO: 15049 - DNA, 87523 bp, Human; identical to SEQ ID NO: 12670

SEQ ID NO: 15050 - DNA, 24368 bp, Human
  misc_feature (1)...(24368): n = A,T,C or G
ggccaaggcgggcggatcacttgaggccaggagttggagacaagcctagccaacacggtgaaaccccgtctctactaaaaatacaaacattagctgagcgtggtagtgcacgcctgtagtcccagctactcgggaggctgagccacgcaaatagcttgaacccaagaggcagaggttgcagtgagcggatatcacgccactgccttccagcctgggcgacagagcaaaaccctatctcaagataaaagaaagaaagaaaaaaaagtccgtagcctaaattagccgtcctgtgatcttctagtaccaagaccgttgtagaatatagcttcagagctagaaagagcattaggtgcttacaattgctaatccctatgttgccatgtggagggacatcagctgtccttcactcctggcctctttctccacctgtccccattgagttatctgatccccgagtttggaaggaactgaacaccagtatctcaactttttctttccttctttcttgggatctacctgcctgcctgcagaaggtgctttctggtccactctctggcacacaggagccccagactgtccatggccacctgtgactgggtggatacatttgtctaattctggggtgaacaaggggcaagcccacgtggcaacagctttaagctgcatactccatttgatatacaataataaaactccatttctttatctttcaattggtttcaactagggagtgagaaaagggtatgggttttgttctgttttgtttttgtttttctttttcttttgattccttaaaatttcaacaaggagtgtagaagtcttccatgtcaaaatgctgcaggattaagttccaactgcttagatcagcatacgaagtctatctcaatctctctagtctagtgattcataaagttggaggcaggttatttcacctacaccacccccaccaaactactaggccatgtggggatgttttttgagaaaaggggtgggcaaaactacttcatctcctctactccatctctattttgatatcacagttcctcaatacacaagcccttggcttaacttctttcctttcttttttcttcttccttttttttttttttttttggcagagtcatgccctgtcagccaggctggagtgcagtggtgtgttcctggctcactgcaacctctgcctcctgggttccagggattctcctgcctcagcctcccgagtagctgggattacaggcatgtgccaccatgcctggttaatttttgtatttttggtagagccaggttttgccatgttagccaggctggtctcaaactcctgacctcaggtgacctgcccaacttcgcctcccagagtgctgagatttacaggcataagccaccgcaccctccctttcctatcttctttaaaacctgctcttccttcaaaacccagctaaagcgtttcctctgtgaagccttctccagctacctacgtggtcactctcttctctgttccacagtgtatagttctgcttccatttcagcacttatataatacctttcttctgtaatctatgcacacatctgtctctccagccatactgaaggcaggctatttatcttatagatcttttgcatctccagtgcttggcaaatgaaggtggccaagaaatatttgtgaatgaataaatctcctcactttatagttgaggaaaatcgagatccagaaccaactgaagtggcttgtcagagagtatacagtaagtggcagaaccaagatcagaagccagatttcttggttcccaatccaactctctttccactatgcagtgctataattattaataggaaggtaaatagcagtcatttattattaatattgctgatctcgttaatattctggattgatggctgaatacattgcaaatatgaattcagtgtgtgtttagacaaggattagctatcctaaaactacaaaaaaattctttacagttatttaacataacatttcttttgaagcccagttcaatacaaacaagtgagtttgactcatcagatgaagagcctattgaagatgaacagactccaattcatatatcatggtatgttagcatttctgatcaatgatgagctaaaatcacaatctacatcataaatgtaaatttagttacatcataatcttagtagaatgtagttcacatattgaaaatgttaagggattatccccctctgattatataattctaatcattaaaggatcttctaactccatgattcatttactatctataatacagaataagacccttttttttttttggcccttctttatacattctaactccatgattcatttactctttataatatagaataagacccttttttttttttttggcccttctactaacttagtagaaggaagtaagtaggaaatagaggtaggattgaaataatctcccatttagtatcaaaatctacttattcttttatgacaaaagaataatataccaaatatgagatgagatatttaatcatttctcattaaatcaaatcctaggtaatacttagaagtaatgtcacagtaatgcatctatcaacagactctgtttaagataaaagccacatcaatgcaataacaaaaagtttctacataaaatcagccttttaatcttggcaagtgacttatggttataccagattctttacaatgagcaatcaaatgctttctctcatcactgcaaatataatagtctctcttcttaagaaagcactatccctactgtcagaagagaaagagtgtcctaaaggtcttttgtcctgccatcaaatagcattactttccatttccacttaaaactcccatttaaacacaaaaattcatctaattttcaaagtcaggtggtatttagatgatgcctcctgttttcctttaaatcatcttctgacatgcagacaaggtgagcctctgtccctgagtactgcaaactgggaatatgatttcttcacattatttctttttaaccaaaaacctgtggttttcatcatatgaaattatatctgttaaggaagttctatttaaaaatcttaaaatagtaatgtagaataaatgctggggagaaaattgtccaatagtcattttccaattcattttcctaaatcactaatacaaattatctcaggtaatataccacaggataacataagtacaccgtatactaccggttggcaatctaggcattattatctttaaggtaaatttaaattaacttggttttttgttttcttgttttttgtagagacaggatttcaccttgttgtccaggctggtcttgaactcctggactcaaacagcctgcctgccttggcctctctaagtgctgggatcataggcatgagccactgcacccagcctaacttgtcatttttaagacttaaataataacaaagcaaataagtccctgttttaaaactttgtctttctatgtttttttttgtgaccaacatattgatacttaactgtgaattcttactttgtgactactgtaaaactttaacacaactttatttggtggcaagcacccatattgattaaactgaatttccatttataactttttaaaaacttaactaaacatgaaaaatttttcttcttttcaggctatctttgtcacgagtgaattgttctcagtttctcggtttatgtgctcttccaggtgggtaacacaataatgggcttcctatcaatatgtatatattttttaatatatttttattgcagtagcttttggggggacaggtggtgtttggttacataaataagttctttagtggcaatttctgaaattttggtgcacccatcaccagagcagtatacaatgtacccaatgtgaagtcttttatccttcatcccccttccacctgttccccaccagcccccgaagtccaatgtatcattcttatgcctttgtgtcctcaaagtttacctcctgtttatgagtgagaacatatgatgtttggttttccattcctgagttacttcacttagaataatagtctccagtgaccgggtgcagtcactcacacccgtaatcccagcactttgggaggccgaggccggcagatcacgaagtcagaagatagagactatcctggacaacatggtgaaaccccgtctctactaaaaatacaaaaattagctgggcatggtggcacgtgcctatagtcccagctacttgggaggctgaggtaggagaattgctttgacaggaggcaggggttgcagtgagccgagatcgcaccactgcactccagcctggcaacagagcgagactctgtctcaaaaaaaaaaaaaaaagaataatagtctccagttccacccgggttgctgtgaatgccattttgttccttttcatggctgagtagtattccatggcatgtgtgtgcgtgtgtgtgtgtgtgtgtgtgtgtgtatgtatatctcacattttctttttttattatactttacaaccccactttttgatggggatgtttgtttttttcttgtaaatttgtttaagttccttgtagattctggatattagacctttgtcagatgcatagacggcaaaaattttctcccattctgtaggttgcctattcactctgatgatagtttcttttgctgtgcagaagctctttagtttaattaaatcccatttgtcaattttggcttttgttgcaatcgcctttggtgttttagtcatgaagtctttgcccatgcctatgtcctgaatggtattgcctaggttttcttctacagtttttagagttttaggtcttaggtttaagtctttaatccatcctaagttaatttgtgtgtaaggtgtaaggaaggggtccactttcagttttctacatatggctagccagttttcccaacaccatttattaaatagggaatcctttcctaattgcttgtttttgtcagttttgtcaaagatcagatggttatagatgtatggtgttatttctgaggcctctgttctgttccattggtctatatatctgttttggcatgtgtaccatgctgtttttgttactatagccttgtagtatagtttgaagtcaggtagcgtgatgcctccagcgttgttctttttacttaggattgtcttggctatatgggctctttttttgttccatatgaaatttaaagtagttttttctaattctgtgaagaaagtcaatggtagcttgatggggatagcattgaatctataaattactttgggcagtatggccattttcatgatattgattcttcctatccatgagcatggaatgtttttccatttgtttgtgtcctctcttatttccttgagcagtggtttgtagttctccttaaagaaatccttcacataccttgtaagttttactcctaggtattttattctctttgtagcaattgtgaatgggagttcactcatgatttggctctccgtttgtctgttattggtgtataggaatgcttgtgatttttgcacattgattttgtatcctgagactttgctgaagttgcttatcagctttgggctgagacaatgaggtttctaaatatacaatcatgtcatctgtaaaaagagacaatttgacttcctctcttcctatttgaatactctttatttctttctcttgcctgattcccctagccagaacttccaatactctgttaaataggagtggtgagagagggcattcttgtcttatgacggttttcaaagggaatgcttccagcttttgcccattcagtatgatattggctgtgggtttgtcataaatagctcttattattttcagatacgttccatcaatacctagtttattgagtgtttttagcatgaaggggtgttgaattttatcaaaggccttttccagatctgagataatcatgtggtttttgtcactgattctgtttatgtgatggattatatttaatgatttgcatatgttgaaccaaccttgcgtcccagggatgaagctgacttgatcgtggtggataagctttttaatgtgctgctggattcagtttgccagtattttactgaggattttcgcatcgatgttcatcaaggatattgacctgaaattttcctttttgttatgtctctgccaggttttggtatcaggatgatgctggcctcataaaatgagttagggaggattccctctttttctattgtttggaatagtttcagaaggaatggtaccagctcctctttgcacctctggtagaattcagctgtgaatccatctagtcctgggctttttttggttggtaggctattaattactgcctcagtttcagaacttgttattggtctattcacggattcgacttcttcctgggagggaagaagtccctttagtcttgggagggtgtatgtgtccaggaatttatccatttcttctagatttctagtttatttttgtagaggtgtttatagtattctctgatggtagtttgtatttctgtgggatcagtggtgatatcccctttatcattttttattgtgtctatttgattcttctctcttttcttctttattagtctggctagtggtctatctattttgttaatcatttcaaaaaaaccagctcctagattcattgattttttgaatggctttttatgtctctatctccttcagttctgctctgatcttagttagttcttttttttttcttgagacagagtctcactctgtcgcccaggctacagtgcaatggcacaatctcggctcactgcaagctctgcctcccgggttcatgccattctcctgcgtcagcctccctagtagctgggactacaggcacccaccaccacacccagctaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggtctctaagaacttgctttatgaacctgggtgcttttatgttgggtgcatatgtatttaggatagttagctcttcttttgcattgatccctttaccattatgtaatccccttctttttctttttttatctttgttggtttaaagtctgttttatcagaaactaggactgcaacccttgcttttttttgcattccatttgtttggtaaatatttctccatccctttattttgagcctatgtgtgtctctgcacgtgagatgggtttcctgaatacagcacaccaatgggtcttgactctatccaatttgccagtctgtgtcttttaattggggcatttagcccatttacatttaaggtcaatattgttatgtgtgaattttatcctgtcattatgatgctagctggttattttgcccattagttgatgcagtttcttcatagcgttgatggtctttgcatttttgtatgtttttgcagtggctcataccagttgttcctttccaggtttagtgcttccttcaggagctcttgtaaggcaggcctggtggggacaaaatccctcagcatgtgcttgtctgtaaaggattttatttctccttcacttaggaagcttagtttggctggatatgaaattctgggttgaaaattattttctttaagaatgttgaatattggcccccactctcttctggcttgtagggtttctgcagagagatatgctgttaatctgatgggcttccttttgtgggtaacccagcctttctctctggctgctctttacatttttttccttcatttcaatcttggtgaatctgatgattatgtgtgttggggttgctcttctcgtggagtatctttgtggtgttctctatatttcctgaatttgaatgttggcctgtctttctaggttggataagttctcctggataatatcctgaagtgtgttttccaacttggttccattctccccgtcactttcaggtacaccagtcaaacataggtttggttgattcacattgtcccatatttttggaggccttgttcattccttttaattcttttttctctaattttgtcttcacactttatttcattaagttggtctccaatctctgatatcctttcttctgcttgatcgattcagctattgatacttgtgtatgcatcacgaagttctcctgctgtgtttttcagctccatcaggtcatttatgttcttctctaaactggttattatagttagcagttcctctaaccttttatcaagtttcttagtttccttgcattgggttagaacatgctcctttaacttggaggagtttgttattacccaccttctgaagcctacttctgtcagttcatcgaactcattctctgtccagttttgttcccttgctggcgaggagttgtgatcctttggaggagaagaggtattctggtttttggaattttcagcctttttgctctggtttttcctcatcttcgcggatttatctacgtttggtctttgatgttggtgacttttgaatgggggtttctgcgtgggcgtcctttccgttgatgttgatgctattgctttctgtttgttagttttccttgtaacagtcaggcccctcttctgcaggtctgctggagtttgctcgaggtccactccagaccctgttttcctgggtatcaccagtggaggctgcagaacagcaaagattgctgcctgctccttcctctggaagtttcgtcccagaggggcacctgccggatgccagctggagttctcctgtacgaagtgtctgtcgacccctgctgggaggtgtctccccgttaggaggcgcggggttcagggacccacttgaggaggcagtctgtcccttagcaaagctcgagcactgtgctgggagatctgttgctctcttcggagccagcaggcagaaatgtttaagtctgctgaagctgtgcccacagccatcccttccgccaggtgctctctcctagggagaagggagtttatctataagcccctgactggaactgctgcctttctttcagagatgccctgcccagagtggaggaatctagagaggcagtctggctaccatggcttttccacactgtggtgggttccgcacccagttcaaacttccgactggctttgtttacactgtgaggggaaaactgcccactcaagcctcaataatggtggatgcccctccccccaccaagctggaacatcccaggttgacttcagactgctgtgctggcagtgagaatttcaagccagtggatcttagcttgttgggctccgttgggggtgggatccacagagcaagaccactcagctccctggcttcagccccctttccaggggagtgaatggttctgtcttgctggcattccaagtaccactcagttggaaatgcagaaatcacccgtcttctttctgcattggtcttgctgggagctgcagaccagagctgttcctattcagccatcttgcccgggaatcccacattttctttatctactcattaattgatgggcatttgggctggttttacatttttgcagttggaaattatgttgctataaacatgtgtgtgcaagtatctttttcatataatgacttcttttcctctgggtatatacctagttgtaggattgctggtcaaatggtagttctacttttagttctttaaggcatctccacactgttttccatagtggttgtactagtttacatttccaccagcagtgtaaaagtgttcccttttcaccacatccgtgccaacaatatatttagaacaagtatttggtcaactaacacatcattctctatactgggcaataagtaaatttcacagaccatcagcactggggaacacactttgcgaagccctcatggtggactatagttaaaggaacatagatctacctttcagcccttccagatctgcagtcacagccctacacttgtactttgccaatcttaataaagcttaaagcctggagtacaaatgaggctgaggactacaaccaggtacttgttacagaagaaacacagaatacagaatccttgcttaggatgaatccctgtaattatattcctagaaatataagaaattgaaattcatattcaaaatataattgaaacatataaatgattacgtgaaatgactttataaagtagctatataagtgtttaaacatacctgttacatatgacgaaaaactgacttttttacttgctttattattacttataggttgtaaatttaaagatgttagaagaaatgtccaaaaagatacaggtaggtataatatcacgcaaccacactcatgggttttttaaatgaatagcattgaaaaactctctgtcaaaaagaacaaatcagtttttttttaatataaaaataagttttcaatattgtgtgaagttccaaactatagacttattctgatatgtaaagaggtatttgtgaagaccatcatttacctaaccatggagttgcttttcactgattgttgtagttatattatacatataaactacatttgaggttagaatgtagaagttggcatgaaaaaaagtatgtaaataggaaactgacatattgctccccccaggtctttactgttccttgcagacttgactgtggtagtagaaattaaacatgagctgggaactccaagttagcagtgaaattgtgaatcctggatggaaaattttgagagccagcatctagatggaaaagacagaatgggaactggttgttgcctgctcaaggatgttcataccattatagccacaagtctaataatcctcataatctgccccaatttggaatttacatattgcatgatactaacaaatgtggattttcaaaagattttattctgattggcctggaatgtctcaaacctactagtcctaccgatatccttatagtatggcaaattaaaatgtatatattgcttgattctaactagtatagattttctgaatcttaaaaacttttcgtggttattctagaacatcagtttgctaatgtacttttaaaaatttattcctggtcaggtgcagtggttcacacctgtaatcccagcattttggtaggccgaggcgggttgatcgcttgagctcaggagttcgagaccagcctgggcaacaaggcaaaaccctgtctctgcaaaaaatacaaaaattaactgggcatgatggcgcgtgcttgtagtcccagcaacttgggaggctgagatgggaggatcacttgagcccaggaggtcaaagctgcagtgagctgagatggtgctgagatcacaaggtcttgctctgtcatccaggctggagtgcaatgagctgagattgcattactgcactccaacctggtggcagagcaagaccctgcctcaaaaaaaaaaaaaaagtattccttacctaccaaaaaaagacttaaagacagtaatagatagttgacccttatagtatttataaaacttttctgctttagacacacccaccatgctaggaaatttctatttggagaacatttaggtcataagcaaaatatatgtaatttaaatcattggttcaaagtcagtcttgtacattttggaatgtcatattcatttagcattttctataaaaacagtttccaatttttttcaaaatacttttttttctgcaatgaaatcttaaatggaatccagtacataaaacaggtcaatatgtttgattggagacctagaatctccctgcagcagttcctgagatactttcttagccctttctcagaaagttggaaaatcactggataataaaaattaccaaatgtgtacaaaaggcaaatagatgtatagtactgtacatctcagggattagttcatgagaaggtactttgtacttaaatagctacatgtccttggatttaagggacagggagagggctggagttgggagcacttagatcatccagttatttattttaaaccaaatgctcaatagttaatattgccataaagaagtcctagtgtatagaatgcctatagtattcatatcattataatgagaatagctaggtcacagaagtttaatacaggtaatgttttatttactggcgacctagtctataaaattaaatacacaaggatgtgttacagtgcagatatgagggagaatactagcacctctgacaccatggccatgctggagattttatatacaatactcagagtcaagcaaacagctaagtgatgaagtagcagacatggttgattttgtgagaaaaagaaaaaaagtnnnnnnnnnnnnnnnnnnnntatttgctactcaattttaagtgttttaagagttattttatgccaggcatggtggctcatgcctgtaatcccagcactttgggaggcggaggcgggcagatcaactgaggtcgggagttcaagaccagcctgacaaacatggtgaaaccccgtctctactaaaaatacaaaattagctgggcgtggtgacacatgcttgtaatcccagctacttgagaggctgaggcaggagaatcacttgaacctgggaggcagaggttgcagtgagctgagatcgtgccattgcactccggcctggtgacagagcaagactccatctcaaaaaaaaaaaaaaaaaaaaagagggggggttattttaaagcagtattcattgcaaaaaaaaattttttgcaagaacagcaattgacttattttgaaattcagtaaaaggcattttgacttgtaatatgaggtttaattctagaccccttttgattcagacatatcaataggcacttcagatttatagattgtcatttggtattagtttggcttaagaaatttaatttcatattctccctcttgatggtatttaaatgtgtgatgttttctatgtgtgtgtgtctgtgtatcctggtctattggcagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacagtacgttcttttctccatacactatgtgagaaatgtctcagtcaaaatgatttctggaattatggtagccctattcagttatcacctacttcatagtttgttgtaaggattaaaaggtaataatgcactaggaaagcactggcacaatgtctggtacagggtaagtagtcaaatacgtgctgttattacttttcaagagtagggacaataaatgagtagatttggaaattgttagaacaaggttacaagcttttcttttttatttctttcctttagtcttagacctttagttgcaattttgggaccctcctttcccctcatcaccatcactgcctcacttattagcttttcaattgcttagttgctttcaatagcaagaaaatcaattttttggccaggtgcagtggctcgcgcctgtaatcccagcattttgggagactgtggtgggtggctcacttgagctcaggagttcaagaccagcctgggcaacatggcaaaaccccatctccgcaaaaagtatacaaaagaacatgccaggcatggtggtacgtgcctgtagtcccagctactcaggaggatgaggtgggggaactgcttgagcctgggagacagaggttgcagtgagccaaggtgacagtactgcactccagcctgggtgacagggagaccccatctagaaaaaaaaagaataaagaaagtcgattttttcaaaattagctaccaaaaaagttacctctaagcaataagcaatcctaaaaatatgacttgaaaattacatttgatgatatgactgctaacagattgaaagagggcctctcattgtgtgtcagtggctataaaaacacaagctgctggtgtgaaagtttaaaacaaaagaagatgggttaaggaaaggggacaaaatgaggaggaaagaaaagcagcttggaggaaggccagagagagtggcaatgggcagtagatagtagcatggcaaagattcaaaggggcgatgtggataaaaaacaagagatgctctgccggaagtgaaacacacaaagcaacagagatccagccatggggaggaaactggactttgccgtgcataatgtatatttcatattctaataacctgcttaatcctttctcgaataaggtagggtattaaatagtttacgacctcaaaagccccaagttccttaaggacattgctttgagctagaagtatagaaattatatcaaatagccatggggttctcagggcacctagtcataggacaagcccagccaacttctcctcttaaacctatagcccaggggcctcatgccaacagtgtcagttctgaaggcaaaccaactagtacgagggtctttggggacacacacctgtttgtggccaaactgaactctgacatacagagaaatatagtttgcagaatatgcagtagagaactagaagccattctacatcctattgtttcccatcttcctctatggaaaaagcatagtcacttaaccagtactaattataaaagctaaatttcaaatagatccagttgatgatgtgaaagtttctgatacatataggtaaaatagtattagatagttaaatgtagctggggaaaaatattttccaacatagggccctatttttcaaaccattttgagatcttttttttttttttcaaataaatttttgaaagcagcctctactgaaaagtttccagaaatcaaactagctctgtttagtgaagtgaagcttaacaaattctactgtagctggttctggcaacccaaatgctctgatgtttgtgcagagtacaaacaggatagacagtagatgggtgactttgcatatgctgaatgtttcagtctcccataaaataaagcatctgacaactggcatttttcattgtcctagagctttcgaaggtgtcctacggtgactagtttattttctatccattctgccatctttgaggacccacacttctagacagctatagagcttatccttcagcaacaggatctggtaaacctttttcactgacctgttgtctaccagtgctgtctcactggttctgcctggacatttgcagccctttataaaattagtgaacaacactgcttgcctactgtattttgtagtttcttggggctattgtaacaaagtaccacaaaccaggtagctgaaaacaacagaaatttcttctttcccatttctagaggatgtaagtccaaaattaagatgagagcagagccatgccctctgagactgaggagagtccttccatgcctcttcctagcttctggtggtggccatcaatccatggcaggccttggcttgcagctgaatccctccagtctgcctctgtcatcacacacttcctcggatgtctgtgtctttgcatggtgttgtccttgtgtaaggacactagtcatctaggatgagggcctgctctaattcgtcttaacttgaatatacctgcaaagactcaaattctgaataaggtcccactcacaggtacaggataaggacttcagcatgtcttttggggggacataattcaaccagtaacacctaccgtgtaccacacgccaagactaccaaacgaggcacagtccccaccttcgaggaacctataactaacactaccatttaactgcaataagacaggagaggcagcacacaggaaaatgatcctttctgtaggagcacaaaggcattttaggaaatgaaatttgaggttttaaaagataagtaggaattcatcaaatagaagaaaaaagatgaaaatagcaaaaggtataaaatagtattaatcttgcaaaaagacactgaagtgttctatcttgatctttttttttttttttaataaggcagttgtctcttctctgtcacccaggctggagtgcagtggcactgtcatagctcactgtagccttgaactgccgggctcaagcgatcctcccacctcaggctcccgagtagctaggacttcaggtgtgcgccaccgtgccaggcttttttttttttttttttttggagagacagggtctcactttattgccaaagctggtcttaaactactggactcaagcagtcctcccaccttggcctcccaaagtgctgggattataggcctgagccatcatgcccagcctctccctttatatggtagatccagatctctgaaacagttctatgtctggaacactttgtggaaagcaagttcacgagtaagactaggggtcaatacctattcagtcctctatttcacatcctaaagcaaaatatatatctacagctttacctacaatacaatacaatacaatacagtaattgatgtccataacgataagtcatccacactaaattaggctcagtataccctctaagtacattaggaagcatgtaatacattttttaggatctttgaaaatgacttaaatgaatagttttgctactgaggattaatctccatttttctggaaaatccagttatacaaaactgctaatttctttacagtgctagataacagcagctaatgttcatttacttcttactctgcacaaagctgtgttctaagtccttggcaaatgctcactcatttgtgagcctcatttaatcctcactctgatgtacatactattgctatcaccattttaaaggtgaaaaggctgagtcccagagagattaaataacttgcttagctttacacatctaataagtggcagagccaggactgaagcccaggcagtggtgctccagagcccatgctccagacttcggtgataccctatctctggactcctttagatacatgaatggttattatctacatggcatttgtgcagtaaccactcagattttgtttagacagaggaataatcaaagtgacagttggtaaaagtctgatttctatctattggtaacatgctccatttctcagatgtggatcttggaacctaaagaggtcaataagaagactctgcctatcttgatgcttagaggtgttcagaattcctcccaacaaagaaataagcacaccttgctctcagttgattaaatcaaaaatatttattaatcttcgtgtgcaaggcactgtgctaggcattagagttgtaaatagaaggcagaaagagcaagtctttagttgtaactagggatggaatgaaatgtacaaacttcaaaactgtatttccctttcagctgctatggaggacttgggagatcttgtcttggtaagaaatatatttctattatttttttaaccgccaaatagacaaacttctgtttccagaccatatgttcattttgtattaaaatggaaccaagcaaaatataagtttgctaagactcaaaggattacttaaggccctaaacatggtgttccctggaaagcttgggtgggagtgggaggtattttcagcattgttctggaggattctggcaaaacatcatttacaagtcttaacacctgcattcttattttttaacattttttgatgttcttcctgtggaggtgttataatagagtaacttccaaatagtttccatgggtaactatttatgaataccaaagttaattactatatgttaatttaaaaaatgttttaatgtactaagaaaaacaaaaaagagttcgtgaaatgccacactggagtagtagttatttttttagtgttggatgatatcaaaattgaaagcttttgtgtttcaaagaatactatcaaaatgacaagactacccatagaatgggaaaaaatatttgcaatctatatatttgataagggatttgtatccagaatataaaaagaactcttacaactcagtaataaagataggccgggcgtcgtggctcatgcctgtaatctcagcactttgggaggccaaggcagaaagatcacctgagtttaggagtttgagaacagcatgagcaacatggtgaaaccccatctctacaagaaatacaaaaattagccaggcatagtggtgcatgcctgtagtcccagctccttgtgggactgaggctggaggactgcctgggcccaggaggtcaaggcaccagtgaaccgagtttacaccactgcactccagcctagatgacaaagtgagatcgtctctctcaaaagaaaaaataataataataaacaaacaacataactgaaaaatgggcaaagtatccgaataaacctttctacatgcaagatacacatatagtcagtaagcacatgagaagatgctcaacatcatcagtcatcaggaaatgcaaatcagaaccacagtggataccacttgacaccaattaggaagggtattataaaaacatgaaaaataacaagtattggcaaggatgtagagaaattcgaaccctcatacactgttggtgggaatgtaaaatggtgcagcggctttggaaaatagtctagcagtagttcttcaaacaagtaaacattaacatatgacccagcaatttcactccaaagtatatacccaaagacttgtatacaaatgtttatagcagcattaatcataatagccaaaaaatggaaacagcctaaatgtccatcagttgacgaacagataaacacaatgtggcatatctatacaatggaatattatttgatcataaaaaggaattaaatacagacatatgctacaatatgtatgaaccctgaacacattatgctaagagaagtcagacacacacaaaaaaatattgtatgtttccgtttatgtgattgctcagaataggcagatctacagagacaaagtacactagtggttgcctatggcaggggttgatggggaatagaggatgacagcaaaagggtacacttctttctgaggtgatgaagtgctttaaaattgactgtggtgatggttgcacatatctgtaaatatactaaatcactgaatggatgaacactttaaatggatgaaagaatgaagccagtgttaaactctaattcaaccatacggtcatttaagatcataatttaactgtcaaaaacacacactaaaagtctcagtcttttaattcatttggaacaattacaccagtcttctgtatcaacagaagtcttattaaatataaaatgctgtaccctgtcactagttatttaataacatattatttttctgtcatgttccattagtagctgcttgtctcctactatacctgtctgacacaatatcaccagagcaagccatagacagcctgcgagacctaagaggatcccggggcaatacagaccatcaaggtgaggaggtgggcggtgcttgcttggttgtggttggggtcgttgttacaaatacagattcatgtgtaaccaaaaggttacatatgaaaatccaaaagggcagtgaaatgaaaatccaaagcactctgttattcaaataccacttgcttatgcttttagtttttaaaaatttacaagtaaatataatccaggtagtctaaaaaagcacacaggatttcaaacaagataatgaaaatttgaacttcctggtttacttttccaggatctacctacttctcagtttttgccccagtccgttttgggaatggatcctctcacctaggacaatgagatggttattgttaatacaaacttggtacgttcttgggtagattcttggccaaaaaaaatctatggaagatcttgttatatcaccaaaacatttaataaagacagatgaatgactataatacaaaaaatggaaagcagtgctaattatcctttgcagtagataactggggacatcttccacatgtacattcccctaacacttcaaaacactgcactagcaatgccaaggatattgcattaatcatgttactgaaaagattctgcagatgtcacttcattttgtagatctgtaaagctaatgtgccttcttttcagaagcgtgccctctcagcattagaatccgctcatcagaggagtgggcaccaaagaatcctggctgttaggcagctccctagacttgagagcccatcttcccagggttggaggtctaatccagtgtcattaacagtgaattatcataattactgataaattcaccaagcaacctgattcttagggcttaaataaggtcattaacgggacaatccatacaagatccactccactgtacaggtctgaaacagacaactctctttatgttaaaaatcaaacgatgcggccaggcgcggtggctcatgcctatatcctagcactttgggaggctgagctgggtggatcacttaaggccaggagttggagaccagcctggccaacataacgaaaccttgtccctactaaaaatacaaaaattagccagggtggttatgtgtgcctgtagtcccagctacttgggagcctgaggcacaaaaatcacttgaacctgggaggcagaggttgcagtgaaccgagatcacaccactgcactccagcctgggcgacaaagtgagaccctgtctcaaaaaaaaaaaaaaatcaaatgatgcttcaaatccaaaaagttcacctctcttctcttgaaaacaaactacatggccatggccagatgtatatatgaatatccatatgttttacatctttaacattgcagataattaagtccatattactacagactcagtttatcacctcagcattctgtggcaaacaggcttgctggtgttagcaatgcagtttccacatctcaataaggatatgaaatgagatgattggcagagtaagaatatcttttgggaggctattaaaactccaaataaattatttaaagcttttattttgcttatctgctgagattagcaatacagtttgtttttaaaaaatattgtctatgaaaattatccctagtgcattatgtcatcacaaaaaagcagaagactagggcttctataaattgagaaatggattttgttaaatataccagttacttgctacagaaagtgctctgtccttcttaccaggggggaaaaatgttagcaaaaataatgccattatgtactgttttaatcttatttggtcctgtaagtaaagagagaaagaattttagacttaaaacatatccatctacatttcatttcaccttctgatttttagagacttgtagaacaatagtttttcacactatatggctttactaaaagataaaacttccccatgatgcaaatgcttccttacccaaaaagatgtagaattgtgcttagcaagtatttttttttattcctgatacctgctaatattgtgcccacactgataactagttttctacagtgtattccaatgtatctttacttttttcagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaactcgttgtgtctctttcatttcttataggaataggaaaattgggataggaaaattggtatgcaattttccttttagaaatgaattggttgttctggtatattctacctggaggtaatgctgaaaacatgcatttggaaaaatatttgaatgcctatttttaatacttagtactgcacttttacttcattttactgtttgtaaccactgggtagcatatgacaaagtagtaagtatgagaattggtatgagtgcccaaacttacttttaaatgatgtccccctccctctctattcctcccaaaacttcttccgctttttacttcatagacctccggaattgaaaaggatcctgtgagtcttccactcgccccctcccagtactggatcagccccaagggtgtttattcactatgggctggaacattttcagagacaaggaattcactggttcagacagctgctccaccttttgtccgccctaggaactacacggaatgagcttaatcctttcacatttatttcataaagaatttagctacagattaacaatttccaactctctcactctttcacttccccctatactatgaaacctatcttttttcatctttaaattcaactttgagttacccaaaacagtcatttgggctgtagacaaggatcacacacaatgtgtcaaacaaacacacttgttttaacagtcagtggtttcagtagggcttacagtagtcacatggctctcttggctactggtaattacaagtgtgaaccaatggcaatttggcaatgaccaccaggttgcagactcataggcacttccacaaaagacaaagtttcactacatcaaaatttcatttttaaataattattcaatgactggctgggcgtcatggctcacgcctgtaatcccagcacattgggagaccaaggtgagcaaatcactttaggtcaggggtttgagaccagcctggccaacatgacgaaaccccatctctactaaaaatacaaaaattagccaggcgtggtggtgcacgcctgtaatcccagctacttgggaggctgaagtaggagaatcacttgaacccggcggggcagaggttgcagtcagccgaacccaggggacagaggttgcagtgagccgagatcacaccactgcactccagcctggacgacagagagactctgtctcaaaaaaaaaaaaaatcatacaatgactaaacatcttattttgtctcacactactcttcttgctgctgattaactgcttgaatttcattacaaaataatgcaaaacaatgaccagcctgtttgggaatttcagagcactagtatgtattgtaatataaaatcaatatattaatagagtcatcccttgttatcctcagaggattggttacaggaccccccaccccacccccaacagcaaaataaatggatgctcaagtctctgatataaaatggcatagtatttgtatactttaaatcatctctagttacttataataccgaatacaatgtaaatgatgtgtagttattatactgtattggttttatttgtagtatttatttttcaaatagttttaatctgaggttgagtcagcggatttagaacccatagatacagacggctgactgtacttttatacataacgctgcttctagaacttaacattttatgaggatactaaggaaggtaggaggatcacatatcccagcagtatctaaatggttaacctagggatttcattttctcatataattaataccaaaagttatagcaagaaaagtttttttttgttgttttttttttgagatggagtctcgctctgtcgcccaggctggagtgcagtggcatgatct

SEQ ID NO: 15051 - DNA, 135667 bp, Human
gcagaggatgctgctgctactagcagtgctctggaggtacagaatatttcttaatttacaccactccttatcttatttctccgtgctctagtcaaccactcagaagtaagctggtgaaactttcacacttttccgctgtctgaaatcatatcaaacaactatgtgtacaacttattaaggaactaactcctgtaaaaatagagttgaggatcatagaataaatttttaaaaacatgattcatatgagagataatgaagtagttgttgttttaagttactaaaaaagggggggaacccatagatcatatccttcctctgcttaaagccctccaatgtcttctaatctcactcagaataaaagccccatgagatcctacatgatctgccccaactccttgggtcactgatctcttatttcccaacttattcactttgcccagacataatggcctgcctatgatacctgggaatcagtgcagctcccacctctgagcctttgcattatctgttttcctctgcatgacgtgcttttcctctggatatcttcatgagtcactctctcacctgcttcaagtgttaaatataggttactttctcaatgaggcctacacggactcccctatttaaaattgcaaactcatctccaccctgacccagaacttgtgtttccttaccctactctacttttttccataacacttaacatcttctaacatactatatactttacttatttactatatatattgtttgtatattgtgttccctccactagagtataagcagagactttgttatctgtttcattcgctaatatatcccaagtgtgtagaaaagggcctaacacatattaggttctcaataaataacagatgaatgaatatggataaagaataaaatcaattctgattcataaataattaggaaaatctaaaatgttttatccatttggggttctcccacagtcctaaagccacagatccctcaaagctttggataaatgcaactagttattgctaacaaaaggaccagatcccactaagatattctaaaataaagcccttctgtatggcaagggaaaacgagactcttgaacactgttgtcatggtgatcccaggtcgtctcatctatgggagggaaagctcagcaagattgccagtgtagcctttaggccatctggataaacatcaggcagaaggcaggcattcatccagggaccaggagtgactctcaggttttgttcttctctagaggaagtgaagagaggagaagaaagggaaagaatacagtgggctgccactatggaaagccttgcaggatagtccattatggtaatctgcacagcctgcttggtggaattggcagaagtgatctcttacattgctccacttagttgcaaaaaaaaaaaaaaaaaaaaaaaaagatactgattcttattggaaatataaagctcagaagtcaagttgtgtccaaggctcaaaactacctgctttgtcttgctaaaggagaggatataaacagcaatggacgaggaataatgggtgattttcagatttgttgatattcgtgggcccaattagagtgctgtatacatcagattatctgataaaatctgtgaaattgaaaaagttccctgagagaatgaatcagaaattaaaacgatgacttgtagaatcttctctgcattgaaacaggaacaccaactgagattctgttgctaagatattgctgggtcattttttaaaatagctagctgaagatagagaggtctgtaaaacactaattaattgggccataacagtaattagccttttagttcaggtggcctgtctttccagcatagccctggaaacagattatttttgtgctaatgagatatgtgtttctcaagcaacgacaaaacatctcgcctaatggaattttgttttatccctcctctctctgtccatctgtctgtccgtgtgtgtgcctccgtggctctccttcgctctgtgggacgacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaaggtaaaggatcccaagcagggatgcttggttagtgtcctccctctgggtgctctgagcattcagcaggggcggttctggctcagccctggagtcatccccatgctgatcaaacagttgaccagagaacggttccaggggggatgggaggagatgagagaattcagatctgcagctgggacagaagtcggtggcagaaccgcgtgctcagggcaactcaggactggctgaacccagcctccctaataatgagcggttttgtgttcactccaggatctcctaaatggagtgcatgcgcctgtctttccattccagggctgggtttcctcccccaggaaagcgatgcttttcttgttattgtccaggctctggtccagttcccctgctcagtctctgtaggtgctggaacccaccactagcatgttctattttgccagccaggcctgtttcttaagtatgcaaaatggagctcagctccatcctttctcttacccaagggcaagggatttgggccttggtaaggtttttatgtcccagtgagtcaggcaagacagagaccacagttgggtccagagttttctcttgtccctaagcaagactgaaggtgattcattcacttttaaagtctcttattacttagaatgaatttaatgtggtcattatgttctccctatgaaaaattttgaggtgagtcttcaaatgcaagaaaaatggaagtcatttgttttccagacattatacgtgtacaagagattcttccccaaaaatcgttcaccgcacctgattgcagttgtcttatggaattcaagaaaggaattagagtcacatgactaagtgaggtcctgctcattctatttttgttaatgggtgaagttagagaacttctaccctgttcctggggagagaacactcaggtaggactttaaaacaaaccctaacaactgtattcaaggtcccctcccacccatctcttctacttttctttcctttagaagtgctttctttgccttttccttttggagataagtgatttcaagggtgcgccctctttcctgtgtctatgctaacttcaatgatgttagcggcagttaaagtgcttcatataaaaatagaggacaaaatctttctcgttattttaaattggaagctagctgctaaattctttaaaattaacacattggaatagaatagaggaatctagaggactgaaataaaaagatacatagttgctgtggctcagacatgtggcatggtgtgggggctgatataattgactcttgacttcccaaatagctcttcttaaagagctgaaagcatatttagtgtgtgtgatagggaagatacttgaagacaaatttaacggtgggaatgtgtttgttgggtcaatcttaaaaccattttgggtttttttgctactatcctgacatagtaagaaaagacgctgcagcttgcagggaaccacaggaaaaagtattaacatgaacaaccttcagccccttggggccccaaaacagtcaagcttgagtcatgctgagcatgtgttcatgtcactgtactgtaacaggcatgtgtctccattttatcccctaactaatgttcctgagatagtcaccgtgtgcacggtgctgttcaaatatgtttattctcaaaagtagataaatctgagggctaaagagaaaagggaactttgcaggcctattgagagacaaggacaacagctgggactgactgaccagacacctgatgaagagctgaggagatggaaaactgcagctgtgaatgcaaaggcttcagagtatcttttatggccaattttgtgtcatttgaatctctgtacaagttgccccatatggcttggaccctgtgctgccaagtttagaaggtagagaggagggtgtggcagtcttttcaaaagatgagggcgtgccaaggtgaataatctccactctcttctgcacggaggggtcctttgaaatctagtctcccactgaaactcactgctccactgcactatctatgaagagtctaaaaggccattctgaggcagccaagaactggaggtcctgagcaggtgattcagcaatgccagcaggcaatttgagctctgaggttctttttggtctcacttgctctgtctcagcaggtgagaaaggatcagcgctgcccagccttccccaggctgttttttttttttttcgtctgacacagagtttcacttttgttgcccaggctggagtgcaatggcgtgatcttggctcactgaacctgaccttaggcgatccgcctgccttggcctcccaaagtgctgggattacaggcgtgagccaccacgcccagccccaggctgttcttaatcactgtttgtggacagcaggtttgtgctcatgccaagcttgactcctggcaacagtgaggtccggtcagcttctgtggtttcctgctcttgtccactgaagcttctggcagtatgcatgcattaattttatgcattcacaagtatccaggggatgagccatcctgctgatgctggacagagtttcagaagtgcctagaaatatttagaataatatttaggataaggtttgacagatatttgatggcatcattgcatgtaccatggaggagcaccagggtaactggtgcacgtgctctaacaaggcctagttttggagctttctcacctttcagagacctctgcagttattgcactggagacaaaacgcagttctttcttcatgcttcagttttcctccttgtatgcccctgagctcttgccgccctgtatttctgctcccctacaccttctaggatgacctgttataaacattagattctaaagcaggtagatatgttttcctttctacaagattagccgtaactgttaggaatgtccaagtaaaaagccaatttaaaaattttcataaaagcactaatacccagtgtgattaatcaggatagttatgtgatatttaccaaacctatgtgattgtagaatactttttattagagtgtgccgttgggttcatattccagggggacacctgttgggaaatcatggtatctttgcccttgagcttgtttcctgcattctgattacttatcatgcaactcaaaagtgtgtggcttggaccagccatgttgatattatgtgggaggttgttagaaatggggaatctcaggctgcttccaagacgtactgaatcaagatcccctgtgcataagtgcatatgtgattcttatacactttaaagcttgggaagcagagttttattttttttaatttatttttatttatttatttattttgagacggagtctcgctctgttgcccaggctggagtgcagtggagcatctctgctcactgcaagctccgcctcccaggttcacgccattctactgtctcagcctcccgagtagctgggactacaggcgcccaccaccaccacgcccggctaattttttgtatttttttttttttagtggagatggggtttcaccatgttagccaggatggtcttgatctcctgaccttgtgatccacccaccttggcctcccaaagtgctgggattacaggcgtgagccaccgcactcggccagggtagcagggttttagacgatggcagtatgctttcatattcctacttgaaactgactgtcttcttgccaaacaaatggcctcttttcaatctcatctttcttgtcctctctggtaatctaatatcatactgctgatcagtccttaaaacgttaataataaagtaatgtatatttgttgtaataaattcaaactgtacaaaatggcacagaattcaaagttaaagagtctgggcatggtggcccacacctgtagccccagcactttgggaggccaaggctggtgaatcacttgagcccaggagttcaagaccagactacgcaacatgatgaaactccatctctacaaaaaatacaaaaattagttgggtgtggtggtgcatgcctgtagtcccagctactcaggtggctgatgtgggaggatcacttgagcccaggaggtcgggcctgcagtgagctttgatcacaccactgcactccagcctgtgcaacaaagaaagacaccttgtctcaaaaaaaaaaaaaaaaagttaaaagttccctactcaaccctcccatccctaattctcacacgtcactacaggcctttgtattgttttttttttattgttgttcttgttcttcaagaatttctttaagtattcaggaatatatagtttttcactgaaaaagtaacattatattgaacatactgttttgtaacttatgtcatttaacaataaaattagggacaatatcagctctcatggaaatcgttcactccttctcagaactttttcctcccttatcgtactgatgtttctctttcttggttctcctcttactctctgacctcttttccagtctcttttgctaccacccttccagttcctctgtgttgtccctgagttctatccttgtctttcttcctcctgcctatccttgctgtcaaagctgctgtcacccatgcaggttttcaggcactgctttatgtgtgacacttctcaaatctcttgctttgaagaaatcctcttttctaaactccaagccgatttccctcactgtgtattggacatcccatagacctcccaaattccgtatgtccatgttaatttatcaaaatttgctcttttccttcctctgttcccttcctgagcaaatgaagtgatgtcattgagtgtgaacactcaacctccaggactctaaccctcttacagttctaagttctcatactttttgaatactgttaggaatttatcccatagaaatgctatagcaggtgggcaaaaatatataaattatacacatgtgtaaatagagttagaaagatacatatgaatatctttcttatctcgtttttcatagtaatgaaaaagttggaaaaaacaccaacagggagttgagtaaaatgaattttcatccatccatccattggagagcaacaaaatcatttagaagaactaagtctggatccaagtaaagactcattagcctgagacaaagttaaaggtactcggtgccgacctgactgtaaatacttcagtagaagtcttgcagtagtgtttggttataaaattatcacccaggtgatccagagtgttcttactatttgaaaaattaatatcaaaataaaaatacaaaaatgaaattctctttttggaaccctaaagtacacaaccagtgacccagattgagaaatatttctttaagctagcaaggacttaagtgttgcttggggaccaggtacctcagcaccttttggagtgcttgttcagaattcagattctcaatctacccccacctcgaaactacagaatgagaactggctggggcatacatctgcacttttaataatcacactgaagcttgagaatttctattgtaaacagatgagctaagcagcccagaccttctaagaaaacttgttggtgagcatgacttagacatatcatgcttttaaattaaagatgctgagggggactcagctgtttctatctctttctgttagagaggtacctgtctgtgccctgggaggcaggcctctgcagcctgctcacccatggcctcctctgtgtatagcagctacagcagcttgaggctggagggctcagccccttgtggcaggggaaaacctgtcttttccttggaggggtgatttgtgggatggctaccaggtggaggtcttctcaaatagaatagattttcatctgtctagcatttatgatgtttgttatcacttttcattattatactagatattacttctgtcctaaaatatttgggagggaaccaaaataagtatgacccatttactttcttctcataattctaaaaaaaaaaagtcattataccctagtcctgtatgtgttcactttcatgagactgtattaatataccgggctataaagattcttggaaagtctctttctttcacaatacaggtgttagattccacttgagctctatgcccctccactgaagctgctgttctttgtcagctttcaacaagatggaccagtaactgctggataaagtgtgactcctgtgttggtatgtgctatgccatggaaatacttagatggagacatcgattttccaccttagagtatttttttttttttttttgagatagggtcttactctgtcactcaggctggagtgcagtggcgcgatctcagctcaccgaaacctccactcccaggttcaagcaattctcctgcttcagcctactgagtagttgggactacaggcatgcaccaccatgcctggctaatttttgtattttttggtagagacagggttttgctgtgttggccaggctggtcttgaactcctggcctcaagtgatctgcctgccttggcctctcaaaatgctggaattactagcgtgagccactgcaaccagcccaccttagactattgaaagcaactaagctacttttatgagactttgcccagtgatagaaggagctcttctggtctaggcaaccctggatgaggctgccagcagccagctgaattcatggcttttctttctgaagctgtcacagagttagcagtgttccaattgcatatcgatctatgttttttttttaaaatggtggcttcactgagtggtggggtttccttctcagccttggatagaattgctgcaaatcttggtggctccagcacttattatttctagggacagttattcttgccacttcaattccaagatgtgtgtaaagatctaaaatggttattgtaccttggtaatacttttaataccaaatctttgggacacaataaaccctcctagtaaatttggtttgggcatgcagtagggcattgatcagctcctgaaatggaatcgagtcaaccttaaacttgcctgtagagggagagctcccaggcagcaaacatttttatgcctccaagaaataatgatcctatttattaataaatggcaatcctaattccctatccaggcttttttctcctctgttcctcacatagatcaacctaacttataataatggagtttggaagacataattcagatacttctaattctcagaggcaacatgaggtcaaggagattctctagtctcaaatactaaccctacttccctctgaagtctgggtgggatcctcatagacatagtttctgcacttctagattctatctttgtgaccccacaaaacactcctgcaatacaaaaatacaatacataaatttcactcaaggttatgccagtcccacctattcatacatccatctttcctttgattcaaccaatatggcataggatgtgcctgacactagcaatgtagtggttaccaaagcagacttgaatccacccctcatggggcttacattctggtggaagagggagtagacattaagaagaaaatcaacagagtgatgtgtaagagactacctggtggtgggtggcacttaggaaggtcagagaaggcctctgagaaggaggaaactgagaagtcaactgtggcaagagctggttaaagcaagttccagacaatataaaatgcaaaggccagagacaggaaagttctagggatattctatacatgggaaacaagttgatgttgctagaatgtggtaggcaaggggaagaatggcaagaaatagaggtggaagattggcagtgcccttccatgcacacatcatggtgctgagcttggtctttcctaagcattctaagaagcctcagaaagatttttaaactagaaagtgacatgacctcctttgcattctttagaggtcacattggctgctgtagggagaaagagttgaaggaggacaagcaagcatggaagcaggaagacaaattaggaagctcttgcaggcatgagatggcaatggcttggagaggtggtagcattggagatgagaggaatggatggatttgagatatgctttggagatggacttaataggacctaccgatgctttggatttgtggtaggggtgactttatccccaatacccctcaaattatatttcagtttttgtcaacacaatgattacaaagagatgcaaaaatatttacaatggggaaaaataccccaaactttgatgctgcttcattagtcattgaactcgtttttttgtgtgtctgcttttggaaaaactcatccatttggattatgatagcactgaaatgatctccctatttgagcactgtatctagcatattttcctggccaagcaacgggtttaatatatttaggtgatggtgatgtttgggtggctgacactggagctggaatggtccaatatggcacttgtggaggttaaataagacccttagtgagataggtagggattatggtcaagcaagttggttatttagagttagatacatgcttgcctagggccaagaaatcacaaaagcttcagaaagtctaaagaacatcccaaatgtgaatcaaaattttactaacaggcaaggaaaagtcagaggctaaagttagagcgaaggcagctttaaagtagatactcaaactggggcttcaagttgaggcaagcacatcactcagtctggttacttcagctcaagactgcagtcggccatggtctctattggtgatttactcagagattcctgagtccgccccgtctctgtaatggcactcctggattttaagtgacctaggttgaaatggtggtcctcttggccaggcaaagcattgatccaggacttttctctttccttgtggaagtgggtgtgaatggcaggaagagcagattaggggctcagtggaactgatcagtttttctagatagtgtttctcaaagggtagttggtagaccatttatatcagaagcagtttgttgaaatacagaattcccgggctcaccccaggatttcctaggaaggggctaatgcatctgcttcattaagtagctccgcagttaattgtaggcagagaacttgagaatcattactctagggactatgtcggggctgatctctcaacgtcctcagagtaatctttggcaggtttttcctccagtaacccaactttttccaaggccagttggattttctgtttgggcttagatgttagtttaaatggttcttgtgggtaagtagaatttaaagtgaaatgtatactgtttacttcgagacttccacctccgtatgggagagtgaaggggagatcatgtaaacacagcctggtcttgccagctcatccaggggatgctacctaacatctctccaccccacaatgccactagaacaaaggccccaacagtatatggtggcgacacagaggagctaaccattcattgtttcagtagtttggggcctcctgggtgagaggagtcctctgggtgatctctgttcatagcctggaaaatttgtagcaggagagggagaggagtggggttgagttgtagtcttccactcacaatcaagagtaaccggcatgactttattacacaagatcaaacatttcactaccactaatagtaatccagttcaaagttgcatattctggtaaatataacattctggcttaactcttcccttctggcaggcacttcattttcttacaactcttggctgagcactgaaatcttgggagatttatctgcctacaaagcacttgcaaaagcagagtatgtgccccaaaacctaattctttcacttccaaattcactcttgtttacctctccctaacatctctaggagctcagtttgattctacttctgaaaacgcaaagaaaatcaagtaaagcagaaagatgcttttgtattgattatccccactcactgttaatgtctattgccatccagtggttgccatgaaaatattcaacctctacttctttttttttttttttttgtttgtttgtttgtttgttgagatggagtctcgctctgttgcccaggctggagtgtagtggcatgatctcagctcacttcaagctccgcctcctgggttcacgccattctcctgcctcagcctcccgagtagctgggactacaggcgtccaccaccacgcctggctaatttttttttttttttgtatttttttagtagggatgggatttcaccgtgttagccaggatagtcttgatctcctgacctcgtgatccacccgctttggcctcccaaagtgctgggattacaggtcaacctctacttcttctcactcacaccaccacaatttgaactttacaataagatttcttggattatgatataagaagatatgtctttaaatgaatttacaatgttcacatcgctgtactgtttctgtggtgattgattatttaaattaccctccgaattttccttgaaacaagcacaaagacagagttccaaaaaatatttccaaatgggtaacttagttttcagcagaattagttgtaaggctagaccatttggcctctaccaaaacataaaatataataccatgtagaatttatgaactgtgctttcctactaattggagttttgggtcaacatcttcatttcaaattgaagtcaagggttgaggtacagtttgttgttctagattatttctcatgggtagaagaaccaggatttaaaataagatctactcattttcagccagtgtctttttccaactaaattgatttccaggtaattggcctgcttacaagcaaagctaaatgttctctatggcaagttgctttagaatttggagatttaagatttaatatcaaaaatgtatatagatgtaaatagttttataatgctatataatataggcagctagttcaagtgttagcatggtctgtaagccggaaattcagtccaatcacttggaaagcatgtaattattttctttagcttagccaatttatacttgaatcttttttacatagaatcatggttttcttaaatgttgaaaataaagaaaatcataaataaatgattctagaaagtttggatataagtaaaatagtctaattgtcaatttgttccttttattttcttccttctctctttgttaggtccacatttttttttttttttgagatggagtctcactctgttgcccaggctggagtgcagtggtgcgatgtcggctcactgcaacctccaccacccaggttcaagcaattctcttgcctcagcctcccaagtagctaggattacaggtgcccaccaccatgcctggctaatttttgtattattagtagagatggggtttcaccattttggccaggctggtctcgaactcctgacctcaagtgatccacctgcctctgcctcccaaagtgctgggattacaggcgtgagccacagcacccagcctaaggtccagatttgtaatgccctttcttagtcctctgaaaacagaatcctgaaatttggagaagtttttatatatttcaccaagacatgctatagttctaaagccaaaaatcttggctttgaatgatttataagtcctgttatgatttacattttagttcttatggagacatcttttcctcagggcccactactctggctaaaaacataaagggacttgttgatgaggaaagtctcagagccaaacctagagcctgagggcaaagttctctgagaaagagacacttttgaggttccagccttactgttcctctgtcaaattggaactgatttgcctctgggatgagacataaggtcattcacctgaactattaagttttgtctctcccactgtatatatttgcccctgtagtttatatcagtagtccccaacccttttggtaccagggacaagtttcatggaagacagtttttccatgggaaggtgggagggtgggatggtttcaggatgaaactgttccacctcaaagcatcaggcattagagtctcataaggagcatacagcctagatcccttgcttgtgcagtttacaataaggttcacgctcctatgagaatctaatctcctagtgtcactgctgattggacaggaggtagagctcaggaagaaatgctcactcacctgccgctcccctcctgctgtgtggcccagttcctaacagaccacggaccagtaccagtctgcggccaggggtttggggacctgctagtttatatgatgcccatgttgtaatgggtagaggtgggtaactttccatcaaattgatacttgctcttctgtagcgtagtccttcttgggaagtggctctcagtcacggactgtatttcccaacctccttgcagccaggtgaagctctgagtctaattcttaccaatagaatgtgagtggagatgatatgggttacatctgggaagatgggtgagatgcagttgtgccttttcctccttcaaggctctagaccaaggggatggcaaaggagaaggaacctgggctcctatatgactacctggtggaaagctacctgctaatgaacactcacactcatctattaaattagcaacaacaacaaaaaattccttccatgttaagccactgaaatgttggggttatttattactgtagccagcattattctaatgggataacccatgatgtaatataaaattgagaaagaagatctatagttagaatgtatgttgtggcacatgtcccataataaaattagtctattttttttttttttttttagacggagtctcactctgtcacttaggctggaggcaatggcacaatctcggctaactgcaacttctgcctcctgggttcaagcaattctcctgcctcagcatcccaagtatcagggattacaggcgcctgccaccatgcctggccaattttttttatttttagtagagacagagtttcactatgttggccaggctggcctggaactcctgacctcgtgatctgcctgcctcggcctcccaaggtgctgggattacaggcgtgacccaccgcacccggcctattagtctaatttttataagcataattttataggtcttgcttcttctctgttcctttcccctttatactgtcctttgctggtactgtcctttgctcaactgctggaattactggtatggtaattctgagcaaattttaaaaagacagttctgtcttcaagatgttttattgcttcttcctgaaatgttgtcattaaaaactatacaaatcttgtataaccacaaggtgagtagctggcactctctaaaagctaggagacacctaggaaaactgaagtccctgtctagggctagactagcaaacttgggaaatcactgattctctctgaattgggcgaagcagtgagctgcctgagggtaagacatgcttgtgactttttgcagtattttccttagtccaaggacccattctcagcagtaagtgttctgaagcttgtctgagtctggtcgaaaccagaatgccaagttatgagttacactggaaatgtatgaggggaacttcatcctagtggggagctcagctcattattgcctggagcaaaaagagtagattgttctcatcggaaatttccatcatgctttggcatcctgtgaaactgttctgttttcaaaggactgggaatccgcaactagaatcacagcagctgctcccaaccccatgcctgaggtcctttcccccaccagtggccccttgtctagattccctccctcaagacaccgtatcgttttgattgcacatccccttttcactgcgttaaagaatcgtgcgccaattggatctgggtcttaccttctccacttactactagctatgtgactctggacaagttaacctgtctgcatttcgatttttttgtctgttcaaaggagataatagtacctacatcactggattcttgggatgattatttgagataatttaggtaaagtgcttatcctctaatgttgttgctatttaaatatttattttaataataattatacaatgagatggggctttgggagaatctaatacagttactcatttttttttttttttttgagatggagtttcactcttgtcacccaggctggagtgcaatgggagtgatttcagctcactgtaacctccacctcccaggttcaagcagttctcctgccttagcctcccaagtagctgggattacaggcatgccccaccacacccagctaattttgtatttttagtagagacagggtttcaccatgttgcccaggctggtctcaaactcctgacctcaggtgatcagcctacctgagtgctgggattataggtgtgagccaccacgcccggcctaattacttatttaatgcaggaatactttctgcaacatactgtttcataacatttcagttagtaagtttgcaagttttcttcctatgtcacagtttgattgactgctttccaacaatttatcggaagttgaattgatctcactaataagctctttccaaagtatattgtgggacaggttgcctctcgggaggtttcctaaagccagctgacccaatttgtcattttctgttgactgtagttttcaataaatatatgcttagttcctcacccataatatctcagaatataatatgtggatataacatctgtagatcagtattttctagtatgccccagctgatttaaaatgtccagccagggttggataccacttagctctatctgctgtatatagatttttgttatctttaggcctatgtattgtggggctccctccacaatcctcccttagcctcaggtgtgtgccttactcttttgactctgttaggccatactacagtaacaaacctcaaaatttcaatggcttagctcaacaaacatgtatttctggctttcaactattgctatttggtggaggctttcctttattcagctacaaagggatccaagctccctttcttctgtgccagttgaatatcaacatatggcttctcaggttgccatgccagaggaagaaagagctgacaccagctcttaaaagcctcccctggaaatgatacatgtcacttttgcctatggctcgtaggccagaatttgtcacatgactctatgcatcttgatgcatggagcgcactggaaatttgatgaggtccctatcatggacctgtttcacaatgatctcttgtcttagatcttcaaagcacttatcatcacccagtacttgatgtatgccttcctttatttgtttattgcctatctctcccaagtagacgttaagctttttgagatcacaggcttttgttcactgctgtatctctagtgcttacagtgatgcctagtgagtagtggggtcttaataaacatttaataaataagtgaatggcaactccatacacaaaggtgaagccactgaaatctgttgtgggattttattttatgtcaatgtgctttatagcttgtgttctttttcaaaagcacatttaaatgttattgagtccaaagagaagttaaagaataataggctaattaagaagagaacattatatgtggatctcctactattactcacgaagagcatttatctctcagttgttcattcctggagtgatcaccccaggaaagggcaaatgtagtcagcagagaaggatgctttctgaggttcagctgacataggcaataaaagacttgagttggcaaagcagaaggtgatatcactgtgggcctgtgttcagccttttctttgctgagctgagcctatcgaatttgcacaagaccagtctgttgaaactttataacccccataaaatggaaaaccttctgcaatgaatgcttcttctcattttgaatactgcagaacccaattaaaaacaaggtttgttattaaggctggtctagagacaggcagtattatgttatgattaaggcatgaactctagaataagaaagatttgggtttgaacctgagtccaacacttacctccctgaaacctcccaagcctcatctataaaatgtaatgaatatttcctacttgctagaattgtaatgaaatttaaattgaataatgcttttaaggtggttaggttggtagaagaaatggcactttggaaatgacagcaattatcacattctataattggattgtttttctgtactagatatggcagtatacccaggttacagtcagtggtggggcttactcagggagatgagagaatgtgaggccactcagatgggctgtcctttgtggatcagcccccgacctgaggcttccaaagctgcctttctggtgggcctgtagtgcatggccatggcaggcctgctttgcccctgagctcagttggcagcccacctcctttggtgcactcagcatctttgttccccagcatgggctgctttttcaccatccagtgtgaagctcacctgtcacagcccacctcaaggacattattccccccatgctcaacatttagctcaagcctccaattctggtcctttcagctgtggccaggttagcaggatcgattcacagaaagaaccatttggggaacttctctttaaaagggactgaatttatgtcaagcttggaatgctgcagactcctctcctctattttttaaagtgaaactttacatgcaaagaagtttcagccctggctgggaacagtggctcatgcctgtaatcccaacactttgggagacccagccaggtgtttgagaccagccttagcaacatgacaaaaccccatctttacaaaaaaaagatacaaaaattggccaggtatggtggtgcacgcctgtactcccaaattctcagaaggctaaggtgagaggatcacttgagcctgggagggtaaggcttcagtgagctgagatcgtgccactgcactccagcctgggcaacagagtgacagtctgtcaaaaaaaaaaaaaaaagaaagaaagagggagaggagaggagaggaggaaagaaaaaggaacgaaggaaggaaggaagggagggagggagggaaataaaattaaaaaggaaggtgttcagccctatggttattttttatgggaagctaactttgaacaatgagaaaatttaggaatatttgaagtagtatttgggggtgaggttcagttatgttcttcccgtgataaacatggaattgcctctttagagtagatagacaaatccctcttacataaaatgcttcagatgactgccatttctcttaaaaagctctcccatttttgttatatgctttcaattatctgaactgggaagtaagctttggtgtacttctaattcagggcaattttttgtctgcctggacccccataggcaggcggactggcaccacaaggcagggggcaagattctccttataaggaggtttcttgtaacaacttgtttgtttggtgcattgtgcttcatctattttatccaccattgacgtgctttctaaagtagttgtgcatccgctcactctagaaatccatacaatgtatttcacaagtactaagaactgtcatccataaaatagaatatattttaattatcctttaaagaagacaaggtaaggttgtcccttcaaatacctaactctcatctgtgatttgaaatgagtattcatagctccattttttgagacattttaaatagattattatgcaaagatgcataccttgagcaaacaaaatagtattatgaactttcatatatagataaacaaaatttaacaattattatcattttgtcatatttgttttgtctacttttgggaaaagcattttaaaattaagtcacagccaccaagacatttcacccctacaagcttcagtgtacatctctaaaaataggacattttcttatataactagttaggctcattattacatctaacaaaacaaatacttaacatcatctaatgcctagttcatatgcagattctcccaagaatcctccaaatgtttttcccccttcagttggttagttttaattagccaatgagcaaaaatctctcaacttctattttccactacattaactataataagaatatggagcagtagaaagttctctcagtctgtatagtatgcgatgatcagatggattttcttttttcccaatattttcttatgaaattcctcaaacatatagaatagttgatagaattcttcagtgcatccctgtttccatggttctatttttaattctcttcctgacttcttagtaactgggacttgatagtctctacccctcagattcagtgagaaagtaaataagcattccgtggctcctttttagggggaagccttaaataatatttgcaaagcagatggatgtcatttctttgcatggcttacaaaccttgggagtgtcttctcaactgggtagctcatgccagtctataaatattattgagcctgactttcagttgacaatactttactggggcatccccagagagccaggtgctgacctgttgccagtggaatcaccgtgtgagttaagagagaaaatgatgagccacgctgtctaacactgaagcaattggaacaagctgtgtgtttacaccttatgcaatgtcagctgtatttcaacattatctgaaaatatcatgcaaaggtatttggaaaggagaaaaacaaatctggtttttaaaaatgtctgtctgagggttgctgctgttgctatggaaatcagagaagcagactttcacgctttaccacaccgagcttgtttttgaacagattcctgagactgtgggcttccccccacctcctattctgagtggttttgttagatataaccttgcttgaataatattaacatattcctgtgggaaagcacattaggtgctaatgcttggagttgtttttaacgaatgatttaacaataccggattcatttttcatctgtatgtttttaaatagactggctcctataaacagcgttaacatacagctcagcttggagcataaggaaatgttagtttaatattttagtgccatctgctgtaagtttcatggcattctaccccatctggcttacttgcagcaattccctatctttttttagtttcagtagaacacagcaatctcttttcaaatctttcatactgattgggtcctgtttcttcctactgaatactggatgaggctgttgtcagaatgtctccttgattgtaggtgttcatttcctgaagacttctgtttcagtgcatgtgtgtgtttgtgtgtatgtatttgtgtgtgtgtgtgtgtgtgtgtgtgtgtgtgtgtaaaagagagagacagagggaaagagagagagagagagaattatcaagcagttaactccttcctagacctctcttccttatttcaaatgatgctgactcttggtgagtgaacatttgtaaattcagcaccattgctatatcaacaactattgagaacccattgcatgccaggctcttttctaggcactaggggagagagtggagaacaaagcagacttcctgctctcatggagtttcattagtggaagagactaatagtatacaaataaacacacatcatatagtatcaggcattggcaagtgctgtgaattcaaaaataaagcaggctaaagaaagctattttaaatacgatggtcaaagaaggcctgatagatgatagaattagaatattggaatggacatgttaaggttgctacaagggcaacaaatgtgccctctaaccctgtgccttgaggctcttgttaaagatagacccttgtcattagctaattaattatgtttcaacattaaccatgaacattatatggatgaaaaacaaatctgctctttaaaagccatcagagtttttgttgttgctttggagctagatggaccttgggcttaagtcagcttgttcttcagttctcagttcttcagaattcagcagttcttcagttcagcacatggttagaacacctgtatgtgtctgattcttagttaagttccttggagagtaacaaagaaacttttctccaggagttgcttttaactgtatgctttaccaaccctcaacccatcaaggggattgaataatacatatagaatatttaaagaataacaccagatactattatgtttgacttcagctacaaatcctgtcaatcctaagtgctattggatttcagaggagggagaagtgttaagatgtccagcgcccttctctttacctaagctctttaaaggtcagtttgagcagaacattgagcatcacggagattactaatattcctttcattagaaacaaagagattctgaggtcaggtaattagaatcatgaacaacccatgtgaattcttctgtgtttatgtgtctgtgtttgctcacacgtgtgcacacactcacatgtgcacatgttccatacattcattcaggaatcaaatattaggcaactactgcatgtgagttactggtctgtgactggagaagtgtagggagaactttcccctctgaaggttcaagtcattaagtctgttgaaataaactgacaacagacagattaacaggagaaaaggcattacaggtgttcatgggagccacacaaaatatgaaactcaaaaaagggtcagatggctgatgcttaaatattcttttcctaggggagatgtaaagtgagggatgtaggcaatttcagaggaagactaaatggtttttaggggattttagtggccccagagaagagacaatagcctgggacacggttcttctggcctctgggagaggtgatgacaagttatgggaatgtgaggggcagaatgatactgcaaacaaagtttgtcttatgcaggtaaagaagaatagttgagagaataggtgaaatgtctgtcgggtgtggtgtcatgagcatggagacttcctctcctgctttatgagttaatcttctctgcccagtgtagattcaatggaggaagtccacaacaattgcattccttctggatgaacttcccttagtcaggtaagagaatttcagagagagccgctttctgtgccttggaaggaaaagctgggggtgaacggggaggcaggagaaggtcagagagagactttggctctgaggcctttcagcctcctttgttcaaagcactcagcatgccaaacggccatattttggggtatcattttctgagccccaacagaagctaatatgagtaagacacagtgcttgcctgcaaggtatttgtagggacatatatacaaacaaataggtgtaataaagtgttataagggcaatgaaagcaagcaatgcttaacccagccttgtctgtgttaatgattgatgttgagatgtttgagatgtatgactcttctaatttttctatgcctgttttctcatatcttcaaaaaatctgggacagggagaaacattagcaaaataatgactcttagccttcttactttagggagaaaggttgagttgtcctaaagtaatcacagtatttgttttggcttactgggacgtgaggcacataaaaagaatcattgctttaatagcttgagtatcattatcagatgctgtagtgatagctagtacaccagtgggagagaagcaagtagtaagtgcatttcctccttgttttcctgtttacacagtgtacttggagttactggataactttagagactcattagccctctgtacaattaaacgtaaatgcccatcttagtagaggctgatcataatgtagctgcaaagttggggtagggggtagagggacagataactatatgaactcctaagtacgcatagacttccgtgtgcttgttcctgggagcctgtggcagcctgcatggaagcaaaagtaaaattgagtttgggaatagggggaggttgttgaatgtcttatttcacctctaccctcaaaagtgctttcgataaggtgcttctaggcacaaaggaaagatttaaatccgccatatttcccttattatatataaactttttatccagttgagcaccacttttcagagctaggaaaatatttttgggctaactaaaagctgtaaaagctgctttttgcttagtgtttataatgatgatccagctctctgattacccatttctcccttcccccaacccagtatgttcagttggcatcaaaatgatacgtctatggtctgtggcaccacctttgggagaggtgggttttcttcctgatcacagtgtccgggaatcagctgcagcacaagtccaattccagtaccagcactggctcccccaagatgctttcactgccattttcgtacccttctctcctctctgctctctcagtgactggcaatttgattgtttctccaatttccttttacttctgtctgcacagcacaatgctgaattcagaaaatgagaactcagccatcactttattctgatgtagggacaccctgtcaatggaaatgtggactagtgtgtaggttctagtgactctgggcctttgaagctccaaaagcttgctatttttggtgccagcaggttttcagagctctgagaatttctgtttccccttcccctgatggcagaccatattgcatctactgctctttcactccatcctcacaaagacataaggagaagtttgccaagggggaacatcgttcaatattgaatgggatttctgagcaatgttgcataatcttcttagtcaatttttgaacctagcagagatttgactattcgtggcggtgagggggcggggttgttcttgaagggactagaattaaaattcttatgctgggactgcaagtccctggagggcctgaaattgtgcaaatatttgcaggagcattttgctagaccaagatcgtaactttcatcagactctcagtgggatctgtgactctaaaaataggtttaagtttaaaaggggaagagaaaacactcaacttgataatttcaagagctccatgctgctgaaaaacctgaatctgtgatttcctgcaatattatcatccttcccctcagaaggaagaaaaatacaatataatcacctttgtttttccaggagcttcaaactgtggaatcacattgctgatgagtaggcctcagcctggaacactcctgttcactgtataatatctgactgagcagtgtgccattttaaataatggtcatatgagtgttggctaacaaccaaaatttcagttacatcattccatatagatagatagatagctggtttacttatataacaaatatttgttgttacatcttatacatcaggcactgtttgaggcacttgagatacttcagtgaacaaaatgaagatttgtgctctcacggaacttacgttcttgtagggggagaaagacaagaacaataaacataatgtgttagtccgtttttgcattgctacaaagaaatacctgaagctgggtaatttataaagaaaagaggttttattgactcatggttctgcaggctttgcaggaagcatagtgctggcatgtcattctggtgaggcctcaggaagcttccaatcagaagatgaaggacggcagccatgtcaaatggcaagagtgagagcaagagagtgagatgggaggtgccacactcttttaaacaatcagatctcatgtgaactcagagtgagaactcattgatcactaaggggatagtgctaaaccattcatgaaggttgtccccatgatccaatcacctcccaccctgggctccacctccaacattgggaatcacatttcaacatgagatttggaggtgacaaatacccaaacgatatcatataatatatatgcaaattatatagtatgctagaaagtggtaagactctggggaggaaaagaaaaagtagaaagagttagagggattgagaatgtgatggagggaggggcaggtcactatactatatcaggtggtcaagggagagagaactcattgaagaaggtgagagtggagcaaagatttaaggaaggcaaagaacttaggtaagcagctatggggtggaagagcagcctaggaggaagaaacaactgcagtaaaggccctaaagcaggagttgtctgatgtgttcacagaaccgcaaggaagccagggtggctggaagggagagtcattggaaaggaggtcagcaaagcaaggggaggcagaccacaggcctcatgactctcactggagtgcaatgggacccccatggggtgaaagcagaggagtgagctgctctgatgtgagcactcactctgcttgccatatagtgagtagacaggagagaccagggcagaagtaagaagacccatcagaggctcttcaggaacccgagtgggagatggtggtggaacagggttgtagtagtggcagtagtgaaaaaatgatcaggttttggaaatatttggaaggtagaactcacaagatttcctgatcaactggctgtggggcaggagaagaaacagcgatgactccacagttttgggtttcagcagccctagagaatggatgggtaaaagccttgcaactgaatgaaatcacaagggaatgggtgcagtagtaaagacaaccaagggctggcaattaaactttatatatcaaaatgtattaaaatggactttaaaagttgtagccaaataagcaatcataagatgagtagcttatgaaaacatttatcttcagttatttagaacagatgtagatcataagtaagttttgaagaggaagcaaccttgacatattgtacagtgtattcacagggagtcctgcttgcacagactttccagtgcacggcagcactctgggaaggcaattaaaggcccttatttaattattgattaatcaatgcttcatctaaaagcatttttattaatataaactccattgttaattattttctaaaatatgttaatattcttatctaagcaaaacttaaaaaattgtgttgttggtgacaagatttacaggagcctcaggatctcaattctggatataattttttttgtaaaaggcgaattttgttttacctgaaagcagttttagagaacatttactccaattcagtaattttacagttagggtaagtgaggcacagataactacgtaagaatctgaaacaggagtcagcaaactatatccaatttgtgttcgttcatttgtttttatacagctttattgagatatagtcacataccataaaattcacccttttaaagtgtacaattcagtaccttcacagagttgtgcaaccatcactactatctagcttcaaaaaatttcatcaccccaaaaagaaaccccatgcccctcaatgttcattcccccttccctctttcccacagtccctggcaaccacgaatctattttctatttctatagatttgcctattatagacacagtttaaatttcctgttaatggaattatatgatgtgtggccttttgtgtttggcttctttcacttagcataatataatattttcagggttcatccatgttatagcatgtatcagtacttccttcctttttatggcaaaatagtattccattgtatggatataccacatttgatttatccactcatcatttggtggacatttgagttgtttccgttgccagctattaggaataatgctgctatgaccattcatgtacaggtttttgtgaggacacatgctctcagttatcttgggtatatagctaagagtgaacttgctggataataagataactctatgtttaacattttgagaagctaccaaattgttttccaaggtggctgcaccattttacaatctcagtagcaatgtgtgagaattccaatttctccacatcctcacactttttaattttagccattctggtggttttgatttgcattttaatgatgactaatagtgttgagcatctttttatgtgcttatcagccattggtcttctttgcagaaatgtttattcaaatgatttgtccatttttacattaggcggattttctttttactgttgaactaaagagttatttgtatgttctaggtacattctccttatcagatacatgatttgcaaatattttatcttgttctgtggattgtgttttcactttcttgatggtgtcctttgataaataaaagtttttaatttttatgaagttacatttatctatttttattttgctgcttctcttttggtgtcacatcaaagaaaccagtaccacctaatacaagttaaccaagattcatttgtttgttttcatctaagagttttaaagttttagttctttcatttaggtctttgattcattttgagttaatttttgtatgtggtatgagatagaagctcaacttttgcatatagatatccagttgtctcagtactgtttgttaaaaaggctgttcttttcccaatatattgtcttgtcaccctggccaaaaataaattgaccgtaaatgtaagtgtctgtgtctagacaattaattttgttgtattgatttattgtctagacttatgctagtatcatattatcttgactattgtagctttgtagtaagtgaaatctggaagtgcaagtcctccaattttgttcttctttctcaatattgttttgactattctgggtcacttttatttccatatgaattttagaaatagcttgtcagtgtctgaaagacacttagcttgtaccttgataggaactgcattgaatctgtagtttgaggagtactgccatcttaacaatattgccttccaattcatgaacataagaaatcttttcatttatttaggccctatttaatttatttcaacaacatgttgtagttgtcattgtacaagtcttgcacttttaaaataaatttattcctgattattttattatttttgatgctgtcatgccaccacctgtttttttaaaataaaattttatcagaatgaagccatattcattttctcacatattttctttggcttattttgtgctacaagggtagagttgagtaggtgctattgagaccatatggccaacaaagctgaaaaatgtttactgtttggcccttgacagaaagagtttgctgatctctggtctagaacataatttgttggcaggaaaagctgattcttttctttttcttccttagagatgctgtgtggtaagatggaagaagaatcagtgttagtatacttgatgttgagagatataaataagattggatggcttgagttttggagtaagtgagacctaggttcaaactctggatcatcgctttctatttgatctctctgaaattctgtttcgcctccttgaaattttagtttccttttcttatgagggaagaaagtgacttgttattgtcatatgtaacagccaatggcagaactggcctcaaacttctcctttttgtccattgtcatctccattgcttgacagttaaatctctggccaagagctacattctaaatattgctacttccccatcctccacactaaattcttaacatcaacttgttacaagctgtgtctttattatgccatttgtttatacaatttttttcataaaaatgtaagtgcagaaaaatatgttactcaatattagatggaacaagttttgttttgtttcttttcctcttatgaaaaagataagtgatttcatttcctagtaaaggtattctagtttgactcataaatttgcaggacacattcttttctttattaacttttgtttttattttattttattttttatttttttatttccataggttgttggggaacaggtggtatttgattatgtaagcactttagcagtgatttgtgagattatggtgcacccatcactcgagcagtataccctgcgctcaaaggataaaagacacattcatattaaccatgatgatatagaaaagtgcagcagtttcagccaccaaaattatgtttccagcaacatctattttgttgatatagatgacaacaagcttccagctggaacagattcaaatgggtttcctcttgctcaatatttgaatctactccagaaaatgatggctagactaaaaggaatcaaaatatgactcagcaactccagttgtataggtaaaatgcagactgccaattacaactaaaagttcagaaatgctttagaagtgtaaccttgtagtgaatttatctggcacataaacattaagtctagtgcttacaggaagatagaattgtttttcaggcacatttttagcttgattcttaatgccttaggtattagtccatttttgcgctgctgataaagacatacctgagactgggcagtttacaaaagacaaatgtttacttggacttacagttccacgtggctggggaaacctcacaatcatggcagaatgcaaggaagagcaagtcacgtcttacatggatggcagcaggcaaagagagagagcttgtgaaggggaactcctctttttaaaaccaacagatctcatgagacttattcactagcaagagcacaggaaagacttgcccccacaattcaattacctcccaccatgtccctcccacaacacgtgggagttcaagatgagatttgggtgaggacacagccaaactatatcaccttatttttaaaattagctattgtaatctattgaaaaatggcaggcagctatgactatttgttccttcccattgaacataatattagaaaagatcaagtgttgattatgatgttacctatttgtagaaaccaaggaatcaccatttatttttaaactaactgtacaaaaggttcagagtcaaagaatttctgggttggagggaaccagtattttaaaaatcttatgaacattctcagtacagagaactcaccaccttccaaactgactttccatccttagaaagttctgacagtaagaaatttatctcatattgatgttacttatccactaatcatgttgtatcatgcagggccataaaataaaaagatcactttcatattaaccttgagtcttcacttttccagacactacattaccattgttgtttatcatcacagagtgcttttaagtccatttatccccttttttgggccatctacctcctccaacccgcttttctaaatgttttgctcctaaacagtacatctttttgagaagtatgtgagttggatagtgtggtttacagcaagagcatgacttccctcactgtgcacacccaatttctactgattcaacctgaagacacatcacctgtttgtcagccacatcacgctgttgacttgtgttaagcttacatcatctaatacccataagtctttatttattaatgtgctaggaataagctatatatttttctatttcacattattatggttggcactttgggtggaagtactaggccttgcattttgtctccattaaattttatattgttaggctaaccctatttttcttgaaatatttgggaggattctatcattcaatgcttttactatccctgttgcattatctttagtatgattactcacttcctacatatcagtgatgacagatttgagagctcaaatcctttaatgggccactgaaacttctctctagatttaaattcaattctgtaaacatatattcagtatttactttataatggactgtacttagttcagtgatgaacaggatatggtggtagtctcaagcacatcatcactctacagtgggagaaagacatccagaaataaccatggtataaaatattaagtataataacaaagttgtgaacaaggaacacaaaggagaggccagtaattatctgggagaagtgaatgatgcataccaaaatgagggatatttgagccaagttttgaaagagaaggagatgtttgtgagaagtacaagaaaagagtctgattgccattcattaatcagcatttattcataggaaaatgaaatgttatcttcctgatagttcttccctgaagagacaagtggacaaaaaaaaatgagactctagaagggtgaataacataagccaatcaaaaataactcaggagtatgtagtggctagttgacaatgccactgcaatcacattatttcagaatggctgactacatttaaaatattttctagatcttgtgattcttgttttttttcccccctatgagagcagttaggaagctcttactaatgtttcttaaatttggagtttagggaccaagaataggaaattctgaaaaattgtttcctatcctatttacctgaatctgctttgtaagagactcctctatcttggaagcataacttctgtccaggttagatccatcaacagctaggttacagcagcttccagcttcttcaatcagtatttgggacctgggagtcacagtggactccacaccttggtagaaatttagaagtatgttgctgacaacaatggatttgtcccccagcctgccagccctgcccttgggatccattcatgcagctgtagtaaatagcattttccatgtagtatctctgcaaggacaatcaattcagcaacagactttctcctttaaaaaatgaaaaaaaaaaaaaagtaattaaaatcctctatcttctcacaacaaagacctgagaatataaaagtacttcttcatttattgggttatgctactgaccttttaagcggtgtcttagctctgaggatgatgagtgacttgggcattaaacaatctgaagacaccaaggtaattatgctgtgggccaagtcattcatttagttgagagtgttcctgccatttagcaatgagcctgcagcttttaaaagcaaggtcatttgacctgctgcctcagcataaaggtacatgaccttgtctgctgccaggcaggtaaatgcaagtattaaattgcctttacaatagagaggtttaagacttagctggctgttggaaacttagccgaatagttgctctgacttcaacaaagtcacctgctaaatctgtctaaatctccagggaagtcacgaataaaatgagggccctaaaaacataaaattttcaaaactacgtattttatatatataaaaaaactacatgcatataaaaatatttggggccaaatcaacatatcatttgaatatttttctatagtgtttacagactacagtatataaagtgttataatctttctgatatgtgtgtgtatcatatatgtatgtatatgtatatataaatataatatcaatatatagcaaaatcgtgctgatataatcaaaggtagatttagggattaataaagtcagataatatttattggaaaaataaagatttatccttattttatatagataaaagagatggtaatgttttgtcacctattaagtcagggaattcttcagctttttctagtttgtaacaaataaatcccagatctgaggggctacaatgagaagtagtctttcttctgtacaatacatcagggtttggttctgctgaagtcttttgggctctgctcagcttggcttagctccatgcatgttttcgttttggaacccaggctaaaggagcagcccctgtctaggacatgctgtcctgatacaaggatggcacaaaacggccctagctaagccacacagtcacgtttaggcttctgctcaaatgtggtaagtgaacatcgtgttccctcacatcccattagccaaagcctgtgccatagccaagcccaaagccagtggatgagtaagcaggatgaaggttgtatagttgtttgttcacatcctcaccctcctttctatcactttcttatcataagcctagggagtggtaaagagaacgttcttctgaatggaaagctctgggattatggtctgagcttgactttccctcctgcccaccacctcactacctaccaccctcaccccatcactcaaccgtggcaccaagtgcccttgcctctctgggaacctttctccaccctgaaggaggatagaatactctgagaagctggtattgctgtttttctgtctccagtgacctacttcaaggaaatacagggaaaagaatactaagaagccccatgccgtctgtcctttgtctgtggctgcccacttttcctacacagggcagcagtttgctgtccacactggaacccaaccactctctcttgaagggtttcccagtttatatgtgagtttctgagatctgtcagcctcctttttctttctgtggcttctctagggttgggtttggggaggaaacaagtagctagtgtaaactccttgtcaaactactttgtgaagctactttgagttgtataaccagttatttccacatcctaaggataaattgatccataatattggaaacttagcaacaaattttgaatggcacagaaggtataagaatataacagaaattttcttttcaacctgagctgtgaggctctaagacaccatatagcatttttctcagttttgtaattgatgtgctttaatgtttttgcaccgtgcaaattttcagaattatttccagaagcctgcaattcatgtttcttgaaaacgatatttaattatgctttgttatataaaatatattgtgataaatctctgattctcagaaaaagtgccatgtatgtgtaagtgcatacacacacttacgtatgtgatttcttccctccattcttagagtgtttgtcaattatttatgcccattgggaacagttctccccctcttcccacatgcctagaactatgactctccttacttccagatgggtaatctgatgcttttaattattacactagcattactttcactaagagtttatcatgaatcaatattttattgaagttaaaaaaatcctgatttagaaaacaaagtcatgaatgaccaactggggaataagagctgagtgatgaaatgcctggctaaagaaggaaaaggcgatgaagaccctttgctgaaaggtggtatttagcattaaagtaagatttcagaacccaaatggaacattttttcagatacatctcctttaaaccaaattgaggttgaggtgaagggaactaaaaaactcagcctggttctgagcaggttctgagtccagcagaaaactcatcttcagatgtgctgccgtggagcagcaggctcacttcctattttagctaaacacattcatccattgtggcatagaccagcctttggattctcagggattcttgtactgggcacattttttctgtagcaacattgtctcaaacatgataagacaaaactcagccacaaggagaaaactttggacagcagcattcatattgaattggacttggagtccagattaatagcataccttgtacaaaaaagtaaaaaccaggaaggaacaaaataatggcattcacagtgacctggatggaagtggagaccattattctaagtgaagtaacttgggaatggaaaaccaaacattgtatattctcacttataagtgggagctaagctatgaggatgcaaaggcataagaatgatacagtggactttggggtctgataggacggtgagggtgggaaggggtgagggataaaagactacaaattgagggtacagtgtgtactgcttgggtgatgggtgcaccaaaatctcagaagttaccactaaatatcttattcatgtaaccaaacaccacctgttcccccaaaacctatggaaataaaaaaacacaaataaaaaagtaaaaaccaggaggcttattagattaaatgaacatagaaatgtctgcttatattatagcaaatgctgcaaaagataaattgtgcaaaaagttatctttgtttttaaccaatactgtcttctcaatttgggtggctataataaaataccatagactgggtggcttacaaacaactgaaatttatttctcacagctctggaagctgtaagtccaagatcaagagcagacggagaaagccagctctcatgtgtcttttataaggggactaagcccattcatgtggcctccattttcatgacctaatatatcccaaaggccccacctcctaatatcgtcacgatggggttaagatttccacctaaaaattaggagaggggagtggtggcaaatattcagctggtagcaaatacctaattattaaaggtggtggctcattacttcttcatatggctagccagctatcccagcacctcttaatgaatagggagtcctttttccattgcttatttttgcctttttagtagaataatttattttctatttaagatatatcaaccttgttgaatatcagatggctgtaggtgtgcagttttatttctgggttctttattctgttccattgttatatatgtctatttttgtgccagtaccatgctgttttggttactatagccttacagtatagtttgaagttgggcaatataatgcttccagctttattctttttgcttaggattgcattggctcttcaggctctttttggttccatatgaattttagaatcattttttctggatctatgaaagatgtcattggtagctcctaggaataccattgaatctatagactgctttgggcagtatggccattttgatgatattgattcttccaatccatgagcatgaaatacttttccattttttaatgtcatctataatttctttcagcagtgttttgcagttctccttgtggagatctttcacctttttggttagatgtgttcctaggtattttaattttttgaagcaattcttgatttggctctcagcttgaatgttattgatgtatagaaatgctactgatttttgtacatggaatttgtatcctgaaactttactgaagtcatttatcagttccagaagtcttttggcagagtctttagggttttctaggtatggaatcatattgtctacaaagagagatagttcgacttcctttttcctgtttgaatgtcttttatttctttcttttgtctgtttgctctggctagtacttccagtactatattggagtggtgagaatgggcatccttttcttgttccagttctcaggggtaatgcttccagcttttgcctgttcaatatgatgttggctgtgtgtttgtcagagatggccctttttattttgaggtatgttcctttgatgcttctagttttttgagagtttttatcataaagcaatgttggattttatccaaagctttttctgtgtctattgagatgattagatggtttttgtttttaattctgtttatgtagtgaatcatatttattaatgcacatatgttaaatcaacccagtgtcccaggaataaagcccacttgattttggtgaattaattttttgatgacctgctgggtttgatttgctattattttgctgaggatttttgcatctatgtttatcagtaatatttggtctgtagttttcttttttcgttgtgtctttgccaggttttgatatcagggtgatggtgtctttatagaatgagttagggaggagtcccccctccttgatgttttggaatagtttcagtagaattggtaccagctgttctttgtatgtctggtaggatttgggtgtgaatcagtctggtctggggctttggttggtacattttttaattactaacttcaacttcagaacttgatattggtgtattcagggtttcagtttcttcctgatgcagtcttgggaggttgtgtgtttccagaaatgtatccatttcctctagatgttcttgtttgtgtgcatagaagtgttcataatagtctctgaggatttgttatatttctgtgggatcagttgtaatgtaactttttttgctactgattgtgcttatttggatcttctctctctttttctgtggtaatctagctagtgggctatcaattttgtttatgttttcaagaatccaacttttgggtttgttaggtttgcatggatttttgggtctcaactttgttcagttctgctctgattttagttatttcttttcctcttctagcttttgggttactttgttctcacttttttggttcctgtaggtgggatattagattgttaagttgatatctgcctttctgaggtaggcatttagcaccttaaactttcttcttagtgctggttttgctccattccacaaattttggtatgctgtgtctctgttttcatttatttcaaaaattttttttctttataccttaattttgttctttacccaaaagtcattcggagtaagttgtttaatttccatgcagttatatggttttgagagatcttcttggtgtttatttttatttttcctgtactgtggtccagagtatgggtggtatgatttagatttttttgaatttattgagacttgctttatggccaaacatgtggtcagtcttggagtatgtttcttgtccagctgagaatgatatatatcctgtggttggtggttggagtattctgtagatgtctattaggcctagtgggtcaaatgttgaatttaagcccagaatttcttcattagttttctgcctctattatctaatactgtcagtagggttttgaagtcccttactattatttatgtggctaagtcttttgtaggtctagaagtacttattttatgaatctgggtgctccaatgttgggtgcatatatatttaggatagttaagcttctagttgaattgaatgctttataattatgtgatgccatttttgcccttttttattcttatatgatataaggataatgacccccccccacctccgctctttgttttccttttgcatgatagatctttctttgaccctttcctttgatcctatctgtgtcattatgtgtgagatgggtctcttgaagacagcagactgatgtacttttttaaaaattcaacttgccactctgtgccttttaagtgaggtgtttagggcatttgcattctaggttaaggctgtgtgtggtggatcatgcctgtaatcccagcactttgggaggccaaggcaggagtataacttgaggtcaagagttcaagaccatcctgttcaacataacaagatcccatctctaccaaaaaaaaaaaaaggaaattacattcaagattaatattgatatgtgaggttttgatcctgttgtgaagttgttagctggttgctttgtagtttctattgtgtagctgctttatagggtctgtgggctgtgtacttaagtttatttttgtggtaacaggtatcattcattcttttgcttttatgtttagaactctctcaaagatcgcttgtaaggttggtctaatagtagtgaattcccttagtgcttgtttgtctggaaaaaatctatctctccttcacttatgaagcttagtttggtgggatatgaagttcttggttggaatttcttttctctaagaatgctaaaaataggctccccatctttcctggtttgtaaggtttctgctgagaagtccgctgttagctgatggggttctctttatacatgttctgacccttttttccagctggctttaagattttttctttagtgttgacctttgacagtctggtgactatatgccttcatgatgtttatcttgtatagtatctcacaggtgttgtctggatttctcgtatccagatatctacctctctagcaagattgaggaaatttttctgaattattcccttaaatatgttttctagattgttgactttccgtctctgcagaaatgccactaattcataggtttagtaactttacctaatcccatatttctaaaagactttgttcactttttaaaattaccttttttatttttgtctgactgtgttagttaaaaagactggtcttcacgcactgaaattctttcttctgcttggtctggtctattgatgaagctttcaattttatattgaaatttcttaaatgagtttttcaattatagaagttctggttttttttaagatatttatctcttcctacatttcctggattgcttaagaagtttcattgtgttgattttcaaccttgtcgtggatcttgttgagcttccttgcaaccatgcttttaattctttacgtgtcatttctgagtttccattttggttggggaccatagctggagagctagtgtaatcttttggtggtgtaactgcattcagatttgtcatagtgctggaattcttgcatttgttccttcccatctggaaatgctggcgtttctaatttttgtcattatttttgtgtggttggggttttttctttttctgtctttccctataatattattgttgttttctttctttccctttccctttcaccccctccctggaggatgtgattacagagaaggctgggtagtatattttggctttgcttctatagccctatgcacttctgctgacaggtcttatcttgggctgtgcagttcaacctcaagccagtagatggtgcctatgggtaggagctgtctgtggccaatgtggctgggtatagccttgcttaccgggagaagttctctgttgcctcaagcaatgggctggtttatggtgtgcacattggtctgagctccctgctcagccctggaaggggtgggacaggtggcaaatgggtggggttggactaggcaggctttacaggccctctgatggcatgcacgagcaccagcgccaaaggagaacccagtgggcagccaccacgtacccagaggtgtgcctagttttggagctgggaaacctcctaggcctcaaggtctctgcatggtggtggggagtggctgaaactcctaatccaggagagtgagtgttccagatggctggagatctgcctgggaatggaccgtagaggaccctactgcaccagaatctctgcacaaagaaggtggggtggctctagctgctaatccaggagaacaggtgctttgaatgcctggagatctgcctgagcatcgagtagagagggcccctgtgcaccaggatctctgcctagaatagtggggcagctcaggcttctgttctacatgagcaggtgctcaagattcttggatatctgcttgggcatagagagcacagagggtgcccctttagcaatatctcttcacaggaatggtggggtggttcaggctgccaatcctaggcaaacaggctctctgtatgcctggaggtctgcctgggcatgaaacagagaaggccccccttcaccaagatctctgcacatgagtgataggatgactcaggctgctgaccaggcaagcaggtgctccaaatgcttggagatttgcctgggcatgaagtgaagaggacccccctgtaccaggatctctgtataggaatggtacaatgggtcaggatgctaatccaggtaagtgagtgctctgaatgcctggagatctgcttggatgtgaagtggaaggaacctctttgaacttgtgtctgcacctttgcacaggaaaggtagggcagcttaggctgctgaactaggtgagcagaagctccaaatgcctggagatccacctgggcataaaatggagagacgcctgctgtaccaggatctctgcacaggaaggatgggctgactcaagctactagtctttgggagcaggtgctctgaatgcctggagatctgcctacatgtagagcagagagggcccctcataccatgatctatgcacaggaaggataggctggctccgactactgatccaggcaagggggtgctctgaattcctggagatctgcctaggcatggagtggagagggtccttctgcaccatgatctatatccatgaagggtggggtggctcagactgctggcgcaggcaagcagatgctccaaatgcctggatttctgcctggggatggagcagagaggaccctgccaccatgatctcaggggagcaggctgggacacccagcaatgacacgtgcagactggttccaggttgccaagctagccctggcttacaagtctcatcacccagatgagatgcagctgtagcggctctcctcccaccccgggcctgcaataggagaaagcacaattccagcacctcctgctgaggcactttccatagctctggttgcagaggccactacccaactccagagcaggcacttcagtctctgacctaagactattataaaatgcctaagtggccatgctgccaggtcactaaagaatggctgcctttgaatgtgcctggattaaaaatggtgtcctgttcttggttccaggcctcggaaaatgtctgcagcttttcccagcgtctttccctcatagcatttccaagcctttccccaagttacctccagggcttggagaaacataatgctgttccttaacctgggctgctcagatccccagtggaaaggtgagtcacagaggaggctctctgctcctctcatgtgctggggcttcacttatgtttatcagacagacactgtcacgagggctgtttgcccacgttttcctcctagagatctggggtgtccttcataaatctagtggattctcatttactttgtgaattaaagcttatctttatgcactgtcttaatgcagtatcttgctatttccaactggctgagacatgctttaacattcaccatcttggaaaacaatccttatacattttgaatagtaactccttatcagaggtatagtttgcagatattttctcctactctgtaggtagtctcttcattctgttgactgtttcctttgctttgcagaagttttttaaattcgatatcatttcatttttttgtttttgtttgtgttgcctgtgcttttgaggtcatatccaaaaaaataatcgcccaggccagtgtcacagagctttctccctaaattttcttctagtagtttcatagtttcaagtgttatgtttaagtctttaatgtattttgactggatgtttgtatatggtgagagataacaattttccacttttctgcctgtggaaatccagtttgcccaacaccatttattgaagagactgttcattccccgctgtgtgtttctggcacctttgtcaaaaattggttggccataaatgcatggatttatctctgggctttctattctgttccattggtttatctgtctgtttttatgccagtaccatgcagttttggttcctatagctttatagtagtacattttgaagtcaggtagtgtgatgcctccagctttgttattttttgctcaggattgctttaggtatttgggatctgttgtggtcacacacagatttctggtttgttttttctatttctttgaagaaggtcattggtattttgacagggattgtgttgaatctgtagactgcttttgggtaggatggacatgttaacaatattaattcttctaattcatgaatatgagatctttttccatttatttgtgtctttttcaatttctttcatcaatgttttacagtctttagtgtagagatatacatttaacctccttggttaaatttattcctaatatgtttttgtagttattgtaaaggggaatattttcttgatttatttttcagataattcactgttaatgtatagaaatgctactcatttttgtatgtgattttgtttcctgcaactttactaaattcatttattagatctaacagtttttttggtggagtcttcagacttttctatatacaagttcatgttgtcttcaaagagagacaatttagcttcttcctttcagatttggatgccttttatttcttcctcttttcctaattggtctggctcaaacttctagtactgtgttgaacagaagtgacaagagtggtcatctttgtcttgttccaggtctcagaagaaaagctctcaacttttcccgttcggtatgatgttagctgtgagtttgtcatatatggcctttattgtgttgaggtacattcctaattgttgagagttttcatcatgaaagcatattaagttttattaaatgctttttctgcatctactaaaattatcatatgggtcttatcctgcattctgttaatgtgatgtattacatttattgatttgcatatgttgaaccgttcttgcatccctgggatgaatcccacttgatcatgggataaagttactttttaaaattttcagagtggagagaataaagaatggagaacaaggactgaagagatgagaatcaggcacgtattatatttctcatcagcagcactgtacatgagaagacagtacacaatgatttcagatttctatggagaaaactattttgaacttagacttctatacccacccgaactattattcgtataagcaaaatcaagatattttctgacatttaaactttacaactttattgctcaagtaccccatataaaaaaaatctcaaggaggtaatcctaacaaaactaaattcagggaagaggatggaatacagtataaaacataagaaattgtagtagctgaatatgacctataaagcatgaagaaaagtgaaattagagaatttattgaatcttaatgcctacagcttttttctgttgagtggtaggggatttagtgatacgagatcacagtttcctttctttgagtctaaacatgcttcttatttttatagaaaataatatctaagtcatgataatacaataattctgtttattgccataaattttagaaccatcctgtggataaagtagagaagtcctaattataacttttgaaaaatatgtaaattgtataaatcttggcagtaaaagtaatgtgaaaaatcagtaactggaaaggatataaatgatagtgaaaatgcactgaagtttttaaattttatataacaggaactacctcaaattactaaatctagaaatacttacaaaacagatcatttaattaaatcatagtaaccaccagaagtaaaaaaataaaaaaagttagaagagtgaggtgaagggagggagaatttaacttttaaaaagccttattctaattaaaattaaagtctttctctttttgtgattataacattgcaaacagaaagtgcactgtatgtactttgcttggtcattagaaaactttaaatgcagaagccttctgagcctgtgaaagtcaatcactaaaattactacttttaaggcactaactcaaagggcaatccttggtaataagaatcagacaaagactctcaaaacaccagagtactcttcatagtgaagagagctggcgttggcaagagctaaaaaacaaagaaaagcaaattagatggatcaccagttttctttcatggcagacaaaagcccaaaactcttatctgactaataaggtcaactacctgaaaccaaagatactaaggaaataagagagtaattctaaagcaagagaaagaagcccttcaagggacctactatggagatagaatactaaatactctatgatctaacctttcaggaaatagaaatgaataaacagatttgtaacttggctcacctggtttgaaaaacaaagaaagttttcagaagttgtggtaaaaagccatcatttgtgacatttaattctacagtgaatggatcttaggcaagtatattacaaagtgttttgagactggccagagacaaattctaactaagctttttttttttcaattttctaaaagaaagttaaatgaaaaccaaaagaaaccctagtattaaatgcctactgaattgacagataaagatgtgtattgaatccacgtcatttcaaatctgcaaaatgtattttccatgtcagttatattagaaatgcatatttcacttcccctatcccaggatgatttggaaatatttagatcagaaaataagtcattgtgttaatacacaaaattaatactaccttcatacaactttaaatggattaattaatgtatttttcagctatataaaagcaaagagttgatgccaactagtgatttccaatagaaagagaacatgaggttgagtctggaataagcttcagtataggaccaaaataatgcgttagtaaggagaaatgggattggcagattcatacatcaaccatagtgaatgtcaccaaatatcttgtgtcagttgacttttaaatattaaccgagaaccaaaatgtcactcccctaggtacaaatcaaattgcttctcctttcttttgcctgcactcttaaatgctgaataacctcataagtaagatttctattaggcaaattagtgcatgcgtattaggaaccacagtttctggagtggagttcagtgggactaactatattccctatgattagtcactttaatcatagaattatgaggaaactcataaattatcaaatcatattctcaaagccttttttagcaatgcttaaccatgtgctctgtaagtatacatttgattttgttccctagagacaattgtttctgttttatgaagtgtgaaacattactcattggcaattatgagtaacttttatacttgttaagttttattgttgtgttaatgtaaacagaaacacttgtgtttgtttccatttgttcaatacacatttattaggcatctactttcgccagaagctgggagatacaaagatgaccatgagtcagttcctgccctctagcaattcaaaggagacataggtataaacttcaacagcaggaaaggcaagtggaatccttctgtgggggcagaagtagtctatctacccagcagccagcacaatgcatggtataacattggatgtgtaataaatcttgttcaaataaataaaataatcatgagaagatgtaccagaaatagtaatgccataaggaaaggaagacaaatggagttgaaccttgagctaagtcttgaaatatggagcaggtgagagaatttcagttgaagaaaagaatgtgtgtaaagtcctcaaagggtgaaatagcatgtgatttcagggaattaggataattccatttttctggaaagtatgtcagtggcaaagccatgggagatgaagatggggagatgggaagcagccacattaaaaagcacatgctggatcttctagcttcttaaagggtagcaccatgatcagatttatgtttagaaagatttctccatgagaaggacagattggtaaccaaaaggatagttagaagatcactaaaaaaatctagtgagcagtgacgagggtctaaactataaactaaagctgtagcagctgagaggatgaatttgggagagatttggaaagtagaaatcaaggtttgagggtaggggaagggaacagtgagacagaaacaggaatctgggatgatccttgtgttctgatgtgattagctggatgaaaaagaaggctgcttagtggaacacgatctgagaaggtgatacagggaaaatgagttcatagatgcctaggagacattcaggaagatttatttagtaagcagttagtgacctgaacctggaactcaagagctaggtccaggctggagattcagagctggtggtacccatgtctggtggtaactatgagcatgagtgagagagcccagtggagaatacagagtattagtgacccagattcattatttcccagtgcctactgcagtgtgtggtttggggatggaattgatatgacactcatcattgataatcattattggagctagaaaaaagggttgaaaaaatagtatggagaacattttggcattttcaaattaccattttttaagattcagaatgattttctattgagagacagttactcatggaataaaacatatgaatcaagaaccaagtaaattaaaagcaaagtaactgacttgtttttgttagaggaaatatatgttcatatgtctaaattaagaattgttcatagcaaataatgcttggtaagtttttgttggatttgtacatgtggaaatctaagatgtatttaataaatatggaaataataaaatagatttgtagttttatgagcacttagatgaaaagagaagcagagaaaaaagagaaaatgggaaatagagatagacacacacatactattaatatagaaacttataaaagacaaaataactgtaatccataattcaaccaccactgtcaaaatttcaacatatattctattattatgtctgtacatatttttgtatacttgttatgttggctatataaattcatatacttctttttttaacttgatatgataaacattttcccaagttattaaaaactcttcataaatatggtttttcatgacagcataaagatgcctatcacttttcagttacttagttacacattctctattgttcaacatttagattttagctttaaaaaactttaaataccactccattgagtatctttgtttataaggctttgtgttcatttcaaattattttcttgagatagatttctggaaatagaattaccatactaaaacatatgaacattttaaggctcctattgccaaattgtgttttagaaagatgatacaaatgtatacttccatcagctttatgtggcaatgcctggacacactaaataatacagcatgctataaagccttgtatttgggttcattgggaaattggtaattggcactaaccttgtattttattcagtgaattcactgattagctcaaattagtaaagatagacttattgtaaacaatgacaactatctccttttttatttaacttttatgcaaaataactttaaaatggaattcaaaacacacttccctatattttgcatggtttcacttggaaatacttctccagaaggaaagaaatgcttctctaactggtatggagggaaagagggattgctctttcctttttagtactattaagcaacaattgtctattttggaggaggtttatgacttctttcaaaaacaaagtatcccattttttccccagagcaaagctcttagaaggcaatagctaagagctatgttactaacatgattgttctaggaggagcactgctcagctcccatggcaacaggtaccatggaaatagacacactttgtcagaggtattgtaaatgctattgggtatgagggcagtagttgcagtgaaatttcattgttgctatgttgtagaggttgcacaacacaccaagccttatttagattctgttgataagtctgacctggtttttaagaagttctatttttttaaaaaagaaaaacaaaccccaacccccaacctgttagacctaagataaaatgagaacaatttgcaaggttcaaattgttctgtatggaagctctggaaaattatatgcaagtctgtatggaagctctggaaaattatgatatttcagagaactgtgaactttgaagtgtctgtggcaataagtgataggttgagtgtgaataacttaaatccagaagtcatccccagacttcatttgagctaaacagttcagcttcttctcataggtcaggtcactgttaatttttgcagtgacaatgattaacaatgaaattattaagagtgattactaatataacacctgttttgtactctgctgttttactgttcaaccctttttaataaccattaaaaggtacctatgactagtactataagcagattcatcccacagttggggaaattaaggcatagagaagaaataaagacctcatggtcttagctggagagaggtagagtctggattgagaaaagttagagctccagtctctagccttattttacaaacattgatacaatggtaaagatgaaacctaagtcaaagggtgtatgggttatcattggtggctctgtttgtttaatagataactcaatttagcagagagggctgtactattgtttcatttcagagcacctgtgcaacttctgatgcttaagagggaaattgagaatacttctctaattcatacccaagccaccctaacaattacacatgataatactcaatacaaaatgtcaagttagggattatcttggcctttttctagtagattcctacctgttcccagtcttttccagacactgtcatccctcacaatccaatctgtcactctgccaggagccaagaggattcagatgctatcccttgctttttgaaatcacagttgaactcaagaacccaacagagttagatactaagaccctgcacctgtatctatggtccttaaacttatatgtgcataagaattacctggatagcctgttaaaaatgtacattctcagcttcccattctgactaagtaagcctggggtgaggcccaggaagctgcatttttaaccaactcccccagtgcttctgaagcaggtggtctgtggtcacgctttgagaaacctgaagatcagcatgtcagtctgttaaagtctcttccacaccagtgagcctaaggacaatggggacagtggaggttgaggaaggggcagtagtgagaagggaggcctgtacctctgtgcctgggagcccagcaaggaaccttcagctcttgaggtcccaacatgtgctgtggcccacgctggacctcagtatgtgggaaaaagcaaccagctttcagaattcacaaaggatgaggcacaaggtagagaaacagggatgctgcaatctgcaatctgagtgcgctggcccctgagtcagtaagagttgtctgtagatacctaaatgtttaaatcaattttcttctctcagacagtggaatccagaacatatattaaaaagagaccacttccagcctgtaggaaaaatgaagttttgtagctcattgatggcttctttcttgctgttaggaaggccaagccagagaagctaaaatgattgagctaggccattttcgcattagcattcaacccttaaataaaactttggagaaaagaccccttttcacattccccacgcacccctaccaccactgcctaagctttggcagccttccaaatcctccagaccccagaacaggacttgtccctgggcttgttttccagggtttatatgacgcccttgttcccttcttggcaattcaagtgaaactcaccatctcaggccacagcgtggtagtcattgttgtaaatagctttgactatttatttttctaaaattcctagaatagcatttagatgccaagatcctgggagtgagaaaagaatgttatttttgtaagaaagactattttaggggactgttctaacattaagagacagaaatgggccatgtggtttgctaggaaatttccttgcaaagctaaaatccacattactgcctttcatgactggggtagttagtcactttctcactttattttaaatgaggtcatgattcctgagttattgtcacctttggaagctagaaggatgggtaagtgccaagtgctttgaatctactcaagagaaagccaacgtacaatggttttccatttacctgtagaaggcaggtccatatcatctttgaaaaaataattacgcctgttctttgcatctcccgcctcaggaccagaatttgtgtttgtttagtgatgaaaaatctccaatattaatattaatctttttgtttgttctgtttcctttgccatcatgctctgtccacttactgcagtatttgactccttgagatacatttcaaatcataaatctctcctcatggctccttaaaaaagtgaatctttctcgtgtccctactttcttgtgtccctacttactatttttattaccagattataaccatgatttcctcattgaccacagcagtggggtaccagcatccctggaaaaagatgtcttgaatatcctacaatgaatatcaaatggagagagcctctgcctgttcaaggctgaaaatctgagaaaaataaaactcacgttgctttttaaattcagagatgtgaccactgtgaatgtattgcatcaacataagtcaaatattggtacctatgggtatagaaggattcaaaggctggggtcctggaagaagagggtcagaaagcatcagaaggaggaagagcaagacttgcagacaaccctgaggtgggagccagctcccctcactcagaaagtgtgggctggtacacccgataggaatggagcagggcgcacatggagatttggggtgagctctcctttcctaagtagggtacactgacaatgatcaatctgttcccatcatctgaacttataatgccttcccagaaaacctctttgggctaccatcatacctcttagagaacaagcatatatctaagcctcatcacttttcaatgctgcggttatttctgatgtttcctggatttaagaagtagtggtttactattttttcagtgtttaagaatgaccttagaaacccgttaaagtgcatatgctagggcttcatccccagcaattctgatttgattgattggggatggatccagaaatttttatttttagtgagtatactgaattattttaaagaagatagttaggttagcagagctactctttgcttctttttacttccacctttcatgttgtcctgcctcctctttgatcaatacatactatgtttttgcatgtgccctttgccctcaaaagtcttttccaatcatcgattaggtaggtatcatctaagcttgggtttctcacataatttcgttaatgcttctttgcttcaaattttgacttacctttaaggccatataactactgatacttaattgaacctgttctctaattgccaccactgcagttacaaatgatgatgatgatattttcaaggttatttatttatatcacagaaaagaacagtagcacttgctatatacttagagctttctgaggatcagctatacacataagacactgactcattaatttttacagcttctgtgcaaaaactagctaaaattgctttccacttcaagttgaagacagttagtcataagtatacattccagcattaatttttttcctattaactttgatgcataaggtttatttatttaatggatgtttctggactgtctgccatatgtcagtcactatgctaggtattaatgatacaatgatgaacctcccctcatgaagcatccaggatagttgcagagcaaacaagaaaacaaagagaataatgaaagtatacagagtggtacctaacacagcattaaatggggagtgggggttatcagagagttgtcttggaggattgaaagttgagtaggactaaaggtttgaatggaggctgaatatgttgaccccagatcatgcccttaatagctggttgcatttaaaacagaattccagccattgtaagaatttattttcttgtgatttatatcttaaatataaaattcaagtgaaaatggataataaaaataatctggctgggatccctgggtgttggaattggatacccctgagtttcaatccaagctccaccacttatacatgatgtgactttagacaagttacttaacctctccaaatcttaggctcctcatctgtgaagtagaaataatgatttaataataatttattattaaattattataaaattgtattattaaattataaaatatattattattaaattatttatttttacaatttaattgtgagtgttaaatgaaagaacatattgaactagataattcagtatctagaacatagtaagtgctcaataaattatagcgccccccccccagtcctataggtctcaaataattaatttttctactttaactagtctcctgatccccaaattagcattccagcttcctactgagcattctgacttctgtctttatattccctggcctaaaagactctccacatgcagtccattttcccctttctctctttcctgccttcacccccatatgcacacatgatttgtgtgacttagtttattcatctgccaagacttagtttagacactatttattccaggaaaccttccctgaccctctttaccatatcttggttagccaccactcctctgtgcaccataactcactgagcttcctccatcatggtgcctttaacaccatttgataatgtgtgtgtgtttgtgtgtgtgtgtgtgtgtgtgtgtattcatctgcataccccactgggctgtattgttttcatgtgtgacttgcttgcccttttaagtccagcacctagaggagataggtgctggccccaatatgcattttcaacaagtatttttgaataaattgagatatcaatttcccctaattttaggtgaggagtgtacctgatacatatacactagcctcattatagtttgtatagataactttgtcttttaatctgtgccatttgcaattttgagatacttattaacttctctttgctacttcttcctttgccatttgcatctttcatttcagaattatacaatgtccaggttttttctttctacagtataaagctctgaactcctgattaatctttcaatatgttgaataacatacacacacatacgggcacacacgtacagcctttatgtttggtttctttctttgaatgccgtttgttaaatagttcctttggtagtaatccctctggctttaggtaaagccagttcaaagcatttttagagcctggcaatttgtagctctctttaaaatatcttttcatctctccaactccgtgcttcttaatctgtactagaaaccaagcatttgaaagaaactaatatcacctgcattgtggctgcttctttgcctttctgcctcccacttgttactgtagtttattcatctttatttttccagcatctagtccatgcctggagcactaggcatgctatcactgcttgttaaattagaatttggaaaactacctagtgcaaatatgtttcccactgctagtagaccacccatatcggtagctatctggcctagttagctgacatggccaataaggctgccatagaggtataactttgtctttaaagtatttattcatttctgtttctcttgtggacttccaatacatgtagaaaacagggacattgaaaactgaaacagttgggggaagattgaagggatgtgggtgtggttataaaaggttaacacaagaaatttttgtggcattgaaactgctcaatatctttattgtggtgataaaattgtaaataatagacactcacacaaataccatgaatacaagtaaaactagggatatatgaataagattgggggattgaatcaatatccatatcctagttataatattgtattacaattttgcaaaatgttactgatagcaacaggagacagacaaattctgtcagatagacagacagggacagtcctcagtgaaacctgaccttcaatccaaggacagtttaaagcctaaaaacagagctgccagttctcgatagagtccacgactggagcgaggacctctgtgcccatcttaccctcctctctctctgttggttccttctggatgatgccttttaaccagtcaaatggtgctttttccaaagaccacccatggaccaatcagcatgcatgcttccattctaagcccataaaaaccccagactcagtcctatgggggctacctgcctttgggcccctactcactgccgaagggtcccctctcgcagttgagagctttgcttctgttgctaaataaaattctttgccttactcactctctggtgtgtgcagatgttattcctcttggttgtgggacaaggacctggaactcacaaagctgtgggcagcaggaacaagacagctgtaacacacccgcatttgcctagctccagacacaaaaaagcaaagccactgggtaccactccctcccactcgccgagcaacaagagagaaaaagcttctgggcaccactccctccctctcacggaacacaaaagccacaacatttcttgggggctcagaccttgggactccccaagcaagagctgtaacacagtggctacagagatttccagctggggaagtagtaccaaagggatcctgtaacattaccattggaagaaagcgcacaaagtatacaagggctctcttagtattatacaagtatttcaataaaagttttcatttaaaaaatgaaagttgaaaaagagagaaacaggaaaccaatgtcataaagaaaaggggtaaattatttcactttgagcttcctagttaaccaaagaagtcaaggcaaaaaagaaatatcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaagaaatatcttgtattcattcattcaacaaatcactcattcaacaaataatgaatgcaataaataaccatcatctaataaaacatacaatctgcttgagaaagacagcaccttccttgatattaattttgaaatttgccatatgatgtgtcctttatgtggattattatgaaactcgaagcaccatagtaaaagcataataattatccttggaatttgagtgttttaaagtaacattttttgagatcctgcactggctttgttcaagctggagtaacatcatagcgctttacttgctattgtggaatggctttttatgttgaggtgcactgtctaatttcactttctgctgaatggacaccagctgctatttactgaccaccataattgctggctatttacatatgtgttgtgagcaagtgtctcatttttcctggtgacaaacctgagctcaaagaggtcaaatggcatctaaagtagtaaggctgataagtagcaaagccagggcactcttccctgcctgtagcttaaccagactagattcacatcctaaagccaagagagaaggcaaggctgattttagagactttcaacatttgtgcttcctactaattgtgtcctaatcactgtggcattaggttgtatagtgtccatttcaggaaagagaaaagcaggaactagatgtcagaaatataatatcaggctttcttgtttttgttttgtgggaagtagccaaagaccaaacaagacaaaagattaaacgtacaatatcgtctctctgcattgatttctgagcccaggtccagctctgtagagtggacatatgggggaagcttagagctgttccccgcctaagcattggccttttcaggttcaaaagctttagatcctttgtgtgccctggccccagcttctctggtacagacagtgggtggttgttagaaagtgtcagtaggtggtaaagtgtcctggtgctctgaagccaggcaaacctgggtctgaaacttgattctaccactgaggggctttgtgagggtagtcaagttacctaaggttgagtattagcagcccttccttgtaagtctgttgtgaggattaaataaaataatccatgtgaaacacttagtccagtgtctatcatttggtatatgttaatatgtgcgattgttggtatcactcattctttttagtgtggaatgtttttctctgctctttggtttgtatatgagttacaagtaatcttccttccatgttatctgacagttgcaaaagaagtaatgaggagaatttcttcaagaactctggatcgtgggcctatagctaataggggtttaaaataagaagaaagaatccttttccacaaatatggtaaaactataatttttttaaatgctcaaagagagaataggttgactcaacattttctcttttttttccacaagtatgactttttgatgtgtctttacaagacaaactgtctttaaaaaccttacataacaaccctccctcctccctatgtacacttccatatgtacccacacaaagactgggccagtttatgcatctgtagagtccactacttaaaaccaacaggatggagtgatggatggtcatagtggtatcagtgagggcactgctattaactacatgtggtagctcagattagaaagtcctgaaaggaatgttgtacatgtacacctttcccaatttactcatattttaatgggaattgctttcaaagatgtgttaataaccatgttgctgttatagaaggagtccaaggataccttctgaaatggctcaaaatacacatgcaaaaatatactagccatcatgacacctggatgtcatttaccttctttgggcataatgagttactatattaacacttatttagcctgttccagcatatttttcatcttcgagcaagtgaagagactgagaccagtatatgctatggaggtactgacacatatagttgaaggagattggttaaaacatgtgccgaattggtcaaacttcttttcacttcaagtttaacatcagatgtgagtttttctgaatatatttaggtccacgttgccatcttcaagactttttaaaaccatcttcacctaaagttagattacattaaaagaaaaataagaatatatttggagcagagctctaactttattttataccacaagagttctgattttgtggattcaggttgcgtcttgctgagaagaaatttcagtgctgcttcagcagcttcctgggctttcagattattatttttttaatttccttctatataagttaagagtggtttgcaaaattgcatttgtttgcaaaaatttactgctgggctataaatgtttaatgagatcattattttaaatctaattctggtccttgcttattaatgcacattctgcaaaggaaactttgagtggggaactttacactatctcactacactattgcactaggcactattgcaaaattcttagtatttcccttctatgatgatttattgagaatgtttctgttatgttgatgtactgggcaatttttgcaatagcaacccattcatttagttattctatttgtcgttgcacactttcaaagtgatcaatgatgaccttcaaataaaatattggaaaatgtctaactcattcatggtgagagaaatgagcaaaaaaatggagacagaagattttgttgctctggaacaaggagtctgcatgatgaaggggccagggaagaggtacaacagtgctactgaaccttagtgagtttaacagtagaaatgcttttggctgcaagtggcagaaaatccactcatcggcagtgtgaaccttaaggttattcactactcacttaataagaactttagagcaaggagatctcagagacataggtgacttgacagagctctagtgccagggcactagacttacagagtattcctcatcatcatctcctcatgatcataagatggctgcaacagttcttttttttattttttattttttatattatacttaaagttctagggtacatatgcacaacatgcaggtttgatacataggtatacatgccccatgttcatttgctgcatccatcaactcatcatttaaattagatatttctcctaatgctatccctcccccaggcccccatccccctgacaggccccggtgtatgatgttccctgccctgtgtccaagtgatctcattgttcaattcccatctatgagtgagaacatgcagtgtttgattttctgtccttgtgataatttgaagagaatgatgatttccaactccatccatgtccctgcaaagaacatgaacccatccttttttatggctgcatagtattccatggtgtatatgtgccacattttcttaatccagtctatcattgatggacatttgggttggttccaagtctttgctattgggaatattgctgcaataaacatatgtgtgcatatgactttgtagcagcatgatttataatcctttgggtatatacccagtaatgggattgctgggtcaaatggtaattctagttctagatccttgaggaatcgccacactgtcttccacagtggttgaactaatttacactcccaccaagagtgtaaaagggtgcctgttactccacatcctctccagcatctgttgtttcctgactttttaatgattgccattctaactggcatgagatggcatctcattgtggttctgatttgtatttctctgatcaccagtgacgatgagcattttttcatgtgtctactggctgcatagatgtcttcttttgagaagtgtctgttcatatcctttgcccactttttgatgggattgtttggtttttttcttgtaaatttgtttgaattctttgtagattctggatattagccctttgtcagatgggtagattgcaaaaattttctccgattctgtaggttgcctgtgcactgtgatggtagtttcttttgtcgtgcagaagctctttagtttaattagatcccatttgtcaattttggcttttgttgccattgcttttggtgttttaggcatgaagtccttgcccatgcctatgtcctgaatggtattgcctaggatttcttctagggtttttatggttttaggactaacatttcagtctttaatccatcttgaattaatttttgtataaggtgtaaggaagggatacagtttcagctttctacatgtggctagccagttttcccagcaccatttattaaatagggaatcctgtccccatttcttgtttttgtcaggtttgtcaaaatcagatggttgtagatgtgcggtgttatttctgaggcctctgttctgttccattggtctataaatctgttttggtaccagtaccatgctgtcttggttactgtagccttgtagtatagtttgaagtcaggtagcatgatgcctccagctttgttctttttctgtaggattcacttggcaatgtgggcccttttttggttccatatgaactttaaagtagttttttccaattctgtgaagaaaatcaatgttagcttgatggggatgacattgaatctataaattactttgggcagtatggccattttcatcatattgattcttcctatccatgagcatggaatattcttccatttgttcgtgtcctcttttatttcgttgagcagtggtttgtagttctccttgaagaggtccttcacatcccttgtaagctggattcctaggtattttattctctttgtagcaattgtgaatggctcatgatttggctctctgtttgtctgctaatggtgtagaggaatgcttgtgatttttgcccattgattttgtatcctgagactttgctgaagttacttatcaacttaaggagattttgggctgagacagtggggttttctaaatatacagtcatgtcatctgcaaacagggacaattcgacttcctcatttcctaattgaataccgtttatttatttctcttgcctgattgccctggccagaatttccaacactatgttgaataggagtggtgagagagctcatccttgtcttgtgccagttttcaaaggggatgcttcccgtttttgcccattcagtaagatattggctatgggtctgtcaaaaatatctcttattattttgaggtatgttccatcaatacctagttgattgagagtttttagcatgaaaggctgttgaattttgtcaaaggccttttctgcacctattgagataatcatgtggtttttgttgttggttctgtttatgtgatggattacatttattgatttgcatatgttgaaccagccttgcatcccagtgatgaagccgacttgatcgtggtggataagctttttgatatgctgctggatttggtttgccagtattttattgaggattttcacattgatgttcatcagggatattggtctaaaattctctttttttgttgtgtctttgccaggttttgttatcaggatgatgctagcctcataaaatgagttagggaggattccctctttttctattgatttgaatagtttcagaaggaatggtacctgctcctctttgtacctctggtagaattcagctgtgaatccgtatggtcctgggctttttttttttttttttttttttttggttggtcggctattaataactgcctcaatttcagaacttgatattggtctattcagagattcaagttcttcctggtttagtcttgggagggtgtatgtgtgcaggaatttatccatttcttctagattttctagtttatttgtgtagaggtgtttagtattctctgatgatagtctgtatttctgtgggattggtggtgatatcccctttatcattttttattgcatctatttgaatcttctctcttttcttctttattagtcttgctagcggtctatcaattttgttgatcttttgaaaaaaccatctcctggattcattgattttttttgaagggttttctgtgtctctatctctttcagctgtgctctgatcttagttattttttgtcttctgctagcttttgaatttgtttgctcttgcttctctagttcttttaattgtgatgttagagtgtcgattttagatctttcctgctttttcttgtggacatttagggttataaatttccctctacacactgctttaaatgtgtcccagagattctggtacattgtgtctttgttctcattggtttcaaagaacatctttatttctgccttcattttgttatttacccagtagtcattcaggagcaagttgttcagtttccatgtagttgtgtggttttgagtgagtttcttaatcctgagttgtaattgattgcactctggtctgagagacagtttgttgtgatttctgttcttttacatttgctgaggagtgcattacttccaattatgtggtcaattttagaataagtgtgatgtgatgctgagaataatgtatattctgttgatttggagtggagctttccgtagatgtctagtaggtctacttgttgcagagctgagttcaggtcctggatatccttgttaaccttctgtctggttgatctgtctaatattgacagtggggtgttaaagtctcccattattattgcgtgggcgtctaagtctctttgtaggtctctaaggacttgctttatgaatctgggtgctcctgtatttggtgcatatatatttaggatagttagctcttcttgttgcgttgatccctttaccattatataatggccttctttgtctcttttgatctttgttggtttaaagttgttttatcagagactaggattgcaacccctgcttttttttgctttccatttgcttggtaggtcttcctccatccctttattttaagcttatgtgtgtctttgcatgtgaaatgggtctcttgaatacagcacactgatgggtcttgactctttatccaatttgccagtctgtgtcttttaattggggcatttagcccatttacatttaaggttaatattgttatatgtgaatctgatcctctcactacgatgtttgctgattattttgcccgttaattgatgcagtttcttcatagcatcaatggtctttacaatttgggatgtttctgcagtggctggtaccggttgtttctttccatgtttaatgcttccttcaggagctcttgtaaggcaggcctggtggtgacaaaatctctcagcatttgcttgtctgtaaaggattttatttctccttcacttatgaagcttagtttggctggttatgaaattctgggttgaaaattcttttctttaagaatgttgaatattggcccccactgtcttttggcttgtagagtttctgccgagagatccgctgttagtctgctgggcttccctttgtgggtaacttgacctttctctctggctgcccttaacacattttccttcatttcaaccttggtgaacctgacataagcagacatttcaccaaagaggatatatagatgttaagtaagcatgagaaataacatcagagacaatgtaaactaaaaccacaaggagactaacaacattaacagaatggctaaagtcataagcagtggcaacactaaatgcggcaagaatgtggagatactggatcactcattcattgctggtgggaatataaagttgtacagccactttgcaaaaaagttggatagtttctataatgaaacatataattatcctgtgactcagtaattgcactctggcatttatcccagggaaataaaaacttacgcttgcacaaaaaaaaattatacacagatgttcacagcagttataatagtcagaagctttcttcagcaggtgaatgatgaaacaatacatggtacatccataacatggaatgttactcagaaaaaaataaataaaaaggaacaaactgttgatacatgcaggcctctgaagatgtcaaaacatcatatgatacagaaaatacaaaatatagttaatacacatgggcataggtttaaatattctatgttactgatttcttaattgagttatatttctcaagactctattaaataaaaaataatgttagttgcctcagatgcatttaattttatcatattgtggttattttgtgactttttttattatacttgaagtaatgggatacatatgcagaacatgcaagtttgttacataggtatatacgtgccatggtggtttgctgcacccatcaacccgtcatctacattaggtatttctcctaatgctatcacttccctttccccccaccacctgacaggccccgatatgtgatgttcccctccctgtgtccatgtgttctcatcgttcaactcccacttatgagtgagaacatgcagtgtttggttttctgttcctgtgttagtttgccgagaatgatggtttccagcttcatccatgtccctgcaaaggatatgaactcgtcctttgctgtggctacatagtattccatggtgtatatatgccacattttctttatccagcgtatcattgctgggcatttcggttggttccaagtctttgctattgtgaatagtgctgcaataaacatacgtgtgcatgtgtgtttagagtagaatgatttataatcctttgggtatatactcagtaatgagattgctgggtcaaatgatgtttctggttctagatccttgaggaatcgccacactatcttccacaatggctgaactaatttaaactcccactgacagtataatagcattcctatttctccacatcctctccagcatccagcattttaatgatcaccattctaactggcatgagatggtatctcattgtggttttgatttgcatgtctctaatgaccagtgatgctgagctttttttcatatgtttgttggctgcataaatgtcttctattgagaagtgtctgttcatatcctttgcccactttttgatggttttttttttcttgtaaatttgtttaagttccttgtagattctggatattagccctttatgagatggacagattgcaaaaattttctcctattctgtagattgcctgttcacactgatgatagtttcttttgctgtacagaagtctgtcagtttaattagatcccatttgtcaatttttgcttttgttgccattgcttttggtgttttagtcatgaagtctttgcccatgcctatgtcctgaatggtattgcctaggttttcttctagggtttttatggtttaggtcttatgtttaagtctttgcccaagcctatgtcctaggttttcttctagtgttttcatggttttaggtcttacatttaagtctttaatccatctcgagttatcttttgtataatgtataaggaaggagtccagtttcagttttctacatgtggctagccagttttcccagcaccatttattaaatagggaatcctttccccactgcttgttcttgtcaggtttgtcaaaatcagatggttgtagatgtgcggtgttatttctgagttctctgttctgttccattagtctatatatctgttttggtagcagtaccatgctgttttggttactgtagccttgtagtatagtttgaagtcaggtagcatgatgcctccagctttgttctttttacttaggattgtcttggctatatgggctctttttaggctctgtgtgaactttaaagtagttttttctaattcggtgaagaaagtcaatggtagcttgatgaggatagcattgaatccataaattactttgggcagtatggccatattcatgatattgattcttcctatccatgagcatggagtgtttttccatttgtatgtgtcctctcttatttcattgagcagtggtttgtagttctccttgaagaggtccttcacatcacttttaagttgtattcctaggtattttattgctctttgtagcaattgtgaatgggagttcactcatgatttggttctctgtttgtctattattggcatataagaatgcttgtgatttttaaagacctggaaccaaccgaaatgtccaacaatgatagactagattaagaaaatgtggcacatatactccatggaatactatgcagccataaaaaatgatgagttcatgtcctttgtagggacatggatgaagctggaaaccatcattctcagcaaactatcacaaggacaaaaaaacaaacaccgcatgttctcactcataggtgggaattgaacaatgagaacacttggacacaggaagggggacatcacacaccggggcctgttgtggggtggggggggggggggggggtagcattaggagatatacgtaatgtaaatgacgagttaatgggtgcagcacaccaacatggcacgtgtatacatatgtaacaaacctgcacattgtgcacatgtaccctagaacttaaagtataataaaaaaaaaagaaaaaagaaagctggatttcactccaaaatgtaaaaaataaaaaaataaaataaaaagaatgcttgtgatttttgcacattgattttgtatcctgagattttactgaagttgcttatcaagttgcttatcaacttaaggagattttgggctgagacagtggggttttctaaatatacaatcatgtcatctgcaaacagggacaatttgacttcctcttttcctaattgaatacgctttatttctttctcttgcctgattgccctggccagaacttccaacactatgttgaataggagtgctgagagagggcatccttgtcttgtgccagttttcaaagggaatgcttcgggattttgcccattcagtatgatattggttgtgggtttgtcataaatagcttattattttgaggtacgttccttcagtacctagtttattgagagtttttagcatgaatggggtgttgaattttatcgaaagccttttcttcatctattgaaataatcatgtggtttttgttgttggttctgtttatgtgatggattacatttattgatttgcatatgttgaaccagccttgcatcccagtgatgaagctgacttgatcatggtggataagctttttgatgtgctgctggatttggtttgccagtattttattgaggatttttgcattgatgttcatcagggatattggcctcaaattttccttttttgttgtgtctctgccaggttttgttatcaggatgatgctagcctcataaaatgagttagggaggattccctctttttctgttgtttggaatagtttcagaaggaatggtaccagctcctctttatacctcgaatagaattcggctgtgaatccttatggtcctgggcttttttttttttttttttttggttggtaggctattaattactgcctgaatttcacaacttgatattggtctgttcagggactcaacttctttctggtttagccttgggagggtgtatgtgtccaggaatttatccatttcttctagattttctcatttatttgtgtagaggtgtttatagtattctctgacagtagtttgtatttctgtgggatcagtggtgacctaccctttatcattttttattgtgtctatttgatttttctcttttttcttctttattagtctggctagcagtcttatctattttgtttatattttcaaaaaaaacagctcctggattctttggttttttgaagggtttttcatgtccctgtctccttcagttgtgctctgatcttagttatttcttgtcttctgctagcttttgaatttgtttgttcttgcttctctgtttcttttcattttgatgttagggtgtaaattttaggtctttcctggtttcttttttgggaatttagtgctataaatttccctctaaacattgctttagctgtgtccaagagattctggtacattgtgtctgtgttctcattggtttcaaataacttatttatttcttccttaatttcattatttacccagtagtcattcaggagcaagttgttcagtttccatgtagttgtgtggttttgagttccttaatcctgagttctaattgattgcaccatggtctgagagactgtttgttatgatttctgttcttttgcatttgctgaagagtgttttacttccaattacatggtcaattttagaataagtgcaatgtggtacagagaaaaatgtatattctgttgatttggggtggagagttctgtagatatctattaggtctgcttggtccagaactaagttcaagtcctgaatatccttgttaattttctgtgtcattgatctgtttgatattgacagtggggtgttaaagtctcccacaattattgtgtgggagtctaagtctctttgtaggtctctaagaacttgttttatgaatctgggtgctcttgtattgggtgcatatatatttaggatagtcagctcttcttgttgcattgatccatttaccattatgtaatggccttctttgtctcttttgatctttgttggtttaaagtctgttttatcagagactaggattgcaacccttgcttgttttgctttccatttgcttggtaaatattcctacatccctttattttaagcttatgtgtgtctttgcatgtgagatgagtctcctgaatacagcacagtgatgggtttcgactctttatccaatttgccagtctgtgtcttttaattggggcatttagcccatttacatttaaggttaatattgttatatgtgaatttgatcctgtcattatgatgttagctggttattttgcccattagttgatgcagtttcttcatagtgtcgatggtctttacaatttggtatgtttttgcagtggctggtactggtttttcctttccacatttagtgcttccttcaggagctgttgtcaggcaggcctggtggtgacaaaatgtctcagcatttgcttgtctgtaaagtattttatttcttcttcacttatgaagcttagtttggctggatatgaaattctgggttgaaaattcttttctttgagaatgttgcatattggtccccactctcttctggcttgtggggtttctgctgagagatccactgctagtctgatgggcttccctttctgggtaacccgacttttctctctggctgcccttaacattttctccttcatttcaaccttgatgaacctgacaattatgtgtcttggggttgctcttctcaagaattatctttgtggtgttctctgtggttcctgaatttgaatgttggcctgccttgctaggttgaggaagatctcctggataataccctgaagagtgttttccaacttggttccattctccctgtcactttcaggtacaccaatcaaatgtaggtttgatgttttcacatagtcccatatttcttagaggctttgttcattccttttcattctttttttttttctctaatcttgtcttcacactttatttcattcagttgatcttcaatctctgatatcctttcttccacttgatcagtttggctattgatacttgtgtatgcttcacgaagttctcttgctgtgtttttcagctccatcaggtcatttatgttcttctgtaaactggttattctagttaacaattcgtctaaccttttttcacggttcttagcttccttgcattgggttagaacatgcttctttagctcagaggattttgttatcacccaccttctgaagcctacttctgtcaatttgtcaaactcattgtctgtccagttttgttcctttgctggccaagagttgtgatcctttggaggagaagaggcattctggtttttggaattttcagccattttgtgctggtttttcctcatcttcgtggattcatctacctttggtctttgatgttggtgaccatcggatggagtttttgtgtggacgtcctttttgttgatgttgatgctatacttttctgtttgttagcttcccttctaacaggcccctctgctgcaagtctgctggaattttctggaggtccactccagaccctgtttgcctgggtatcaccagtggaggctgcagagcagcaaagattgctgcctgttccttcctctggaagcttcgtcccagaggggcacccaccagatgccagctggagctttcctgtatgaggtgtctgttgacccctgctggaggtgtctcccattcaggagacacaggggtcagggacccacttgagcaggcagtctgtcccttagcagagctggagcactgtgctctctttagagccagaaggcaggaacatttaagtctgctgaagctgctcccacagccaccccttctcccaggtgctctgttgcagggaactgggagttttatctataagcccctgactggggctgctgtctttctttcagagatgccatgcccagagaggagtaatctagagaggcagtccgtctacagtggctttgctaagctgcagtgggctctgcccattttgaacttccccgaggctcggctttgtttacactgtgagggggaaaccacatactcaagcctcagtaatggcggatgcccctccccccaccaacctgaagcgtcccaggtcgacttcagactgctgtgctcgcaatgagaatttcaagccaggaaatcttagcttgctgggctccttgggggtcagatctgctgagctaggccacttggctccctggcctcatccccctttccagggcagtgaatggttctgtctggctggtttcccatgtgccactggggtatgaaaaaaaactcctgcagctagctcggtgtctgcccaaatggctgtccagttttgtgcttgaaacccatggccctggtgctgtaggtacccgagggaatctcctggtctgcgggttgcaaagaccatgggaaaagtgtagtttctgggccagaatgcaccattcctcatggcacagtccctcatggcttcccttggctaggggagggagttccctgaccccttgcacttcctgggtgaggcaaggccccaccctgattctgctctctctccatgggctgcacccactgtctaaccagtcccagtgagatgagccaggtacctcagttggaaatgcagaaatcacccaccttctgtgttgatctcactgggagctgcagaccagagctgttcctattaggccatcttgccagccatacacccttttttgttttgttttgttttgttttgttgagacagagtctcactctttcacccaggctgcagtgcagtagcgcagtctcggctcactgcaacctcagcttcctgggttcaagtgattctcctgcctcggcttccccagtagctgtgattacaggcatgtgccaccatgcccagctaatttttgtatttttagtagagacagggtttcaccatgtaggccaggctggtctctaactcctgacctcaggtgattcacctgccttggcctcccaaagtgctgggattacaggtgtgagccaccgtgcctggcctgttttgtgactttttgtgcactgtttgatattcacaacctttcctttttccagctatttgtggattaggtattatatcttttggttttgttttttattttgctataagcatgaaatgtttcatatgtgcttgaaaaaaataaaagtggggatcatgctaatttcctgtgagtcatccacttgataggtggtaagacaagaaagagaaaatctagaactgctgtagaatgcagagatgtgcaaggagcagaagtctgaggaactgaattcctagtaagtttaaaaagtctgcaaatgcagtcatgcctgtgtttggtggaaatgtgaagactgcagaaaccacttcaagttatgtacttgggcagaccagcagggaacattctgagagatgtataggacaggaggaccaggaaagggacagcaataaattcaggttgccagggagttccagagaggaatcatggcccgagctaaggagttgtactgtgatcagaggctgagacagaggacaggctggcctagagggagggctaagaagcaatccaagtgaccatgtaaagctgccaattctagattgtcgattctgttccattaacctgtatgtatatgtgcccctgacaagagtccctggccaagatggcaagtgaagcttgactccggctcactctgttcaccaagccttgtgttgagatgcagcactgcagccacctggaggaggaatcttattccaatttttttcttccatatttctttttaattaacatacaatttatataccataaaacatacccttttaaaagttcagtagtttttagcatattcacaaagttatgcagttatgtgatttcaaaacattttcattaccccccaaagaaaccctgtaaccattagcagtcatttctcattccccccacctcccagctcctagtctgctttccatctttataaacttgccttgtcttgacatttcatataagtggaatcatacaacatgcaacctgtatatccagcttctttctcctagcataatgttttcaaggttcattcattcaaaatacttccttcctttttatggctgaaaaatattccattgtatggatatactccatttttttgtccattcattaactgatggatattttagttgttttcaatttgtgactgtcatgaacaatgcttctgtgaatgttcgtatccaagtttttgtgtgggtcttgaagattatgcctttgttttctttgaagaattttctagttttatgtcttatatttggtctttcatctattttgagttaatttttgtgtatggtgtaaggcagaggtccaaatttgttcttgttcatatccagtcgtcccaggactgttgttgaaaatacactgctgttgaaaatacagaaaattctctcccccactgaatggtcttggcacccttgttaaaaatcagttgaccatatatgtgatggtttaattctagactcttgattctgttccattgatctatatgtctggccttatgccactaccaccaccctgtcttgatcattgtagcatggtagtaaattttgaaaccaaggagtatgaggcctacaactttgtcctttttcaagattattttgtttattctgagtcccttgcatctctacatgaattttaggatcccgttgtcaatttctgaaaacaacacaaaacaaacaataaactaaatgacattttgacagggattgtttgaatctacagatttatttcaggaatactgccatgttaacaatgtcaaatctttcaatctatgaacaaaaaaagtcatttcatttaattaggtattctctaatttctttcaacagtatcttgtagttgtcagggtatgacttttgctcatcttttgttaaatttattcctaagtattttattccttcttatgctattgaaagtggaatcgttttcttaatttcattttttattgttcactgctagtgtatagatatacagttgagtattgtatattaactttgtattctgtaaactgctggatgtattacctctaaatcgttttgtgtggattccttagaagtttctacatacaatatcattttgtgtgcagatagagatagttttacttcttcattttcaatgtcaatggctttcatttctttttcttgtttcattgccctagctagaccctccacagtactgaacagaagttgtgagaatagacaatctttgtcttgttccagatattaggagaaaatcttccaatctttcaccattaaatatcataattgccatgagtgtttttggagattccctttatcaagttacagaagttttctactgttcttagtgtttaatactgttgttcttgttgtcgtttttaacatgaaagggcattggatttctcaattttttttctgcattgagataattgtatggtttttgtccttaattttattaatatgatatattacattcattgttttaccctggaacaaatcccacctaatcatgatgtatcctttttatatgttgctggcttcagtttgttagttttgttgaatattttggcatctatattcataagagatattgctctgtagtttttttttttttcataatgactttttctgattttagcatcagggaaatagtgaccttacagagtgagatgggatattttccctcctccttttttttttttttttcacagagacagagtctcgctctgtcacccaggctggagtgccgtggcacaatcttggctcactgccaacctcccctgcccgggttcaaacaattctcctgcctcagcctcctgagtagctggggctacaggcacgagccaccatgtctggcttgtttttttgtatttttagtagagacggggtttcgccacattggccaggctgttctcgaactcccgacctcaggtgatccacccgccttggcctcccaaagcactaggattacaggcatgagccactgcgtccagcccctcctcctcttctttgtggaagaatttgtgaagtactgctgttaattctttttaaacatttggcagaattcactagtgaaaccatctggaactgagtttttcttagtgggaagaatcacttgaaactgggaggtggaggttgcagtgagccgagattgtaccactgcagtgagccgatattgtgccactgcactccagcctgggtgacagagcgagattcatctctaaataaataaataaataaataaaatgttgttcaattcctctttccttgttataacaatattctgtttagttctatccattgttgaatgagggatattgaagttttcaactattattgttgaattatctatttctccctttaattctgtccatttttgtttttattttgggaacctattattctgggagtatgtatattaggggagtatatatataatttttgttttcttaatagattgctatctatatatgttataaattcaataatatagtcatatgactattgctttatatatatagttttattttattgcttatatttttattgcttatatttattgctttatatatatttttacatatagaatagtctcattcttaaataaataaaaaacagaaactacatattatgcagtctattacatacaccaaaatatttactatttctggaattctttgtttctatgaattttagcagctatctgggggaaatttcctttctacttgaaagattttctttagaattttttcgaaagtgagtctgctagcaatgaattatctttgtttatctggggatgtctttatttcaccttcagttttagataattttctggatataaaattcttggttgacagcatttgtctcagcatgcagaatgtcatggaacttctttctggtctccattgtttctaatgagaaatcagtcggtattagtattaataatctcctgcatgcaatgagtcatttttacttcctcctttccaaatttctgtcttttatttcaagtgttcgataaaggtgtgtctaggtgaggctctctttaaactacgtgaggtttgttgtgttcttatatctgttgactaatccatttttaaatagaatttgggacattttccaggattatgtcttaaattttttttctgtttctttctttctcctctctctttctggaactcctattatacctacattaatacccttgatattgtaccacaagtctctgtacttttttcgtttttctttaggcttttttctctttcagttcttcagattagattgtttttatttatctatctttgtttaataattctgtgtttttttaacttttattttagattcagggggtacatgtgcaggtttgctatatagctaagcttatcttacagattatttcatgagccaggtactaagcctagtacccaatagttattttttctgatcctctccctcctcccaccctcaagtaggccccagtgtcttttttgccctctttgtgtccatgtgttctcatcatttagctccaatttaaaagtaagaacatatggtatttggttttctgttcctgcatcagtttgctaagaataatggcctccagctccattcgtgatcctgcaaaagacatgagcttgttcatttttatggctacatagtatttgatgatgtatatgtaccatattttctttatccaatctgccattaatgggcatttaggttggttccatgtctttgtaattgtgaatagtgctgccgtgaacacagtgtgcatgtctcattatggtagaatgatttatattcctttgggtatatacctagtaatgagattgctgggtcaagtggtagttgtttttagctctttgaggaataactacactgccttccacaatggttgaactaatttacacttccaccaacagtgtataaatgttcccttttctctgcaacctcaccagcatctgctatttttttgaactttttaataatagtcattctgactggtgtgggatggtatctccctgtggttttgatttgtatttctctagtgatcagtgatgttgaggttttttttcatatgcttgttgactgtatctatgtcttcttttgagaagtatctgttcatgtcctttgcccacttttcaatggggttgttttgtaaatttgtttaagttccttataaatggtggatatgagacctttgatgcatagtttgcaaaatttttctccaattctgtaggttgtctgtttattgatagtttgttttgctgtgcagaaacaaatttaatttaaattaaattagatcccatttgtcaatttatcgtggttgcttttggtgatttcatcatgaaatctttgcccatacctatgttgggtttttttgggggggttgtttgtttgtttgtttgttttgagatggagtctctgtcacccaggctggagtacagtggtgcaatctcggctcactgaaatgcccacctcccaggttcaagcaattctcctgcctcgacctcccaagcagctgggattacaggtgcctgctaccatgctcagctaatttttgtatttttagtagagacagggttttgccatgttagccaggctgatctcgaactcctgacctcaggtgatccatccaactcggtcccaaagtgctgcaattacagaccccatgcctatgtcttgagtggtattgcctaggttgtcttccagggtttttatagttttgggttttacatttaagtctttaatccaccttgagttgatttttgtatatggtgtaagcaaggggtccagtttcagttttctgcatatggctagccagttattccagcactatttattgaatagggcatcctttccccattgcttgtttttgtcaagtttgtcagagatcagatggttgtaggtgtgtggccttatttctgagctctctgttctgttccattggctctatgtgtctgtttttgtaccaggaccatgcttttttcattattatagccccatagtatagtttgaagttgagtaacgtgacacctccagctttgtcctttttgcttgtgattgccttagcttttcaggttcttttttggttccatatgaattattaatgtaaaatagtttttttctagttttttagtagagacagggtttcgccatgttagccaggctggtctcaaactcatgacctcgggtgatccatccaactcagtcccaaagtactgggattacagaccccatgcctatgtcttgagtggtattgcctaggtgaaaaatgtcattggtagataggtttgaacctataaatttctttggccagtatggccattttaatgatattgagtcttcctattcatgagcatggaatgtttttccatttgtttgtgttatctctgacttctttgagcagtgttttgtaattttcattgtagagatcttacaatccctggttagctgtattcctgggtgttttattctttttgtggcaactgtgaatgggattgctttcctgatttggctctcagcttggctgttattggtgtacaggaattctagtgatttttatacattgattttgtatcctgagattttgctgaagttgtttatcagcttaaagagcttttgggctgagatgatgggattttctagataaagaatcatgtcatttgcaaacaaaaaatagtttgacttcctgtcttcctatttcaatgcattttattttattttttagttttactttaagttctgggatacatgtgctgaatgtgcaggtttgttacataggtatacatgtgccatggtggtttgctccacctatcaacccatcatctaggttttaagccctgcatgtattagatatttgtcctaatgctcttcctcttctttccctgcacatctgacaggccctggtgtgtgatgttcccctccctgtgtccatgtgttctcattgttcaactcctacttatgagtgagaacatgcagtgtttggttttctgtttctgtgttagtttgctgcagatgatggtttccagcttcatccaagtccctgcaaagggcatgacctcattcttttttatggctgcatagtattccatggtgtatatgtgccatattttctttatccagcctatcattgccaggcatttgggttggttccaagtctttgctattataaataatgctgcaataaacatacatgtgcatatgtctttatggtagaatgatttataatcctttgggtatatacccagtaatgggattgctggatctaatggtatttctggttctaaatccttgaggaattgccacactgtgttccacaatggttgaactaatttacactcccaccaacagtgtaaaagcattcctatttctccacatcctcaccagcatctgttgtttccagactttttaatactcaccattctcactggcatgagatggtatctcactgtggttttgatttgcatttctataatgaccagtgatgatgagctttttttcaaatgtttgttagccacataaatgtcttcttttgagaagtgtctgttcatatcctttgcccactttttgatggtttttttttataaatttgttttaagttccttgtagcttctggatattagacctttgttagatggatacattgcaaaaattttctcccattctgtaggttgcctgttcatgctgatgatagtttattttgctgtgaagaagcccttcagtttaattagatcccaattgtcaattttggcttttgttgccattgcttttggtgtttcagtcatgaagtctttgcccatgccagtgtccagaatgatattgcctaggttttcttctagggtttttatggttttaggtcttacttttaagtcttcaatccatcttgagttaacttttgtataaggtgtaaggaaggtgtccagtttcagttttctgcatatggctagccagttttcccaacaccatttattaaatagggcatcctttccccattgcttgtttttgtcaggtttgtcaaagatcagatggttgtaaatgtgtggcattatttctgaggcctctgttctgtttcgttggtctatatatctgttttggtaccagtaccatactgttttggttactctagccttgtcataagtaaaaagaacaaagctagtggcatcacactacctgaatgccatttatttctttctcttgcctgagtgctaaggccaggacatccaatactatgttgaataggggtggtgagagagggcatcctcgtcttatgccagttttcagggggaatgcttcctggttttgtccattctgtatgatgttggctgtggtttagtcatagatggctcttattattttgaggtatgttccttcaatacaaagtttattgagagtttttaacataaatgaatgttgaattttatcaaaagtttttctgcatctattgaactaataatgtgatttttgtctttagttctgtttatgtgatgaatcacatttgttgatttgcatatattgaaccaaccttgcatcccagggataaagccttcttgatcatggtggattaacttcttgatgtgctgctggattcagtttccaagtattttgttgaggatttttgcctcagtgttcatcaaggatatggggctgaagttttctttgttgtgtctctgccaggttttggtttcaggatgatgctggcctcacagaattagttggggaggagtcccttctcattttgttggaatagtttcagtaggaatggtaccagctcttctttctttattttaatggcagaatgcagctgtgaatccatctggtcctggactttttggttgatagactatttattactgattcaatttcaaagctcattattggtctggtcagggaagcaatttcttcctggttcagtcttgagaaggtatatgtgtccaggaatttatttatctcttctaggttttctaatttgtgtgcatgtgtgcatagaggtgttcataatagtctgtaatagttatttgtatttctgtggggtcaatggtaacatcccatttgtcatttctgattgtgtttatttggatctgtcttttcttctttattagtctaggtagtggactaccttattaatgtttttcaaaacaccaactcttggatttgcttattttttcatggcttttaatgtcttgatctccttcaattcagccctgattttggttatttcttgtcttctgctagctctggagttggtttgctcttgcttctctagttcttttagttgcagggttaggttatacatttgagatgattctaacttttgatattaagttggaatttagtgctataaatttccctcttaacactgccttagctgtgtcccagagattctggtatgttgtatctttgttctcattagtttcaaagaatttcttgatttcttccttaatttcattatttacccaaaagccattcaggagcaggttgtttaatttccatgtaactgcatgttttgagttttttgtagtcttgattttcactgctatccaagagtgaatttggtatgatttcagttcttttacatttgctgaaaattgttatataaccaactgtgtggttgactttacaatatgtgccatgtggtgatgagaagaatgtatagtctgttgttttggggtggagagttctgtggagatctatcagatccatttggtccagtgttgaatttgggtctgaaatatccttgttaattttctgccttgatcatctgtctagttctgtcagtaagtgttgaagtctcccactattattgtgttggagtctaagtctctttgcaggtctcttgagaacttgctttgtgaatctgggtgtccctgtgttgggtgcatacgtattaggagagttaggttttcttgttgaattgaaccctttaccattatgtaacgctcttgtcttttttgatttttgtttgtttaaagtctgtttgtctgagattgggattgcaacccctgcttttttctgttttccatttgcttggtagattttcctccatccctttattttgagcatatggatgtcactgcatgtgagatgggtctcttgaagacagcataccattgggccttgcttctttatccagcttgttactatatgctttttaaatggggcacagagtgacaagctggttaaagaagcaagaccccttcaagattattattgatatgtgtggatttgattctgtcattgtattgttatctgttttttatgccagcttgtttgtgtggttgctttatagtgtcactggcctctgtacttgtgtttttttttaattggctggtaatggtctttccatatttagtgcttcgttcaagatctcttgtaaagcagatctggtggtaatgatctccctcagcatttgcttatctgaaaaggatcttatttcttcttcactgaggaaggttagtttggctggatatgaaattcttggttgaagattttcttcattgagaatgttgaatataggcccccaatctcttcaggcttgtagggtttctgctgagaggtctgctgctagcctgatggggttccctttctctctagctgcttttaacattccttctttcattttgaccctggaaagtctgattgtgtatcttggtgatgatattcttatggagaatcttgcagaggttctctgtatttcctgaatttgactgttggcctctgtagtgaggttgggaaagttttcacagaagatatcctgaaatatgttttccaagttgtttgctttcccccaatccctttcagggatgccagtgatttatagtttgggcctctttatataatcccatatttctcagaggttttatttgttccttttcattattttttctttatctgtatatgactgtcgtgtttaaaagagccagtcttccaagttctgagatttcttcctcagtttggtctattttgctgttaattcttgtgactgcattgtgaaaatcttgcagtttgtttttcagctctatcagatgagttcttttatactggctattttatctgtcagcttcggtatcattttattttgattgttagttttctcggattggattttgccattctctggaacctcaatgatctttgttcctatcagtattctgaattttctttctgttattccagccaaccctggttaagaatccttgttgaagaactagtgtagtcatttggaggatataagacactctggtcatctgacttgtcagagttcttgtgttggttctttctcatctctgcatttaggtgttctcttaactgctgggctgcctctgattgaagcggtcaggcaggggcagagtggttgcactggagtcctgggcctggtaactctgcccagtgaagagaagtgaggaccaggacctgcgtggagaacagtatggacacttttccattaggtggatgctctgtgctgggggttcagaccagtgccgggtccccatggactctctagagcctggagacaagaagggtgagggctgtgagacagcaaagatggcaacccacccctcccactgggagctctgtcccagagagctgaagaactgctactggctcaatagctccagtggggaaaggctggagacccaggctgggagaacctgcccagtgaggagatacgggaacagggactcatgtaacaaacatatagaaaacatgtaacatgtagaaaacatgtaacatatagaaaacatgtaatatatagaaaacatgtaacaaacatatataaaagtctggccacttttccattgggctgctggaatatgcaggaggtctgctccagtttctaatcacctcagattttccagcacctgaaggtatcaacaatcaaggctgcaaaacagcaaagatggcagtgtgtcactccctctgggagctccatcccagggaggtatggatctgttgccagcttgaacatactggcgagggtagttgtaaatcttggtcaggagattctgcccagtgaggagaaatagggtccaggacccataaggaaaggcagtctagctgcagcttcacagagctgctttgctgtgctggggaactgccccagtccctagttgccttggactctctagagccctatggcaagaagagctaaggctgtgaaacagcaaagatggtggcctgtcctccccctgggagctccattccagggaggcttggaaccactgccagctggaaaacactggcaagggcggctggtgaccccagtcaggagatcctgccccatgagaagcaaggccagggacccatggaaagagaagcagtctggccacttttctgtagggtggctgtactgaaggcaacgacagccaaggctgtgaaacaccaaagatgacagcctgcccctccctctgggagctccatctcagggaggtataatgccaccatcggtggctagctagacttccaaaccagtgggtctcgtcctgtgaggtaccatggaaacagggtctgcagactgtcactgctcagtcccctggattcagcccctttcctcggggtatgtatgggggtctaacctcccactttgtcagttacagctgcttttgccaggaagcccgggtatctaaagctcccggggctccacgtgtgcctgagcagctgctctgccaagactccacatagctctacatgtcataccacaggccctgatggagtgggttcaatgaggtgatctcttgacctgagggttgtaaagagacctgggagaagcatgggtcttagggtcactcactcactcaccgattcccaggtaggggaggctcccctggctccatgttgctcctgggtaagtgatcatcctgccttgcctttctccattctttgtggattgagttgttttcttgatgaatcctaatacatgtacctggatgtttcagttgaaggtgctgtatttattcgccccttctattgctctccataagagcaacacacaccagttgcttctagttgcccatctttaaaacttagagagttattgtacttttatctccagaatttcctgttagctcccttttagagtttctgtgtctttatcagtacttcctatttgttgaatcattatcatcctatttttcacaaagtctttaaatgtagtttctttttattctttgaacatattcatagtagctgctttgaagtttttgtctgctaaatcaatatctagacctagtcatagtaagtttttattttttttttcttgagtatggatcattcttttgtttctgtatgtctagtaattttttgttgaaaattgaacatttggttaatataatgtgacaactttagattctgacattttaactgagagttattgttattgttttgattttttgtttgtttttagtaacttttctgacttaatctgactgatctatcttttccatggtatatagctgctgatatctctgctcagttttgtttttattgtgtatcctgtcttactaagcatcccccttttgtctgcatagttcagcagacggctaatgatagtagtgctcaaatgtctcaagttcacaaagtttcagccttcaactagtagatctgtctgaggcatgcattaaaagttcaggaggccaggtgtggtggcccacgcctgtaatcctagcactttgggaggccaacgcggatgggtcatgaggtcaggagtccgagaccagcctgaccaagatggtgaaaccccatctctactaaaaatacaaaaattagccaggcatggtggcaggcacctgtaatcccagctactcaggaggctgaggcaggagagttgcttgaacacctcagcctcccaaatagctaggactacaggtgcacagcaccatgcctgaattttttttttattttttgtagagacagggtctccctaagttacccaggctgatctcaaacttcttgtctcaagcagtcttcccactttggcctcccaaagtgctgggattacaggaatgatccaccatccttggccttgtgttctttcttttttcttagactagccagaggcttattggcctaaaacaatcacatttcaaatgccatctatgagatcactgaaaccagaggtaggcctagcctaactaaaactgcaacccaccataactcagcttaatttctgatgggaatttatcaattcctcagttgctacttactagaggcaggagcaacttttctgaaggaaaatagcatcaactgtcagtctttgtgattctttaatacacaaagcccatcatgctataagatattattagacatataacaggcaaaaacatgagaccaacaatcaagcaaaaaaggagatgatagaagcagacccatagatgatccagatattggatatggctgataaagacttcaaaataactattataaatatgtgaaagaaaattgataaaaaagatgaagaatttcaacagagacatggaaactatttaaaaaagtaaaattactagaactgaaaggtaaaatttctgaaattatgacttaattgactatgtttaataagactttgaacacagaagacagaattagtaaactcaaagatagctcaatatcaaatatccgaagtggcagataaagagaataaaaatataaaaagaaaagagtagagtataaaaaacttgtgaaacattttcagaaggtctagcatatgaaaaattgctttcatagaagaggagaaaagaaaatgggtcggaaggaatatttgaagaaatatatatgagacattattcaaaattgataaaaggcatcaatccacagatttaagaagctcagtaaacccaaaaggaataataaaactgtcataatcaagctgcatcaaaccaaagctaaagagaaaatcttaaaaacagtcataacagttactttctaagaagcaacaaaaagactaattactgacctttcaactgaaattattaagtctagatgttggtggaatgaaatatttaaattgctgaaagaaaaaaactgccaaattaaacctctgcccaatgaaactatcattcaaaaatgaaaataagataaagttattctcaaagaaaagttaatataaatacttgccatgacctgagataaaaggaatggtaaagaaaattctttggactgaaacaaaaggatctcagatggaaggaatggtatgaatggtatgacaggaagagatgaaaaacactggaaaggataaatatgtgagtaaatgtgaaagattattaatttttttacaacaaaaaactgttatataatttggtgtttatagcaccaatgatatataaaagccctagcacaaaaggagacagagactaagggagtttgatgttgtaagaaacttgtattgtacaagaatttgtaaacttgctaatttaagattggcttcaacatattaaggatgaacattgtaatttctagaataatcactaaaatgttcaaaaagaggcctggcatggtggctcatgcctgtaatcccagcactttgggaggccaaggcgggtggatcacctgaggtcgggagttcaagactagcctgaccaacatggtaaaaccctgtttctactaaaaatacaaaaaattagctgtgtgtggtagtatgcacctgtaatcccagctattcaggaggctgaggaaggagaattgcttgaacccaggaggcagaggttgcagtgagctgagatcgcaccactgcactccagcctgggtgacagagtgaaactctgtctcaaaaacaaacaaataaataaataaataaaatgtccaaaaagataaaactataagctattagaagaaatgatttataaaaatatacttgattaatttcaaagaaggcaagaaaagaagaacaggccaggtatggtagctcatacctgtaatcctaacacttgggaggccaaggtgggtggatgtcccaaacccaggagttcaagaccagcctgggtaacatggcaaaactccatctctacaaaaaataccccccccaaaaaaattagccacgtgcggtggcacatgcctgtagtccctagctgctttagaggctgaggtgggaggatcacctgagcccaggtcaaggctgcagtgagccatgattgcaccactgcacttcagtgtgggcaacagggcaagaccctgtctcagaaggaaaggaaggaaagtgaaaataagctttcatttgaagaagttagtaaaacaatagtgaattaaagcaaaagaaaagaaataattgaaaataaaaacaaagaaacaaaatggaatgaaatagaaagcagatatacaatagataaaaagaaaaaagtaaaaattttattctttaaaatgaattcataatattgaaaaatcttcaagatgatcaagaaataaagagaaaataaaatttaacaatatcagaaatgaaagaagggacatggctatggcacctccattttgttaaaaaacataagatgatgttataaaaaatttatgccaagaaactgacaacatatttaaaatggacaaagtcaggccaggcacggtggctcacgcctgtaatcccagcactttgggaggccgaggcaggcagatcatgaggtcaagagatcgagaccatcctggccaagatggtgaaaccccatctctactaaaaatacaaaaatcagctgtgcgtggtagtgcacacctgtagtcccagctactcaagaggctgaggcaggagaatcgcttgaacctgggaggtggaggcttcagtgagctgagatcacgccactgcactccagcctggtgacagagcaagactccatctcaaaaaataaataaataaattaattaattaaataaaatggacaaattcatttggaaataaaaaccaacattgacataagcagaaatttaaaaatggaattagaataatcctaacatctattaaagaaatctataattacaaactgttttacaaagaaaagtcccagcccagatgggcttggtggtgaattcttccaaatattccaatatgaaataataccatcttacataaactctttcagcaaatacaggagggagtaacattttctaacttgctttgtgaggccagtataaacctaatacaaaaatctaagctatcacaagatgtacaagcatattgcaagaaaagaaaattgaaggacaatatttcttcaatatggatacaaaaattctacacaaaatattagcatattgaatccaaattgaatagtgatatattaaaatgatgtcacatagaagccatgtgaggttattctagaaatgcaaagtttaacattcaaaatttgatgcatgtaatttttatattaaaaaaataaaaaaatccatgtggtcatctcaatagctttagaaaaagtatttgataaaattcaatatctgttcataacaaaaactctcagaaaactgggaaacaaaggacactttattaatctgataaaggacagctaaaaactcacagccaacatcatacttcatagtaaaaattttgagcacagttttcccttacttcaggagtaagacaaagaataatctgttaccacttctactcatcattatactggaggtcatagccagtgcagtaggacaaggtaaaagagataaaagtacaaagattggaacggaaaaaataaacccatttttattcacagaagatatgattacaagcatacctcattttattgtactttgcagatactgctttttttaaaacacaaattgaaggtttgtggcaaacctgcattgagtaagtttattagcaccatcttttcaacagcatctgcttacttcatgtctctgtaacattttgctgattcttatactattttaaactcttttctagttatgacaactgttatggtgatctgtgatcagtgatcttgatattactgttgtaattattttggggtgccacaaactgcacctatagaagatggctaacttaatcaataaatgttgtgtgtgttctgactgctcaaccaactggccattctctagtctctcttcctcttctcacgtctctttattccctcagacactgcagtatttcggttaggccaatgaataaccctacagtggcttctaagtgttcgagtgaaaggaagagtcatacatctctcactttaaatcaaacgctagaaatgattaatcttagtaaacaaagcatgttgaaagctaagataggccaaaagcaaggccaaacagttatccaagttgtaaatgcaaaggaagaattcttgaaggaaatgaaaagtactatttcagtgaacacatgattgataagaaagcaaaacagcctcattgctgatatggagaaagtttcagtggtctggttagaagaccaaaccaaccctaacattcccttaagccaaagcctaatccagaccaaggccctcactctttaattttatgaaggctgagagaggtgaggaagctgcaggagaaaagttggaagctagcagaggttggttcatgagagttaaggaaagaagccttctccatgacataaaaaatgccaggggaagcagcaagtgctaatggagaagctacagcaagttattccaaagatcattgatgaaggtgactacattgcagctggtgactttaagttgaagacaatgttaatttactattcagaacattctagggcccttaagaattatgttaaatctactctactctgtctatgctcaataaatttaacatcaaagcctggataacaggacatctgtttacagcatagtttactgaatattttaagataactgttgagaactactgtttaggaaaaaatacatattcctttcaaaatattactgctcattgaccatgaacctggtcacctaagagctctaatagaaatgtgcaaggaaatgaatgttttcttgcctgctaacacaacatccattctgcagcccatggatcaaacagtaattttgaccttcaagtcttatatttaaaatacattttgtggctgggcgcagtggctcatgcctgtaatcccagcattttgggagactgaagggggcggatcacctgagatcaggagttcgaggccagcctggccaacatggtgaaaccctgtctctactaaaaataccaaaattagctgggcgtggtggcaggtgcttgtagtcccagcaacttgggaggctgaggcaggagaatcacttgaacccaggaggcggaagttgcagtgagccgagatcgcgccactgcactccagcctgggagacgagtgaaactccatctcgggaaaaaaaaaattgtaagtctatagctgccatattaaatgctctggaaagggttcaccattctaaatgtcattaagaacatttgtgattcatgggaggaggtcatcctccataacaagagtttggaaaatgttgattccaatttttttttttttttttgagacggagtctccctctgttgccaggctggagtgcagtggcacgatcttggctcactgcaacctctgcctcccaggttcaagcgattctcctgccacagcctcctgagtagctgggactacaggcacgcaccaccacacccagctaatttttgtatttttagtagagatggggtttcaccatgttggccaggatggtctcgatctcttgacttcgtgagccgcctgcctcagcctcccaaagtgctgggattacaggcgtaagccaccgtgcctggctgattccaatctttatggatgactttcaggggtccaagacttcagtggaggaagtaagtgcagatatggtgaaaataacaaaagaaccagaattagaagtagagcccaaagatatgactgaattggtgcaatatcaggatcaaacttgaatggatgaggagttgcttcttatggatgaccaaagaaagtggtttcttgagatggaatttactcctggtgaagatgctgtgaacactgttgaaatgacaacaaaagatttagaatattacataaacttagttgatagagagtggcagagtttgagaggattgactccaattttaaaagaacttctactgtgggtaaggtgctctcgaacaacattgtgtgctacagaaaaatctttaataaaaggaagaatcaatcaatgtggcaaactttactgctgtcttactttcaaaaattgctgcaaccactccaatcttcaataaccatgaccctggtcagcagctatcaacatcgaggcaagaccctccaccagcaaaaagattattatgaattactgaaggctcagaagattattagcattttatcaataaaatatttttaaatcaaggcatgtgaattttttgtaatcataatgctattgcacaattaatagactacagtatagtgtaaacattacttttatgtgcacttggaaaccccaaaaatcatgtgactcactttattgcaatattcacttcattgtagtggtctcaaacagaacccacaatatctctaaggtatgcctctatgtgcataaaaatttttaaagaatcttcaaacggaattaataagtaaatttagcaaggtcactatataatactctattaacctagtgtgttaggctgttcttttgttactataaaggaatacctgagactgggttatttataaagaaaaaaggtttaattggctcacggatctgcgggctgtacaagtatgccacgaacatctgctcagtgtctggcgagggcctcgggaagcttacaatcatggcagaaggtgaagtgggagcaggcacatcacatggcgagagtggagcaagggagcagagggcaagaggggtggtcccagactcttaaacaaccacacctcatatgaactgagtgaaaacccacttatcaccaaggggatggtgctaaaccatgagggatccacctccatgatccaatcacctcccaccaggccccacctccaacattgggaatcatatttcaacatgagatttggaggggaaaaatatccaaaccacatcactcggtatagcattttccatttctactttaaactttcctatttcaactatgtatttagattttcttttgtaggcatcctctggctagatttttttcatccaatctgatagtttccatctttccagctggtacaagttagatatatttagatgtatttccaataatgtaagtcctcaatgtcataggttcttggaaactataactttaagtgaaaagatgtacagcaggttcttcaataatgtcatttcatgcaaggtagattcattattaacactgatgagaaaaaaaatattcattctcttatatgtctttttctttaaagttgcagtttccaagaacctatcaacgatgttaagtgaggacttatgacacttcattttgtgctttccatttaccagttctttgtattttcttattttcccctttcctaatttctattgtttgattaattctctagtttatgcaatttatttatttagaagttatatattctaattattttcttttccgctgacaaatatttaatacacaaatatgagttgccaaagtctacagctggtacttctattttcctcctaaacaatgaaaggactgtagaatgcttttactcttcccactcccttccaccttatgttctgtttttgtctcctgttttaattttacctttcttttataaatcctcaagctggcctttaataatttttatgtccagcatttttttcatgcaattcatttctaaggttcaatttttttcttcctaaagtgtcacctttggtagatttttcttcagggtctgcaattagtaaattttctcattgattacatatttgaaaaggtctgttagtcttgctgggtatagaattcaagatgatgattacattcgtttgctactttgaagatgttattttctcaaactattagattctggttctattaaagactgctgttggtctaacagtttctctgaggtaatctgcctttgatttatgcttgcttttaagattttctccttgtctgcgatgccttacatgttcactataatgtgggtcggggtattgatttattacttgtcttgctaagggctgattgactgtcataaccctagaatttatcatttctggaaaactgcaaatttggataaattattcaagttcccgtgttagtccacttctcaaaacccttcagtgtctccctcatttactgccagtattactactcaggactggcatgatctagcccctgcacatttctgtaattaagtttcccattaattccatttctgtctgccaggaaatccccatgactcaaactggtgatgctatttcttgttcataactcagctcaactttacctaccctctaaagcctttcctgaaacctgttcttctccctagccactctctgtttgtgtacccactctttcctgctcataggtctgttagttattgcatttatctatttatgtgtaaaattttccccctctggactcgagttcccagtgggcagctccctttgtatttatggagacaggtccttagtatgggctctataaatatttgtagatcaaatgaataaatgaatcaagaaataagggtaaacactaactcatagggatcttgtaacaactaaatgtataccacatgaagaagcacctggcaaataacatgtgctaatctattgtttgaaactccatattcatgcattattctgctacagtgggttatgtgccaaactggttgccttttaaaatttccttattccatatggcatagagttctcagtgttctttgatcataatgaagtatatttttggttctgtgccttttattccaattgctatatttctcagaacaagaaaaaaatgaagatgcttatatagtgtaccaattattacattctgtcatgaaaacgcagtgcatctgtgaatgttcttctcccatatatcttaatggcattctcctgctcctttaggtgtctgctccgggcctttgctgaccctccttataaaatagcaaattttcacctcacctccactctgtcctcttttatgtgctttatttttcccatacacttgtctacaaatgaatattatatatttacctttttggttattatttgcccacacataaacaccagcgtataaagtaggaactctgctttatgcctagaacagtgtccagcacacagcaggtactcaataaatatttgttgaataaatgtatcaatgcagatgccactgattcccatcagtaaaattctggtgccagaggagacagacacaataaagccactctgggaatgctagccttcaatattaatcttgacctgggatgagattacaaaacttgactattttgcttttcctgagaacagactgcctaatgcatgatttaatcctgaaaagtaaagaaatcacttcctctcctggcaagcaccttaaccaagttctaagctggctgcagataaagcccgtctgttctctactggtttaaagatagtggcagttcctgcctacttttagcaagctttattttgctttctgttttctttcaccacttaaggaaaatttacatatcttctctacccattttatcgttttgatcttggcaagagctttcaattaatactgtgtgagcagttgtgcaaagaaagcacccatttacgatgtttatgggaaataaattcttattatttcataatgacaaacacctaaagcttccatttatttgtattataattatgagaggtccagagatgataaatgacttgctgaaggccatgtagctaacttttacaatacaggtgattcctagttttccgtgaataagttcatttatgtttctcttaccacctacacattaagctaaagcccgccaatttttacttcactagtgtgaatctgtctgtgaaatagccatcttacttcctcaaccttcaactatcaaactgttagagtggatttttgtgtgccatccaacatctctctccacacttagtatgaatgaaaataatgtgatctttcagccaagctgacattccaaggtcagcttttagacggggtctcactatgtcacccaggctggagtgcagtggtgcgatcacaactcactgcagcctcgatctccctgggttcaagtgatcttcccacttcagcctcccaagtagctaggagtacaggtgcatgccaccatgcccggaaaaaattttttttttgtattttttttagagatggggtttcaccatgttgcccaggctggtcttgagctcctggctcaagtgatccactcacctcggccttccaaaatgctaggattacaggagtgaaccaccgcgcctggccccaaggtcaactttatggtcaatgaaaacgcctggcccagaaagtctgacctaatgtatcctccactttaaagagagcttgcttctccctgttccttattgggaacattgtgtattcaccatacacactatacagactgtcagattggcagtacacgctgtttcccgtaatgtggtggacacaatactcatcagtaaaggtacctgctggcaccttctggacttagggaatgataactggggctatcattggactggcagtgcctcctagtggccacagctctaaagatctccctccaactgaaaagcagccagggcagcaaaagcccaccaggcaacccctgccttaccctctcctttcttctcagtcttgtcctcatatcatgcagtgagaagtcggtgctgatcaggctatcatcatataccagtcttttcagtatttaactgacagaattcccaaaaatgacgtggcaatgaaaaaaattgggaggagggaggaaaggtagggaatacaaatagaaaaaataatcaagaataaccttagagtaggtcattgtgaaaagtgctttgtaataatgtggtcattgttgttccttcccatcagccctgtgggagctctgacaccccattaagctttatcaagaataatttcagatatgttacaaagatacgcagagaggcccagctggtttctccacaagcttgtattctgaaaagaatacacatgatcccaaagatcgtattttaaagtgtatatgcttcattaaaatgaaagatgataaatcatgtctacaagcataaccttgagattactgtccttaggcccatgctggtgtggggtatgcaaatgtagattttgatctgggaaagaacacctctggcaactgtagaagaatcgggaaggctccacttctctatgaaaaagaccctgtaatggataaggccatgccacaagatgaagtggaaagtttgttcctgctccctctgaactcttctgtatgctcccgtggtctccagggcattctctgtcctcatgcagtgtcttgtctcctctagggaccccttccaacagtaccttcttttccagacaatgcccacattccagtcctttctctttcctatttctaccttttcttcatcaaaatacatttatcccatccattctttcagggtcttgatgtatgttctgataaagtagtttatggtaagatttaaaaagcaggtcaccacccattgttctgttccttccttagacatttgcattttaactgtggactcctgacatccttaactacctgggcttggaagccaaaagtcttatctcccaaatacacaccacccacctccattgccccccagtggtcaatcccaaagatgacactgttgagacagaatgccctttgcttccctgagttctgtttgaacgtccccacaaatgacacccttggattgtcactgcattgaccaatgactccacgtaccagagtccaagggctttggtctggggtctacaggcaccgcattctgacatggattccttcaacccacaaacagagaggggtaacccaagaaatacacaagccctctgggacagagcagtaggctttctctccagtgattgttgcttgccaacaaaggttttggatatctgtggaatattccaaaaggagagaatctggcaattcttcagaagattctgggcaattaaaattcatcgagttcagatttttaagagttagagggagaagtgaaaggtaaacggtggcaacaattagggaacattatgctgcaagcctgacatttatgatgccgttgacttggtcttgtccagcaggtttcttgggtttctcagaaatttctagaatatgcacctcgcatattctgggagtcaagaactcccaggaacagcccaagtcctcctcctctcacccccaccgtcagccctttttcccctcctcccaaacctcccacccactgtccgcgtcagcgccttcgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcagggtattctctttatttcagtagtgcatgcctgaggcgcacgggaaacccgggacctggactcgtccattgtgcatcatttcacctgtgggacctgtgcatgctttataccccagagctttgtgttggggggtagtaaacctcttatttcaagaatcaaaatggatggtgcttggttgttgtttttttctttttttttttaaccccacccccacccctttgttttcttgttgtaatgctggtattttaaataatgcatcaatcgcctcctccgggagttcttttgggatctgtgcatcattcagtacttgtttaatgttttctcatccccggagttaaagtgctttcttattgttccatgcatcccagtgcatttatttctgcccaaaggttgaaatctcctggcagaaccattaactgagagggctggagtgcatccttttaagagggacacacccatttcagggttgttatttgtggtcacacaaaggagagtggagatgcagactagctctcgaaatcctgaaaatatgatggcgtagccacatattaggatggttcactttgaaatatttggggtttttttctgtcattggagtaacctgtgactactatttattaataataggtatctgtgaaataaatggagggaaagaacgaaacagtgcccgtggcccttggtataacagatttattttggaatagtccatattagcactgggtgtggctaccctccagcctcgcttggattgcttttcagccatttttattcagcctcacacttcacacatccatctctcctttgttacattaaaattcaccttgcagttacagagtatgaggagaaagataatttgcaagaatgaattgtgtgtagtaacttgggtgtttgtcggaggtagtgtcttttcatatttaacaaagatggttctgaagaaggcgcgtttaatttaacctgcagggttttgcagcatccctcaggagaccaagaatactctggagcagcagctgattttgtaaaaacctggcatcttccccttgtaattctatatcacaggaaggataggatgtccttttatctttaatgcctctgtagggttttgcttcggtatatattttaagaaaaagtaaacataaatctcagaattaaaagcctgcttaccttgcctcttgtttgttggattgggtggcaatgacataaaatacagtcgtctacttcaaattatgtgagtgttggaaataccgttgtcaaaagtaaatcgatggagctgataaatttaaaagccagtaaataagaaatgtatgccagttgaggcacaatgttttgaagaatgatgacaattacgtggaagaacatatgttcaatatagaaggcagctgtgaaaatattttgtaacattttattcttgttctgtgtttagatccatccagtttatttgatatacacacctgacaaacaactatggcttggtataagatcaaatttagttggacataaacactggattttagaccatgattatgagtttctagtatttttaacaaaagtagatatccaaagatggcaggttttcttttctatttgtataagatattcacaaaatcttatgaattaaatatcttaatctatttcatcacaatcttatgcggtttgactcggttgcctcagtttatgtctccgaggttttaaaaaaacacatggacttttatcattagaaattaacacaaaatgtcatagtttcgccattgaagacaataatttttcatttctgatgcagagctacttgtgaagattaattgaagatcattgagaatcttttatactcagcgacctttggtcatctttagtaccattgatttccttttgttagatggaacaaatccattatcttgaaaattgactaataagtaactgggtgggaggacttatgagcacaaaagagaaattgtaaggagtgaattattccttttttttctcctcactgtgagaacttttaaccttaacagaatctacattgaggttttgttgttgttgttgtttagcatttttagtgtatcctcttccctttagttcccttattatcaaaaacagttgtgcttaaccctgtctgcccattagaatcacctgggaagctttaaaaaccacgaaggatgcctgggccccaccttttgagattctgattcaattgagctgagcatcagtattttttgaaaagctccctaggtgagtttaatatgtaaccagggttgaagtcactggaatattattattattttgtagagacgttgtctcactatgttgcccaggctggtatcaaactcctggcctcaagcaatcctcctgcctcagcctcccaaagtgttgggattacaggcttgagtcaccatgcccggcatggtgtgtaataattcttagtgagccaaacccatagaccagcagaggtccaggataccaatttaaaaaaaaaaaatgggtgtgatctagaagcagctgtgaatgcagtggaaaaaggtcagtgcaacactgttgatgatgtcctccagaaggattaggagggacaagttttgcttggaaaggaaataatgtgagctttaggttttcttcatgttattaaatactacatggagaaattgcagcagattgaatatttcatgaagactccactgaaactaattatagtgtgccataaacactgtagtgcacatgcagaaggaaccttatcaacatatataatttcagctacagacaagaatgtttaaagaaagggaggctaaagtcctccttatatatactacatcacaccaattctgcttctaattttaaaaagttatactaccaccaaatattggttaataaatcaaagcacattctactcagtgaaaacaaaatgagaattaaatgacaacctagcaaaacacctgtatagataacaatcttacagatcagtaccatcctacaatttacaggactctttactgagtggtttgtttgaattactacatttagtccccacaaaacctgtgtggtgtaagttttattattgtcctcattttggaggggatgactgaggctttggtaagggcacacagatagtaatgccagaggctggctgcaagcctgggctgtctccagagaccctcacttcccactgctccaccttctgccgctgaggttgatggctttttcctcaatgatttttctaaaggtttaaattatctatgtaatggtgattgtgtaggcttaataaccccttcacatttacaagtcttcattttgccagacgtcttctcatttgagcttttcagtttactcttggacattatgaggctcagaagttaactgacttgcccaaggttttttggtagcagattgtgtagtaaaaggtgattctcttggcttcaaatccataactcctcccatctcagcactcactgcctatcttactaacactaagttagagaaagtgaactctcatctacctcatctgagatattttcacagacattctaacctttacaaatacaacaaaatttagcagcaaggccatgatcttgaccaatttataccatggttgtcactgtcatcaccaccatcatcaattcatcattctaaattctccgtaaatattagctacgtgccaggtgctgtcctaagttcttgttacatacctgctttaattaagcctccgtgagactttttttattactctcatgttataaaggaggtaactaagggatttaagaatgagaggggcagcagtttgccccaggacgtaactgggttctgaacacagaacattatgatcatgaagcctattcttttaacacttcgactgtactacccaaatccgaatggtgttgtactaggggaacaaagtttgattagaaccatgcatccacatgattctgtttgttctctaaagatcattttttctccccagatctcactgtactcaacaaattcacctggcaggatgcttagtagtatggttgattgatacatgtgtgcctggggctagaggtcacctcccactttactctgcgtggcagcattttgtagttacagattgccagaatgtaagttattgatggaagatgaaacactttccagagagcataacctaaaggcaatctttttttataaaatattttgaaacttttatgctggtctacagtgttcgtggaaacacttcaggatagtctgttctgaaaggagctagtctgaaacattaaagagctaagcattccagaatacaccgaggaaataatctgttttagccacagtaattgaaaaaaagcatgcctttgggaatagtatttgggaaagacattttacacatatacataaaggcagactaatatcaccttttatgaaaatcagcattttatttagacccattattattaaagtattatacaaatattacaatgtaaatattaacaattgcagactccctggctctaaagattctaatgggatccaatgggaaaactgccttagctggggagaaggggattttttttcccccttagtgaaagaaaactcgtattatgcagataatataccaaatgtaggtaatcaatcactccattgaaaaataaagttctttttcaaaatgtattaacattttcaagaaaaactttttaaggaaatatttcgaactttgggaggggaataatggctttatttttttctaaaaatgaggaaggcacattatgaacattttcatttgtacaaagagaagttcaaataaaagccactaattacccaaaatcctaccacccagagttaatcgttgttaagatttgctgaatattatctagatattgcataaaaatgaaactaaagggctaggtaggcaacaaaaacagtgttgataaaataagattgaatatgttacaaaaagtatttaaaataatttaacggaagaagtggacatgaaactgaaagaattgtggaacgtcagatccatgtttctttactatatgagcttttctttcctggaaattgagaaaaagactagataaacatcaaaaggtttgaatcatttttagttacatgttgcagttttagaccctacagagggacactctgcagtgtccaacattttttttaaagattcattgtgggttagaaaggttgacgaaatactgatctaaatttacatcttcaaatctattattgttctcagatttctgtgaatacttgtttcattaaaaaacgataatcctaatattctatgacaaaaatattatgattactatatatcaatagggattgtggatgacatcgtccattatagttaccaggcccttccttcttcatcatttttaaaaagtctctctttccctccttccctccctcccttatatttgaaatgataatctgtacacagttatttctcatctttagaccagttaatatgttctggaacagaatgtgaagtaattggtatattttaagttaccttataatagaattaaattataaaatccattgaatccaagaaaaccagatctattatgagttgggccttcagtggttagctttcagaataacacttttctttttgaaaataattaaatgtttgtcacaggcaaatttctcatcctcctaagttgtgtgcatgtttgcacccatgtattgttgatatactgtcacctttctagttcttatgaaagtacaggccaggcacagttggctcacgcctgtaatcccagcactttgggaggctgaggtaggtggaccacctgaggtcaggagttcgagaccagcctgggcaacacagtgaaacttcatctctactaaaaatacaaaaactagtcaggcgtggtggcacacgcctgtagtcctaactactcgggaggctgaggcaggagaattgcttgaacccagggggcagaggttgcagtgagctgagatcacgccattgcactccagcctgggcaacagagcaagacgccgtctcaaaaaaaaaaaaaagaaaagaaaatacagccattcaaagaaatatggctgccttataattaagctcataatttgaaagctaggaatttgacattaatgattctttaaaagccatcttctgcctaggtgacagttaataatgctaactactttaaatcttgataattaaaattatattccaaacttacagcatatatttcaaataagaaaactgttaggagttttacaacttaaaagtatagtgttctatttttccaaagtatgtttgagctatatctttaagttcaagctgagcaaagttatcttattgtttcatgaaataaaattctaaattcttccttattttatatgttgccaaaggaaaaaacataatctcagcattactcttgagctctttgacaaagctggtgttaatgttgaacaaatgaaaagcacaactataagttttaatttttagaaagtattgcagttctacacattttacaaagaaaatgctttaaatgtggtcatattttatcccctttcttcagaaatatttcaccaaactgcagattggcaaatttcaaatttggtgataattggcatcaagaagaacataatattttattgaatggaacagaggtacaatgagaaatcaatccttttgtctttttagttcaagaaatatttttgctgttatcatcttggcccaaattttaaacgtattcattttttttaaaaaggaaccaacagctgtctacctcctggttcttttctattccactacaatgatgggttttaagaagggatgacacaatcttaagattttgtggctaattatggttgatgaccaatagaccaaatgaacagtttgtattttgatgaggtcaaaaagcttaaagaaatagtacatgaagacaaccattcttgagtatctcaaaattatttcttcatgcctcaactatcacatttccaaagcccgtcttttcctccctgtgaccatctcttcctttgatcccggttatcctgtgaagatccctccaagtgagccttggctttacaagaggtctaggaggaggaggagcttgcccaactgtctgaaattcacaggacctgttgtttcacttcctgggcaggcccaccccaccatggtgaccaagggcttacacatcattatgttaacttgacagcttggaaagaatgggaatgttctagtcctagtggttagacctagcaaacaggaatcacattcatttctaaccaaggaaaatgttaagccctccataaggataaagtagtttttgccttcagtccagcccgaggaggagtcattcgggaatagtataattccttttgtctctcgtggaagaaaagcagcagaaattgctgttggctgtggctttgacactgaaatccttcattttcctttgttccaccaaagctcatttaaagtggtggattaaatgctatgctcttttactatctatagaaagcaccaggcttaatgtgtctttcctttcaaaacatccacagaattatttaagagtctagaaatagtgttggcatttttctcttgacagtcatataggttgtagttaggaggtgtgagggaagggctggaaaatgaaatcaaaggtgtcttatcagcagaagtccgtgccagcagttttccctctgggctcagggctcctagattaccatgtgaaccttcaactgatgtgggatactatcttggtaaatgaaactcatgactagaagatgtcatctttgaaggtctctatgtttacatctacttctgttttctttctccagtttaatgtcaaacgagggaagattaaagtaggaaaaattacttctattttttcttgttaacattttgtggtgatattttgtttccttcatgaaaatcagtcagaaaaaaactggctcttaatcacctctttggacactgggttggaaacaactgaggtttgtctagccttcttactctgtccacaaagtagtcaattattgtagttaaatcattggaagcttgctaaaaagtaaataaatttcaacagcatatcatttttcaacagtccttttgttgaaatgctgatattatcaatgaacaggaacttgtcacattttctcacttggcatttacttatttatttatttagagatggagtgttgctccgttgcccaggctggagtgcagcggctcgatcttggctcactgcaacctctacctcctgggttcaagtgattctcctgcctcagcctcccaagtagctgggatcacaggcgtgtgccactatgcccagctgattttctttttgtatttttagtagacacagggtttcaccatgttggccaggctggtctcaaactcttgacctcagatgatccgcccgcctcagcctcccagagtgctggggttacaggtgtgagccactgggcctggcctcacttggccttttaaaaagtagcattaatttgtcacatagcaagtggtgtagtgctgcctgaagtattttctgggccaagatggaataaaattacacagttaagaatatggtaccataatgcagataattatgcacaatttattgctattttatattatccgcttatatcacattttaccttataaataaaatataaatagctgcactacttgtcttttcagttcatacatttttaataaactttctgaatactgtggccactgttgggccatttgaatgcatttaaagtatttttaccaaaacaaaaatttggactacagcaaaggactttctttctagaaatttgacataggatttaatttccacttagctattaattcaaaccttggatcacttctcttattcttcttttgttattgattggattctagaaataaggggagcactggtttgatgttagaattcttcaaatctgccacttcacttttggccaaatttattctaagacagtcctaggcaggctgcagtgtgtgtgctcatagctgtggtttgaggactatggtgatcaccaagcccagttcctttatcaaattgataggacacactgatctctcatttcaaagccaatgtgtttctcctcagtttttagcaaagtagctttaatttttacaactggcaaagcaatatagtaatatgcctatcctagtaagtattcttagttaatgtatactcagatgttgaaactctcgcctggcttttctgcattaggaggatattaaaagagaaaagctgatcatattttgttataccagaagaccactgggggtaattaattccagtaacagggttacttatatttttcttacttgggttctaaggaaactttattcaaatacctacttttctggattgggtagtataaagcttcctacgcaagttgataccactctaagcaaaattaaaatgtgaaaaattggcatttacacagcagatttggaatgcagaaattctcttctctgatcccatcacctcctacccttcccactgaatcatcagaacttcaggccatttcctggcactctgaccacacatggccattgccactctcccagcctatcagtcaccagccatctagactgtccgtcattcccagcctgaaccccagggttgttcatttcaattctgtcctcttggaccttagagtcttctgatcatgctccttgtgcctcttcacagccctggaccagccccaccacccattgatcagaacattcagcatctaattctattgaatggatccccaagaaacccttgactttaaccaagccctcttcactttttggcagtccatttattcattcctttttgaagccttattgtatgtttctataccagcactgtttaatagaaatataatataagccacaaatataaattttctaatagccacattaaaaagtaagaagaaataggtaaaattcgttttgattatatattgtattaatagatcaaaagtattagcctttcaaaatatcaatacaaaaagaattaatgagatattttacatccttctttgtactaagtctaagatccagtatgtagttgacactacaggacatctcatttgggactagccccgtttcacacacccagtagccttatgtgactcattgctactgtattggacaatgcaggccttgacttttcctaccctcttcaagccccgcccttaatctacttagtctcaggaacctcttgactcattttccagggaaaattcaagttaatttccctcattatgttattttaccactttaggttatttccgttccacctcaacacgtatctgtggccacaactgtaacttcccaaaatgtccttccatctttacctatctcttttctccctccttctttgaaaacaactgtgattaatcccattttttccttccttagtggagactttgcttcatcaagtctgttttccaaaatcttcacccctcccttccctctaacattcctaggttttgctcaacctaaaggtttacttgttgctactactccccaaactaccatcttctttattactttgaacttccccccacccagccccttacgataaggcttccgtccccactactcatagcagtgccccctgcaaagttatgaatgaccttcctttcagtctccaaatccagtggtcctttctacatttccatttccttgttatgtctacagcattccacactgtagcttaccccttccttctgagaaatgtccttctccttggctgccataacctgcactattgtggtgccctttctagcaggtggacctctcttttctctggacccacttattcctttcaatcccaaaggatggtttcatcctagactgcatcccttagcctaccctccattggagatttcctccactctcatggctgcagtcatcgtttccacatagaatacacccaaaagtaaatgttcagccccctgtactaaattttagccctgcacttccaatggcctactgtacatattcatctgaatatcattggatatatgatattaaggaccatgttaactgagggctactgtgacagagcctaaagagcaagtcatttaacttctaagcttttaaaacacttagtaatgtgtgcaattgtcagcctcatttcatctctgatctcatctctgccccaggctgtgtcagaatgccctgcttagatgtcatcatgtcagaatctggagatttaaagacaagtgtcagcttttccccaaaccagttcaccctcagatttcctgtttttggcagtgatactaattactcagtcacccagctttgaaatgctgttttcacccttaattagctcttcctcgtttctcccacagttagtcaccattcttgtcaactaatcctttgtaatatttccttttatccaccccatctccttaacaaattgtccgccacactcacataccatcccacatcctctttctttgtcaattctagtactatctcttccttaaactcaacttttgccacctacaacagtacaagatgtgttggcatcgagacaacatttgtcaaaagattgttcaatattcccagctagacctaaaattccttaaaagcaggatccaaattttatgatttcttcattcctgtgcttacttagataataggtgatcaataactgtttactattgaaatgactttttactcaaagaaatttctctttaaatatctagttctaaaagcagttttaaatataatcagatttccctaaactaattttacataacttttggggacacttaacatgtaatgtgagagaggcaactattttgttttggaagaagcatcagatttagggtttgatcctgattctcctattaactagccaagatacaagtgtaactgcccaaggggttcacctttcctgctgcctagacagagctgattcatcaagacaggggaattgcaatagagaaagagtaattcaaatgagtctcactgagcattcagggagcagagtttttaaggataactttgtgggtgggcggaagccagtgagccaggagtgccgattggtcagggatgaaatcataggaagtcaaagctgtcttcttgtgctcagtcagttcctgggtaggggccacaaaatcagatgagccagtttattgatctaggtggggccagctgatccatcaagtgcagggtctgcaaaatatctcaagcactgatcttaggagcagtttagggagggtcagaatcttgtagcctccagctgcatgactcctaaaccataatttctcatcttatggctaatgttagtcctgcaaaggcaatctagtccccaggcaagaaggaggtctgctttgggaaagggctgttactgtctttgtttaaattatgaactaagtttcttccaaagttagttcagcctacacccaggaatgaacaaggacagcttagaggttagaagcaagatggagttagttaagttagatctctttcgctgtctcggtcataattttgcaaaggccgtttcaatccttcccttgggttttataacaccttaatcttaaggagtaggctgtgaagatgggacaaggccattgattgctctggcttcttcctgctgacaggggatgtagtgggaatgggagtgaaccccaaggtgagaagagtggaactgctttgcaactgtctgagcgtactcatgcaggcctggctgggctttcaaggtttgcatggcagaaacagtactcttatttatagttttactacagtgtttaagtgaacagcctactataaggtaaataatgagggctaggattaggagtacaattaccagttttaaaagcaaagatttgcttctaaccctcaaagaatttagaatttagtttaaactgcagaaaaaacctcaagaacagctaacaacagtgtagtatagtttttcttttgaatcataatttttctctctccagtcatcatttttattaaaaacaaatcaagaaatggtttgtttataaaatgaattttactcttactgtacttggcctgattatttgcataaagtacagcaagagtaattatttttcatgtaagctttttcaattggctttgatagaactctgttctgttaagaactttagataatactttttaaaagctgagcccagcaatgggtttataccctttaatacctatgaggtgggaaaattcctcttctcttgaggtcccaaaataacttggggttcctggccctgttataaagtgacattctttacttaccacaggtcaggaaccttgtacagggactttgtgaacaaggtatgagaacagattccccaacgggctttaattggctttataagtcaactttgattctttaaaggaagcgtgccatttcacttaaagccttggtaaaataaccagtttctccaaatgtgtcctgttagaaaagaaaacagattgttattacacttatgcaattaactatacttccataaattgagaatattaacaaatagttttcaaattctggagaaattaggtagagaggaacaaatgtgctccaaattttgtttataggagtatattttactcacttgttagaagttgcaaatagctctaaagaaataagtcctcctgactctgaaagaaaaggtttagcaatgtttaacacattagctttccatgagagccctaaaagtttgttcttttcctctctttcaatagcacaatttttaaagttatttgagacctgcacttaagagtcgtatatctgattataaactgccttttgaaaaggaccaaagcaagacaaaatgtctgtggatgacaaaaggctatagccactattaaagctacaattatgtagcagttttgtttacttttgtggcatacaacaattttacataacaattataattattaataatgtgcactaaattgtatcaacattatagaagtttcccataattttggaacacatactaataacatttatataaataaagtccaaagtaaaccaaatgccacttagtcttctatttgaaacattttcctctattttaatgtcacaattttcagcattattaattagaatcctgcatttaagagcacctgttaaatttgatagctgattatgaaacaattttcaccaaaatgagacaattgtctgtggatgataaaaatattttaaggcagccacagttaaagacacaattgacaagaaaatttgttacctctgtggcacacagtctgttaacataataattatgatgattactgataacatatactaagttatattagaataacaggagttttgcataatttcagagcatataccaataacgcatttacacaaatatagaccaaagaaagccaaacaccatttcatatttgacaatgctttctgtatgatttttgtaccaaataagccaaatgttatttttggactttagaggacctaatatctaaaatattaggtaaaaaagagacataatttataatttgatgttggaaagtttgttaaatatcaaaggtttaaaatactggttatcacaaaatagaatcctaggttaccatacgtaattcatttggccaaaatgataactccaaaaaaaattttaaaaaagaaaaacctttactctaatagaggagacttagctttccaaacaagatgcaatgaagatagcatgaggccaaataaatctatctcttttctttctttcctcctttttttccctgccatttacccaaagaagaaaataagacctttttattatcttttaacattacataaaaatcatctttaaaagagaaaaacatatttcatgtttgcattcgtgcattgttaatgttaaagctagtgtttttaaataaaattttgtatctttattcagttttaattagtttgaccatagggtaagattttcacaaaccctttagaaccctttacaattttccattaaacagcagatcaattttctaagaaagccctgttattcagacacatgggcccagattcaggccccacatcagtatgattttgatgtttgttgttgttgttgttttgtttttttttagatggagtttcactcttgttgtccaggctggagtgcaatggcatgatctctgttcatcgcaacctccacctcccaggttcaagtgattctcctgcgtcagcctcccgagtagctgggattacaggcatgcgctaccatacccagctaattttgcatttttagtagagacagggtttctccacgttggtcaggctggtctcgaactcctgacctcaggtgatccaccaccctcagcctcccaaagtgctgggattacaggcatgagccgccatgcccagccgcttttaatgttttaacctaaggaaaaaagctaaataatttcttttaaatattagccaactggtttatacccacagaatttttacaagattaaccctttcactttgcttaagccttcagttttgttctgttactcttttaggttaagacaatttttaaaaccctcagaactagccaaaattacattccctttaacaaaagctatattcccatgccttcttataatcttttaccaaaaacacattccctacataccttgtatgtaaaactgcttcttcagtggtctcaactacatattacaatgttaactgttagcaacttttatttttagtgaaaaacctgataagtaagagattttaattatctactaagggtggagcctaggacatcggacagaaatgaagatctgactcattttagcatagctagtggacttggctttccgtatgtccccaggccttatctataatctgctccaaagtaggtaaatcgaacaattttcaaaagtcaaagaaacagcttgaccttaaagcatttagcaaatttgatatttgaccttaatttagaccaaatgtctacattttcaagacattttattttaccaataatctttaaaactgtctttatttcccaaagattcctaaagtcacgtgaacaaaacggcattaaagtttctatttttctgacaaaatatttgatttaagcacttatgtttctaagccaattagagtttttttatatgtaaacatacaacacatataaatacacagacaggagatttagcacttgtgaaatttttcatttgccagtttcttaattggatgactggcttcagggtggagcccttggaggagcagggccaggaaaacatgaatttctagggccaaataagcagctgaaggcaaagacagatccccaaaattaagggtaccattttataccggatcccggatccccaaaaggaggaaaatactcaggagaagatagtgcaatgcttctaccctgcattttattgcaaggtaacccaaagccaatcagcccattttgtaatcagcccatctctcctgggagtctcatctcccagtgggggtagtgggggcgttttcttgtcttccaagtagccaagagcatgcttctcctatccaagtgtgcaaagaattaagtatccctccataactactattagccatcccttatatttcctacctaattatcataatacgaagtaatttctgatacccccaaaactcaaaaccatcagataacagtatgcaaaacagaacagatcctttaattttgagagggatttatctgcttttaaattcctggggttttataaggaaatcagagggttttttttttccaaaacagggtatgtggtgcctcctctgtttttcccaatgaatctcaggctaccagaagttatcttagggcctctcatgagtgctttaagaaggacaagacaaaaaaatggagaaaaataatacagtcgactgagaagaaaaatcctttttccagaaaaacaagttccaagaagagaaaaacataaaggccttttaaatatatctataggccgggcgcggtggctcacacctataatcccagcactttgggaggccgaggcaggtggatcacaggatcaggagttcaagatcagtctggccaacatggtgaaaacccatctctactacaaatacaaaaaattatgcaggcgtgtttgcgcgcacctatagtcctagctacttgggaggctgaggcaagagaatcacttgaacccaggggacagaggttgcaatgagctgagatcacgccactgcactccagactgggcgacagagtgagacaccatgtcaaaaaataataaataaataaatctatagcttgtttatccacttttaattaaactgacttttaaccatagtgctctttaaagaagaaatcctttcatatttcttattacctgatgttagccatgccaagtggccaatatttttactttctgaactttaccaaaggtaacctcctaggtgcttcaaaggcatggtaaacagtttctttttttataagatttagaatttccgcaaggtagttcaaagaaaggaaaattcaagagaggaaattagaagctaagtatggggggaagaaacctcaataaatggcaaaattacacaaataaaccagaaaggaattattccagaagccaacaattgaaccccggccaccactgtcaaaagataaagccgtagctactgagctatacagcattaagcagtttctattgcttttcccagaaggggcctagagaagcaaatttcaagcttggaaagcttttaactgcccaagaaaaatttttaggactaattatgacatgaaccccaaaattcctgtcctctggatggtggaaaccaaaagaaagtatccccgcatggtcacaaggttaagctcctaaggacacaaaacaagacagaaattttatacagtactggtttcagggacctgtagcaaagtttgtaactgacgagcctgccaagctggcttgagaagcaggcttataggggttgtaaacccacattctatcctgcaataccccctctccgttacagaacacagaaagacaaatttttagcacaaagtacacaacatttgctacagcctaagactagtttcacaaatccttttttctattaatcaaaccttgcggaggagaccagtaatttactgttttacccagacagagaaagggagagagagagagaccagaaacttggctggtaagaatttcttaccctttttgctggcataccaggtttctgggttccttttctctgcagcttccagaagaatggagtggcttctgatgaccctgctcacttgtgctatagcagtggggttccagccactttacaagagaaaatcaccctttactgttttatggaaccacaggcaagattcttaattttcaagatgctgcccaatgggctgcaaggggaaccgaattaacattttccatcccagcaaaatacacataacaaaacagacattagtcacctcattcagcacccaatatcagcctggaaaagctgaaactttttccctttggtccctgttgtctttaatccactccaggtggggacagatgacctccaaatggtaattcacaatggggtctctgggcaaggcaaaaagcagatagtcaccccaagaggcctgttgagccttctttggggctcatggaatgtgaccagataaggatggttccctgagttaggcctgctggatttccatcagcaaccgtctctgagatcccttccacatatacaaacacagacaaagaggagatggacagaaggccttccaaattagatccctaaccaagaactccaagagtatcccttccaaactatcctcctattctctgtctgagaaacctcctcgaaatcttcctgattgaggagaagtctcccaaaccaagactcttcatactagttagaaagaaccaactgagaccccccaaattgcaaaacagacaccctgcaaatgaggctacagacacagacaccccatggtggagctagaaacagacactccacgatggggctacagacaccccccataggctacattaccagtcaggagaagaaaggaggcattggcagcacctaggatactcaccaatctggacaccctgcaatggggctacagacagacaccccaccatggggctacagtcaccctgtgataaggcaacagttaaaggacatctccccaggactatttctccattgcaattaaattcatgcacattgggtcagcagtgccacgccagtagaaagaataccagagtcagccgccagtccaagagaactaggaggccacttgggctggcttctggatccatcactggaggggggccattgaaccacaggcaggtagccacaagggcaatcctggatgagcccccaaatttgtaactgcccaaggggttcacattgcccactgcctagacagagctaattcatcaagacaggggaattgcaatggagaaagagtacttcacatagagccggctgtgtgggagaaccaagttttgttattactcaaatcagtctctctgagcattcagggagcagagtttttaaggataactttgtgggtggggggaagccagtgaaccaggagtgctgattggtcagagatgaaatcatagggagtcaaagcagtcttcttgtgctcagtcaattcctgggtgggggccacaagatcagatgagcctgtttattgatctgagtggggccagcttattcatcaagtgcagggtctgcaaagtatctcaagcactgatcttaggagcagtttagggagggtcagaatcttgtagcctccagctgcatgactcctaaaccataatttcttatcttgtggctaatgttagtcctacaaaggcaatctagtccccaggcaagaaggaggtgtgctttgggaaagggcagttaccatctttgtttaaactataaactaaatttctcctaaagttagttgagcctatgcccaggaatgaacaaggacagcttggaggttagaagcaagagttagttaattagatctcattcactgtctcagtcataattttgcaaaggtggttttacaagtttaaaagtttagtttcctcacctgtgacatacctatataatggagtttattctgagatttcagtgagataacatatgagagtgctttgaacatttcagaatcaatgtaaatagataatattgttgcaaagtgtccagaaccaacagcctgttgttttaagataacagtccttttgttaacctccttattagaaacctcctgcaatcttagcaagtaattgaaagatctgctaagagacgaccctacaccaaactcatgttacttagctaatgctttctgcccacagtttcttcaaggaaagtccatgaagtgcctgccattcacagacttcttgagcaggtggcctcctggttggagatttaggaggcttccctagagggcatgccatttctaccaggtataaagcaattcattcagaggggattcacttgaaaatagcaaattctatcttctgtttgtctgaaaactcctttcaggctcttctgagccccttcacgtctcacaagtgggtaagcatcttccttcacactaaggagtgcccccttcagcacaaatcattctgtcttataatgtatttgtttccaaatatgtacgagcatcataaaacagattaccatttatttcttatccatttgtgtgagtgtgtgtttgttttgtataattcacttatttttatatccccacctccagcacaaagcctggcacttagttcctgctcaataaatgaaaacagatgtgtaagaggtaacacttcagttagtggtgatgctttagtttccttttaattcccatttgcccctcccctgcacaaagagagtaaatacctggaggccccggaccgtcaaagacctttagccctgctgccttggctttagacctttagcctaggcttgccccaatttattgtctccaatccattcaacccaggagctgctgggcttctgtggagagccccttttctcccactctgccctctactctcagagttccaggggtttattgcaggtcatgtcttccaaaagatccctcttctccacctgaaaaagattatggcttttggtgcttcattctaaacaaacccttctaaaagaaaaatcatttggtgaactcattcatgttttgttgttaaggacaagcaaatctttaacacattattctattctagcatctttgcatcaaaaaaaaaaaaagaaaaggattaggccaaatgaatgaatgaatttttttttttttggagacagagtttcgctcttgtttcccaggctgagtgcaatggtgccatcttggctcactacaacctctgcctcctgggttcaagcgattcttctgcctcagcctcccgagtcgctgggattacaggtgcctgccaccatgcccagctacttttgttatttttagtagagacggggtttcaccatgttggctgggctggtctcgaactcctgacctcagatgatccacctgcctcggcctcccaaagtgctgagattacaggcatgagccaccatgcccagcccagaaatgaatttctaatggtcagacagtgtgactggggtcaggatagggagaagagagaggctttagagcacagtactttttttttattttttatttttgcctctggaaacctatttgtaggaccagtcctactcaaaagagaaaaaaaagatctgtttcacccccaaaacatgcttgtgagcctcttctctatttcctacatggcagaaatgtaatagaggaaagggaacaaattttgcccaacaaaggtctgcctactggagtctttctgagttaatgtccctgatggaccaggtagtggtggtgggtggggagtttgtggggagtgaattctctctccggcttcagattgctgggagtatcctcagcctgttatgaaggagactcttttagacctgatttactctccagccagcctgaggtaagtctgtagccaaagagagggttagtactttactctgcaaaaattccttatgtcacctctattgccttgcattgtcatgagggcatgtgactttttcaatattgttctttcatgctaattacacacccatgtaaaatgggagtagctccctgctctcttcaacctgatcacttctgtcttcctatgagcaaatgactggagtctaattctgtaaaccaggtgtctgcaggtacactgcaggtgaagctagcagtacaaaccactaccacttacatttggttgtgagatgggaattttgcatcttatttctcttccttaaaattgattggcatagaattctataaaaaccatttgtcacatacccagttggagggtaaatttgcatagatccttcagtaagggttttatgctatttttttttatatcccgggactggaatatttaaagtatttccattttgcatgacatttgaagcactatgactactcttttgcatgtaattttttgtttctaagttgaaggagggtaataactgaatggtggatgcaatgtagattttaaaggtttcatttcagatttttaaatcacagaatgtaagcaaacaaaccatgttgaacaaaatggtttagtccacatgtcagctccaggggctctctctctctttttttttttttttaagacagagtctaaccctgtcacccaggctggagtgcagtggagtgaagtggtacttcacagagtcctctatattttcaagtttgtttcaaagtcacataattcaggccactgtatggatggtgtagcccacagagctacacccatcgcgatatggtcaatggagattcaatagtcttttcttatatgtgaatttgtgaattatcctcaagggtggaaaagattcttccaaaccaaagtggaatgacagtaagtgcccttggcacagccatctgtctgctcacttgtgtttaggaatccagatgccaggtgagaacccacagcaaccacagcttggtggagtgagccacagcggctcatgtggcggcactgcgggagctcagctgggtgtgtttggtgtctcctgcagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaagtgagtgcctcagctgaggagccctcacccactgaccaggggcttttaccctcacctgtatttcagctcacagatgcacttgagtcatgtttctctgagacccaacagacctcttagagtctcccctaacaccctgtctttgaatatctaacatttctggtgaatttctgaaacaaactcgattattcttattccaatacttattgctttgttgagttttcatatgtatttactattaacagtaatcataatccaacaattacttaatcctctcagcaatatcagaaaggcacagcaggcatttttgtccctatttacaggtgggaacactgaggttctgagaagtgacatgacatgctcaaggccaggtggccagtaaatagcacgaaaccaggactagggtatttgggtctttatttccatgctttctctagaagtttaacaccaaagggccaaccttctggtgggggtgcagggttcatgaacagtcttctcatgtatcctcctctacatttttatactggggaaacctgatttgaatgcacattgaagaggaggaaatacaaaaataaaagggcaatctactaactaagcggatatatgacatgtggcagagggaggtgttagcactgccagctgctataacaaaataccatagacagagtgcttgttctggaggctgggaaatccaagatcaaggtgccagcagggtaggattctgttgagggcccttgcctgggttgcagattgccagctcctcactgtgtcctcactttcactgtgggacggagtgaacaagctcccttgggcctcttttctaagggcactaatcccatttgtgagggctgtgcactcatgacctaatcacccccacaaggccccacctcctaacactatcacatagggggttaagatttcaacatgaatttggggaggacacattcagtccataacactcctgaaaactcaagccaaatactgctttactctttttatctcaattcacagggttaagtaagcacttaaagcactctagaaatatcctctaggtagataacaggtgcagtcttagagcagaggggaggcaggaaaggagagaggaaggatggacctctgtggaggagcttggccaagcagaggaggcttaagctggtatgatatatatatatatcatgtttttcccacccaagaattaaatttaaccatttgaactaatgaaaaatgtcattattaaaaataccactcagtagaacccataagtattttaatatggcccaggtcacttgagttttcaatgctctttctataaacctggaagtaaattctagaatttaaacatgaattcttagagatctgatgaggaacagttggcagctaggattttgagctatctcaactacttaaaaaaagataatttatctccatgaagtcatgtgtggagaattcagcaaatgagctgatttggcactaattttttttctctggtcccagctggtttctctgaattttcagcccacccatgctgtgtcttaggtagccagaaacagtcacaatgctccactgagaaccatgctttctgtgttctcagtgcatggaagcagatgtgtacggtgccctgtggccctcactggctggcataaccccccagagatgactcctgctctcaccctcagagtgagagtaggaacgcttagctgttactggggttcggcagcctgtctcatgattccctctgacggaattttctgtgggaatggtttgttgacagggcctacttggagcttgagatcaccctttctcaggagcagattcagaagtacacggactgcctgcagttctacgtgaacagcacacttaaggaactgaggaggctcttccttgtccaggacctggtggattccttaaaagtatagttgcttaagctgttcacttcacagtcttgactgttattttccctaaaggtgtaatattgtaaactgctacatcaagaagaataaaaagcaagtgctaattatattctggagtcagaagacctccagttgtatggcaccatgaaccagtctaatcccttcattgtaccaatgatgaaaatgtggctgagacatttgtccagggttgcccagtgagtcactggcagagctggaatcaaacccaggtcacatagcttctagctctatagtctttacaacacaccagattgtctccttaaaccatttttagttcctccgacaatttcccaaaattaatattaagataaaaaatctagatagggaatgtgaaaaccatatatacttttgcattgaaggaaactctagattctactaatattaatagtaagccctccaagtgtgcttatgtagttacagctctgaggctagaggtatgcccagcctctcacttgatgaggatcaggggcacctggggctctcactgaatttgctgggttcctttgaataagttgctttggcctcctggtgacttacacgtggaatcaaagttagtcaatcgtgattcggcatggtcataagcagagctggggaagcccagacaaggtagttgtgaagtttctgtgctctcacagcactttatacacaccctggcaggggcttgtactgggagctgtctggtaactgttcaaagaagggcagaaggaaaagtgaaaaatgtggtcttgaccctcaaaatgctttactggaataatgacttgccatataatgactgaagagagataccagggcaattataattacttaccttagtgcttttaaggccatggttgtatttgtaatgtaaaaattgtgggccagaacaggggtcagcaaaccttgtccgtaaagagacagatggtagatactttaggctttgcaagccacaccatctgtggcaccttttcaactttgccattgtagcacaaaagcagaaaaagacagtacaaaaaggaagggcttgactgtgtgcccataagacttctgaacactaaaaatttgattcaatatcatttcatatattagaaaatattaatcttgttttgattttatttgaacatttaaaaatgtaaaaacctttattaactcgtgggcctatgcaaaaaccggtcaagggccacagcttcgtagattattatttccttgagtccctcaaaccttataacaaagtgatccaaatagttccaagagaactaaggactggatcctctttcattgattctgtgatgagctttcaacgcctttcattgactatcgaaatcatgatgtattctgactcaaattcaaatctaggtaaaagtcaatgatatgagactctaacttgtcaggaagggttttaggagctctaataatgctttcgttcttcagtttgcagtcctgatgtggctcctgacctacgttggcgctctcttcaatggcctgaccctgctgctcatgggtaagagcagataagactgtatacgtcttccttcaccccctctgtgaaaacgctgcttcctaggctgtaagctttttgtttgtttaaagagattcctaggaacaaatgccagatatccctgagtgcagagcacttctcttaccatcatagttcaattaaagagtataatatatattatacactaataatgaattcctaagtctaaagggttttttttcttcaaacataactggcttctttctggcttgtaatatatatatttggatcaatatatatatttggatctgtttacagtggcagctatggatggattcattttcatcttgggaggggagagtttatcctaattctaggaataattacaaaatacctgtacagggctcagcatcattttattttccctatgaactgccctgtcatcttttatctagaatgctggatattgcttctcaaaatagggaataaaaaataaaataaaatgctgtatattccaaataatgctataatatcatataaccatataaaaatgtgtctataagcgtattcttattgataactcagaattttaatactatatttgtttttcatcccagctgtggtttcaatgtttactctacctgtagtgtatgttaagcaccaggtaagttctatgtgatgtcaaaaaatggcattgaattttgacctcatcatctttggatatgctcattattttttttttctttatgtaggcacagattgaccaatatctgggacttgtgaggactcacataaatgctgttgtggcaaagtaagtcacatagtgcaatgcataaaaggagagactctcttacatcagcatttgagtggattaggataggggtaatgagaagatagtaaaatgatagattgatttatggtcattcacttactggaatcatatattcattctcttctcaattatgttattttagaaaataagcataagtttttaaactctcaattaaattaaacccagtggtttattcaggtttcataataagttttaatgaatgcatgatattaagctctaaggactggcccatgtacaagaacaagatgcattggaggaaagaaggaaacttgattcaaaaaagtaaaattaacagtttaattcaaataaaaacaagttaacatttttaatcttttaaacaatgaatagcactaattttttaaaaatcatttaaattacttttaaaactttgaattatttttagaactttaaaatacataaaatgtttgccaactaaatacatcacaccattttaactcgacaactgtgtgtatgtgtttaataccactgctttttaaacctgagtcttcagccttactttatggctcccttatatattaggagatagagatttcagttttacatacccatagctaacatgatcattaaacttaggagttttccctaattcttacattactatttttaggtatatagtcatctaaagtgatagctcttatattgcattattattcaatattttgttttattaaaaagctagcctaatctttaactataaatatatttcaccaaaggactagactttttcacaaaaactctatctaattatctgataataatgtggctggacctaggtgagggtcagatttagagagaggcattttaggtagttaaagatgtgtaataacaaaataagaaaggccaatcacattaaagttcctctgctcttagattatatgtgatgtgcttcagttccctctgaagtttataaacttttgttttttactgtgtattatttacatttgtcctcttaaagtcattaggaactcatagggttctatgttgaatttggatctttgagagatctacaacacatttcaaaatgcctgaacgtatcagcttggacccagatgtaaccaatacctaatgaaaatcaacacattaagcataaaataatcattttattttgtattaagaaatggtatcatagcacagtatgagacttggtggtacccgaacctgaggagcctgtttaaaaatacaaatgctaagactccacacagacctatagaattagaatgtctaggattggtaacctggaatgtatattttaatgaactcttcaggtgactttttggcaactagaactgtgttcataaactatagcaaagaataccagaataggagtttggaaactggaagatagaagttctagacctaagttgtccaatacttagtttgagtatcacaaatcatacctattactttttcatttggtttgttggttgagtccaaaaagaggagtacctgttatgttctggacacttcatatgataggtacagagggtataaagataaatgaaatgatctcagccctaaaagagctcttagcccagtggtgcagacaaaattatacagaaataactataataaaatataataagtacagtagagctatatgaaatactaaagtcagagagatgaggaaacaattgttccttcctggacaggatagtggaaagccattaagataaggtggcattcaacctgggccttgaaggatgggtaaacagtcatcacgtggatgataaggggaaagacgttgcaagaggaagaggtaataaagcaaagacagagaagcatgaaaatgtaagtcatgtttaataggcaacagtcaaccagtatgtctagagcttaactgagtcgaaagatcaactggaaagaatgtaggaagagaggctgaggccaggtggtgaatgctctgtggagttttgattccaacccagcaggaaatggccaccccttgatgtttttaagcaggggattgatatcatcagatttatgttttttaaagatcactatggcagtctagtgagaaaagaattggagaggggagagactagagatgtggccatcagctaggaggttatcataattcaaataaaagtgacaagggcatggcctggttaaaatggagggaaaagagagatggcagagaatataaagtatatacaatgtacttgttaaattacaattggaaatcaatgctgtgaaaaggaatggaaaggaaatgttacctatgactaatatggcttctgtaattgagcttcaggcagagttggctctgaatttcctggtagctaggacaaaaagagaaactaggcaagtcacatggttctcactatctatcagagaggaggaaacaacaattcttccaaataacctgttttgcctggcactacattttgaaggaaatttcttggtgggatcttaactctaagtcctcttcaacctctgaaattgtaattccaccttagaataaataattccagcaaaagaacttacaccactttagtggtacagttaagaacatgattgttagaatcagacagactgagtccatttctggcatttttagctgtatgagctcatcataaatgttatttgactctatgagcctatttccttatctgtaaattggaaatgttaataccacacagggttcttggtgattaaatgaggtaatgtctgtaaagtattcttacttggatgtaggaaaccctcaatattatatatcattgtcatcatcatcatcatcatccgattactgcttagagatcggttcatggggcttggaggtagaggacagtcccagattgggccagtagacaccagggccagtctctcctccatactgagtgaccctgtctaggtcgtttcacctttgtttgtctcagttttccagcttaaaataggggttaataatgcataataacacttcttagagttttgaaaatgaggaaaaaagcctcaaatttcaaaaggcaaaataaacactgtagaggaaattaaagcttcgagtaagtgagaccataataagaaatctgctttaagtgaatacaattccctatgtctaggtgagttatgttttagaatgacaaagtagcttgtaattttacctagaagctctcttggtgacctttgataaatctcatggaataaaggacatcctgaaaactcaaattggaaaggagctgtcacgatcttcaaatgagaagaaagaaagattctagatgttatatttgataaactgaaggcctaatttcaagcaaaaatccagaatgaattagtaaaactgtagatactcagaatagatcagtgtatcttcactaaaccctgagatgagatggacttccctagccagtgagtattctgattttagtgggggtagtcagcaagtcttcttggtgtccttgtggaaaaaaatggagatgtatgatccagatgatagcacaggtggtagaattctagaagattgaaataatagaccctaaagatgttcattaatccatccaatatgtgtctggggcaaggtatgtgacacagggctctgcctttgatcccattactttcaaccccattacttctcatgactatgtgaagacaaatcaaatatctttgtcaaagttccagatgatgtacagtttgaagcaaaagcaaattcagaagatggcaagctcaagattcaaaatgaatcaagggatcttgagtaagcgagaatgccgaattgaaatcaataaaatgaaattaataaggaaagtgaagtcctacatttaggtttctaaaaagtcaactttacagatatagaatgcggcgagggatagatgagagagggtaacaataagggtgtatgtaaaaaatacctcgggggttttaattgcttgattggtcacagccaaatgtgagtcaatgatgtgctgaagcatctttaaaaaatcaatgcaagttgagttgttattagtaggagtacaaagtctaaatcaacataggcaacagtcatattatattccatattggccatcccatatctgtgttcaatttcagggttggacattttaacagatgcattaatacattggagtaatgccacaaagatgaccagggtactgtggtattagaaatctgatagtaatgggcagtgaagagcaaactttgctggggatgattaccctggaaaatagatgactttaaaaggacaccatagccattctcaaatacttggaggtctaacattgctaaaggagtaggatttccctttttctctcaagagcagtgaatggaaattttagaagttctgagatttgaatgaaatatgagggaaaagagtaatgattagagttgctcaataatagaaccatctgccccatgaaggagtgagtaccctgacattcattcaagtattcaaatagaagttagatggtcaccattgcacatgtcctctgctggcacctcttcctcttgtccaactcccttctggtcctgtgaccctaaaggttatctcatgtctagggctgcaaacttgtgtctccagcccagacctcttcaactaagcaccaggtctatccacttatttatgtaaggtttctctaaagtgtctgatagacctttcagattcacttagccacacatcgtgcaatctcaccccagaacttgtatttccttcagttatcacaatcttggtaaatggcattttcacctggttcctcaggctaaaaaccaaagaatcttccttgattactcttcctctaatcctagcctatgcattcagtttatcaacagatcaagtgggtcctgcagcctcatctctaaactaaccctgagactgttcccctctcttcatttccatgtctaccatacaatccaggcattgccttcaggtacttggactgctgtgggtttctctccctctgttcattgcttctactctcatttcccaattttttttttacacagccaccatcatgatcttcttacaacattaatcagatcacgtcactcccctgcctaaattcatcaatggtttcccatcacacagggtagaatctaaactcctcaccacatcctacaaactccaacacccaccatctggtccctgcctgcctttcagacctcccctgtccacaccccaagcaaacgggcttctcatctccttgccgccagcttgtcctctctgtgatgcctctgcactcattactccctctgcctgaaacacttcacatccagatctttgcctgatggtcccttcctgtcctctgaggatcagtttctcagatgagtggatttaaaagaggtggtacacaccttaccactgtgcccctcactgcctgccataccaccttgtttttctttatagcagttatcaccatctaaacttctcttgtcttctagtttatttctgtctcctcaattcctacaggaatgaaaactccatgagagcaagcatctcctcccttttgttgaccactgaattccagtacatggaagggtacctcatggcacagagggaggtctcaatcaaaatctgcacgataagctcataaatcttcaaattaacaaaacacttccagtgtaaacctgtccgaaaatcatgctgctatattgtgagcatcacagaatttcaggaccctggagatatctagtctatgcccacattttaatgagtatttaggaccagaaaagtcccttagcttgccggatgccacacagctaattaatagaatagctgagactaggacccagctttttaaattccagttgtgggtaattagactactctgagggtgaacataggttccttttcctatgtccaacataggaacagattatatccctagttatataaccatccctacttatgctcatcttcctggcatagtcagtaatagcactttctctctctttctgaagtgtcccagatgggggataaataatcaccctaactatatcacagtttctgtaatcctgaaataagtcaatatgttcctccacctaaaaagatctaaaaaatgtggctttcttccaattctcttttttgttgctgttattttcattatccagtttttacttccttcttattgctttatagaagagtatttgcagatgtacttacataaagactataatatcttctggaatattaagttctttggtcacttagctaattaaagcaacaacacataaaatgatttcattaataacacttgtgatttactaccttttgatactgtctttttaggattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgttctccctctcttctcatgcatggtcttaccagaaaacacaaaagctcgaagtgatgaagtcactcgatgacattctaggagggctgagagcaaatgctcaccttatttctctctaggactgtggagtcaaactgcaacctggcttacggtttttctgggtcattaatagaaaactgaaaagtggtaaactgtcaatcactcttcatattgtactctgtcaggtggatgcagatatttaagatagtttttaaaaacttgaaagtgatataaattcttacataaactgtatggcaatatgcaacaaaacactggcaaaaacaattgtaattgccatgaactcaccgttttagtaattacttattaagcactgactgtgtgccaagcacttagaatagggctgtgaataagaaagatgacaattcctgccctcaccatgtgaagtcttctaataattcctcactgctttttatacaagtccaattgcatattttgtttcactgctacaatcaaacatcaaagacgaagaggtagaagtgaatgaaaggagtagcagttggagaaaaaaaggaatgattgcttataaaaagctgccttttaccagttttacacctgggttcagtgaatatttgtggagttatccttctatacaaagtggcgtgaaggttacaagggtcacttggcactgtgccaacagccagaaactctcatcactgtgctagggaaagggcaggtggctatgtggaaatgccaactgagcaaagggtagcataaaacaagagccattggcagggcgcggtggctcacgcctgtaaccccagcactttgggaggctgaggcaggaggatcacgaggtcaggagttcaagaccagcctgatcaacatggtgaaaccctgtctctactaaaaatacaaaaattagctgggtgtggtggcacctgcctgtaatcccagctacttaggaggctgaggcaggagaatcgcttgaaactgggaggcggaggttgcagtgagctgacatcacaccactgcactccagcctgggcaacagagcgagactttgtctccaaaaaaaaaaaaaacgagccatgatgcagggtttgagcaacagaagattctcaggggaggtgaacttcacggctgggtcctggtttggtttttgccacatgaagaaggtccagcccgagataaagaaagaacatgagctaaagtgccaagatgtggagtgtgaggcatatgcagagaatggtgagttaaacaagcttagatgggttgtaaagttcttggggtgggaatgatagtgccagataaagctggaaaggtgggttgagatcacaatgggaagaaacttggatgcctgtgccaaggagtttgggctttattctctacatctcagagagtcacatagacacaacaaaggtacaagatactgaaggctagacaaatagagtgataattgtaacctaactccacccaggtgccaaatgactaggtctttactagaacagccacagaaagaatagaaagatgttcacctgtccctgatccttgatagcccagcatgccaagcacccaccatggataaggtgcagctaacagatgatgtggagggagattggactggagctggtaaccaactagctgcggggcttcaagatgaaagctggccttgagaatgagtgcctccttgaattttgcacccaaggaagctcggttgcctcaccctagcccagcactaagactcgctgatcagcaggatgcaatgccattttccaggacagagagcccagaagagattatttggggaaagaagatactaagcttagtttggtgcctgattttttttttaatggttactagatttagaagaggattttcttttttctttatgtttttcagcctccaaccttttagacaaagtttcttctacatggctttattgtatagaattaatcttcaatatctgtatctgcaacattgtcctc

SEQ ID NO: 15052 - DNA, 25659 bp, Human
tctctttggtttttttttttttttttttttttttttgagacagtgtttcgctcttgttgcccaggctggagtgcaatggcgtgatctcggctcaccgcaacctccgcctcccgggttcaagcaattctcctgcctcagcctcccgagtagctaggattacaggcatgcgccaccacgccaggctaattgtgcatttttagtagagacggggtttctccatgttggtcaggctggtctcgaattcccgacgtcaggtgatccgtccgcctcggcctccaaaatgctgggattacaggcgtgagccattgccaccggtgtattactctttctctattgcaattcccctgtcttgataaataggctctgtctaagcagcaggcacggtgatcccattgggcagttacaacagggttgtatgtaactgggttacagggttgtaacagggttgctgctgtaatggcccaatgggttcaccttgcctgttgcctagacagagctgatttatcaagatggaaattgtaacagaaaaacagtaattcacgcagagctgctgtgcaggagactagagtttgttgttgttgttttgagacggagtctctctctgtcgcccaggctggagtgccaaggcgcgacctcggctcactgcaagctccgcctctcgggttcacgccattctcccgcttcaacctcccgagtagctgggactacaggcacctgccaccacgcccggctaattttgtttttgtatttttagtcgagacggggtttcaccgtgttagccaggctggtctcgatctcctgtcctcgtgatctgcccgcctcggcctcccaaagtgctgggattacaagcatgagccactgcacccggcctagagttttatttttactcaaatcagtttcccagagcattcagggatcaaagtttttttgttttttgttttttgttgttttttttttttttttgagacggggtctcgctctgtcgcccaggctggagtgcagtggcgctatctcggctcactgcaagctctgcctcccgggttcacgccattctcctgcctcagcctccccagtagctgggaccacaggcgcctgccaccacacccggctaatttttttgtatttttagtagagacggggtttcaccatgttagccagaatggtcttgatctcctgacctcgtgatccgcccgcctcggcctcccaaagtgctgggattacaggcgtgagccaccgcgcccagccagggatccaagtttttaaggataatttggcaggttggggaaggccagtgagtcaagagtgctgattggttgggtgggagatgaagtcacagggagttgaagctgtcctcttgcgctgagtcagttcctgggttggtggggagggggcacaagatcacatagccagtttatccatctggtggtgccagctgatccatcaagtgcagggtctgcaacatatctcaagcaccgatcttaggtgcagtttagggagggtcagaatcttgtagcttgcagctgtaatttctaatctaaaccataatttctaatcttgtggctgatttgttagtcctacaaaggcagtccagtccccaggcaagaaggaagtttgttttgggaaaaggctgtcatcatctttgttttaaacttcaaactgtaaactaagttcctcccaaagttagttcagcctatatccagcaatgaacaaggacagtttggaggttagaaacaacatggatttgggtaggtcagatcgctttcagtgtctcagttataattttgcagtggtggtttcactgtgacaatcctgagggacttcccacagaaccctcagttattgaagcccaaagcctcagaaatggcgaggaagaaggggaagggtgttgcgcggtcaaactccacacgttcttagccgacctccgccgcttttcctagaatgtctcatctctatggtcgacggcgttcagattccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagaggtagggttcctggtccccagcgctggcctcctgcgcgccgccctcctccttgctggagcaggcggtgcgaaggagccgggcaaggggcggcctggaggcctgctgggagcggggtctcgtgcccgacgcctcagggatacctgtagcgggtggaaggctcgatttttctagtactcctccggagtcttccattctctgttttctccggccggaatttccccttatggattgtgcttttttttttttttttctttttttcctctttctctttctctggctctttctctctttctttcttcttcttttctttctttctttcttttcctttcctttttttttttttttttttttttaactcgcctatttactggaggtctggcgcgtgcgttgcccttaacgcacggtctggttttaagggtctgaagtgtgcctgtctttccggatgaacagatgcaggagatgttcccctctctgggatacgtagtttcagagccgactgtggaggacttttaaagtttggttacacaataaagattttcttctgtaggtatagtaaggagaggaacacccttaactcgacacagacaggggtcatatgcagagggaccagactcccgttttggggtcctggaaggaattgcccttttatttggccacgtggagcactttggtattttgacagtcagatagatctaccgtaaatattgtggttgtagaacagaggtccctgtttccttgacatgcagttttctttattttgaagcctgtaatgacacatcgaatctttcctgcccttcagatatgtgttgcttccccttttgctccatcacttgtctacagccagagaaaattctctacttttaagagctcatgtgattactttggaaccacctgtaaaatccaggataatctccctatgttactgtcgactggtaaccttaattacgtttgtgaagtcccttttgctgtgtaatataacatattcacccgcatgacaccagaaagtgaaggtcgtggggccaaaattctgcctactacagaatccagagcacaaaaactgtaaagaacctctgctttaaagggaaatttagacattgaacaaggtttaggcttcaggccagaaactgagataggacatatggatgggaggaaaagcaagattgaggtgagaggcagataatgagtttggtcaggacatgtgtggagtagttgtacatatgaccgtgttgggccgggcgcggtggctcacacctgtaatcccagcactttgggaggctgaggcaggcagatcgcttgagcccaggagtttgagatcagcctgggcagcatggcgaaacccagtctctacaaaaaatacaaaaattagccaggcatggtggcggcctgtagtcctagctactcaggaaactgaggtgggaggatcacctgagcccaggaggtcgaggctgcggtgagccgtgattgtgcccctgcactccagcctgcatgacagagtgagaccctgtctcaaaaaaaaaataaaaataaaaaaagaatgtgtatcttgggaaagtggtattaaagagagatgtttggaggtcgttaaagtgttagtgtatactcatggaaatggattagatatctcagaagagaagaggaccaagtgtagaaccctagggatacgccgacgggtgggtcatgaaagaagaaacttgagaaaggaggaaggagcagtcaaaacaaaatgtgaagagcatatattgagtattgacaaggagatctttgataattggggaaagcagtttctttgaagtggtggaagatggagcacagatacattcctagttcccaggcattccttttttattcatgacatttctgtatgttgacgcttctttcagtattataactccttttgagggacagtcctgtattgatttttgcatttagaagaatttcaaacctaagatccagtgtggtggctcacgcctgtaataccagcactttgggaggctgaggcgggtggatcacctgatgacaggagttcaagaccagcctggccaacaatgtgaaaccctgtctctactaaaatacaaaaattatccgggtgtggtggcgtgcacctgtaatcccagctacttgggaggctgaggcaggagaatcgcttgaacccgagaggcggaggttgtagtaagccgagatcatgccattgcattccagcctgggtgacagagtgagactgtctcaaaaaaaaaaaaaaaagaaaaatttcaaacctaaagaaaagttgtgttattactacccatacacccttcacaaagatttattagttaacattttgccatgtttatgtctctgtttttcttttttttctgagccatttgagaattgtcgacgttttccacttcctgttcagaagaacagggacattatcttgtataaccacaatacaattctcatactaaggaagtataactctttttaagttcttatcagcttttaaaaaattcttagcctgggcaaggtggcttacgcctgtaatcgcagcacttcggaaggccaaggtgagcagatcccttgagtccaggagttcttgaccagcctggacaacatgacaaaaccccatctctgcaaagaatacaaaaactgcaaaaattagccggtcgtggttgcacgtgcctgtagtggcagttactatggggagctgaggtgggaggattacttgagcctgggcagttgaggctgcggtgagctgtgatcacactactgcattccagcctgggtgacagagtgaaaccttgtctctgaaaaaaattaaacattatttgtttcagcttttcacaaacaaatctcttatgtttcttctttaagattttttttttttttttttttttgagacagagtcttgttctgtcgcccaggctggagtgcagtggcgcgaccttggctcactgcaagctccgcctcccgggtttaagcgattctcctgcctcagcctcctgagtagctgggactacagacgtgctccaccacgcccagctaatttttgtatttttagtagagacggggtttcaccatgttggccaggctggtctcaaattcctgacctcatgatccacccaccttggcctcccaaagtgctgggattacaggcatgagccaccgtgcccggccaaaataatttttttgtgtgtgaaacataaatacaaaaaaagggtataaatacacacacatactgtgtacatatatatacagtccagccgttcttcatctgagggagtgagggagaatgcccagagatgataaagctggagaaggagagagtcatgttcataaatttggcttatagcctttaggctttggtgaaactatttagtttgaggcagagagggacagcaacagattaggtttggctggacttggtttagtctctcagatttgtgttgaaagatttagaatctccggcttatttcagagcttagttttttataggaagttgaatttttttttttttttgagatgaagtttcactcttgttgcccaggctggaatgcaatggcgcaatcttggctcaccgcaacctccgcctcctgagttcaagctattcttttgcctcaccctcccgagtagctgggattaacaggcatgcaccaccatgcctggctaattttgtatttttagcagagatgggatttctccatgttggtcagacttgtctcaaactcccgaacttagatgatccatctgcctcggcctcccaagatgctgggattataggtgttagccactgcacccggccaggaagttgaatttttatccaaataaggaagatacagaggcatgaataatataaaatagacagtttaaaacaggtaaaataggtaatcaaattaaaattaggtaatttaaacttaaaattttttttttgtatctcattccaaaattaatcttaaaccaaataattaagttaacccaaattcaagacctctcttagcttcctgtcctgtttttcatcccgtgctgggaataaaggacactcaccatacttgtgcaaaagcatttgaattcagcaaaacatgttctctacatgtttactctgtgtctaattcttcttgtctttcccttttgactcacggtttctttggaactgggtatgattaattaaatgttttagaaggatttcttctagaatatatacaaagagtaaatgcaaatcagaatttaatgatcagacaaaacagttatatttttagatgatacagtgaaatcttttatgtttctctacatcactttgaaagttagaacttgaatactttcagtagatttattacaatcatcccagcaaactttaatggcagcatgtctggcctatttcatcgtggcctctgctagaattagaaaatctggtggtggtgcaacaaataattcatgtgcaataggatttaatttgttgttaataggtatttgttcaaattaaaattgccagattaaatgaatgtactgtcaaatctctttttttttttttttttttttgagatggagtctccccgttgcccaggcttgagtgtggtagcgtgatcttggttcactgcaacctccgcctcctggattcaaccaattctcctgcctcagcctcccaagtagctgggattacaggtgcctgccaccacacccagctaattttcgtatttttaatagagacagggtttcgccatgttggtagtctggtctggaactcctgacctcaggtgatccatccacctcggcctcccaaaatgctcccaaaattataggcctgagccaccacgctcggcttataatgtcaaatcttttttaacatagtaacatgctgttggaaaaaataagttgttgaaagtaagttgttttcccatttaaaaatatctgtgaatattaatatatgatttgcatttgtaaatctgaaaaagtaaaatacagaaacctagggtttcttttctttttttatttaaaaaaaaaagaatttaacgattagaataagtgtttttaagtgtggaacttggcttctgtcctatagaatgcataatcccagttcatgtaaaagattatgagagttccatagcaaatgctgtgcagaggagcatttgtattctctctgcactagtaaggaattacagaggtattatgatggcttttaaaagtgaaggccataatttgataggcactcattctatgtttaggtttcagtttttccatgtcgtcattgagtcattcaagttttatggctctggatatttgaaattattttggacacccaaatttggaatgtttctttctgaattgtgataacgccagaaaatttttgagatcagaaaagggcagtttatttgctttaaaataatacagcttttgtaggggactcgtgatacttgggcattatttcctctccacattaaaaggaaagcagtgggcaggaaagatgcatacagcacataacctcattacataatacaatgtttctttggaaccagtaggaatgagttgttctggaaaacaatttgtagaggttttatcacttttagctctttaagatttatcacttttaggccaggcgcagtggctcacgcctgtaatactggcactttgggaggccgaggtggcagatcacctgaggtcgggagtttgagaccagcctggccgtcatggcaaaaccccatctctattaaaaatacaaaaattagcgaggcgtggtgtcacacgcttgtaatcccagctacttgggaggctgaggcaggagaatcgcctgaaccctggaggtggagattgcagtgagccaagatcatgctactgcactccagcctgggtgacagagtgagacttcatctcaaaaaaacaaagatttatcacttataagcttcctagttttcctttacttttttttttttaataagaatgttggatagaaatctttccacatgacagtgcatatattcttacttttgccttttgaaagtatacaattaggggcagggtgtggtggctcatgcctataatcccagcactttgggaggccgaggcgggtggatcacgaggtcaggagatccagaccatcctggctaacacggtgaaaccccgtctctaaaaatacaaaaaattagccgggtgtggtggcgggcgcctgtagtcccagctactggggaggctgaggcaagagaatggcgtgaacccgagaggcggagcttgcagcgagccgagatccgccactgcactccagcctgggcgacagaccgagactctgtctaaaaaaaaaaaaaaaagtatacaattacgtaagttttagtatatttacagagttgtacagttatcaccacaatctaataatctgcctttgtttttggtaatgctttcggtaactgagggtcatgtggttagacattgatttcatttaggggaactgaggtggaaagttcatcctccccttccactgaacatgagtgatctcagactgtcacactgtcattgttcctgcccaaggcagtcctaggttctcctgttttacttttgtttttgcttggttagaaattagacagccaggcttgttaaaattgtatagaatatagaatgatacaggggtcttacttcattaacttttaaaaataattcatatagcatacagtttaaccatttaaacatacaattcactagtttttagtctgtttacagaattgtgcaattatcaccaccattttagaatattttcttcaccccaaaaagaacctggtacccagtagcagacattccctatttccttctagccctaggcaaccactatattgcattaacattttttttttgacttcttcaggattttttactttttttctgctaagtggtacagctccagatggatgaagtattatcagaaaattagctagcctctactgaaagctcaaaatactgattttggtgatgtgtttcctttgttacaccaataaaatatttgcatttgaccacatttgagggaaaactagatctagcttttctgtggctttctcttaaagacgttgaataaatgaaaggcttcagggaatctgtctctcagggtaataattatttcctgacttgcggtgagtgtgattacagccatttcatatatatgtcttttagtgtaggattcatggagaaatgcatgattaccaaggatttattgcatacttaactcctgagctctttgttaacggttttgaaggatgttaataaaggaatgtgacaagttctgctgtccgatagttcacattccataagggcacatataagactcattaccacagagttaagtgctaaaatttgcaaatcagaaaaggaagagatctttatggactggtgtagttgaagggaggcctcatggaagaggggaggatttgcaaaagcaaagagggtatttgaagacataccaaaaaagagtaagcatgaaagtcatagaaacatacatgtgactgaggaaaatggaatttcaagtctgtttgaatttatagctagagggaaagagaccgtaacagaattgatcttaaagaaaactcagtttccactactgaattttcttattttatgaacgtttctaaaaaagtaaacttgaatttatttatatgcataaaggtgtccaagctgaacttttatatactttgtggtcttacatgaggatttactttctaaaaataatctacttaaaacatgtttttcagccgcctgtcttggttagatggctctggattaggattctcactggaataccccaccattagtttacatgcattatccagggaccgaagtgactgtctaggagagcatttgtatgttatggtgaatgccaaatttgaaggtatgtatggtgtaatttaatctaatgcctcctttgatagcaaattatattttaaaaaagagtctttgaggccgggcacggtggctcacgcctgtaatcccagcactctgggaggccgaggcgggcggatcacaaggtcaggagatcgagaccatcctggctaatacggtgaaaacccgtctctactaaaaaatacaaaaaattagccaggcgtggtggtgggcgcctgtagtcccagctactcaggagactgaggcaggagaatggtgtgaacctgggaggtggagcttgtagtgagccgagatcatgccactgcactccagcctgggcgacaaagtgagactccgtctaaaaaaaaaaaaagaaaaaaaagagtctttgataataatcaatgtaacattgaggccattgactcattttgggtagtagtttattaagcaaaatttcagcacagcaacttggacacttgaagttttcacaatggatgttcatgtgtgtctgtatatatttctctatatttacacttagaattcttcatttattatggatatgtatttctagcttttcctctaaagtttcactgtttattctgcctttctctttttaaaaggcacccttaggggcttggatcagtataccctgtgcttctcataatttaagatagaactgttttgttttgtttcagtagtgggtctcagtggttgtaggggggatatattttccatgggcctccaccaacctcaccattcccccacatttggcagtgacattttggttgaaagaggaagggtattattggtgtctagcagttagatgccaaggatgctattattatactaaatattctgctatgcacagatggtcccccacaacaaagaattattccatccaaatgtcagtagtgccaaggttgagaaactgtaggatataaagattctcaagttttgctttgggataattgcaaagacttgtaaaaatctagtgaagatgctcatgtttaaaataacgggttgcttttctttgaagtagtgtgtaagagacaatcctatgaagttacctacaaggctattgctctttcaaatttagattttaatatggttccagatataatatgatcatttatattcaggtgtgaaactatttagtaattcttaggacttttggcaagacctgcctcattaagtggtaatgactgattcagctatctgaaaatatttttgttataagatttcaaattcttgccattggaaaaggttcaaagacatttaaaaatctagtgaagtttgaaaaagaggatgaggaaaagtaaaaggctgttaaccttggggtgtagtagtgtagtaagacttcctaataaggcatttggcacaaaatttactctccatctaagtaaatgcaactatgattttataaccaagaatattatgtgtcatgtttagtttaaagcattcattcatttgcagaaatgcgaaaccttgctcttgtcagtcaactccagatgctggtgtgaaatggccccaaatagtgacggccattggaggtgggaaaggtacatgccaagagaaaggcttaggaaatagcatttaataaatactagcctaagggcaaaagcacattgaataagaaaactctgtcattaggccgggcacagtggctcaaacctgtaatcccaacactttgggaggccaaggggggcagatcacaaggtcaagagatcgagaccatcctggccaacatggtgaaaccctgtctctactaaaaatacaaaaattagctgggcgtggtggcgggtgcctgtaatcccagctactcgggaggctgagacatgagaatcacttgaacccgggaggtggaggttgcagtgagctgagatcgcgccactgcactccagcctgggcaacagagcaaaacggtcgaagaaaagaaaaaaaagtaagaactctgtcattaacttgctaggcaagtcatttgcatttctctgagcctgaatttcatccaaaaagttaagggagtatattagtctcttgttcccaaactcaagactaatggatacacattagaaatacatgggaagcttgtttaaaatgcaaatgctctgagtcctaaactaggaaaaagcagttcagtaggttttagggtgtgtgttttaaatatgtgctctataatcatacagaatctatatgattggttgtaattgatgtgattatgattaatcctttcttagtaagatatgcaggatttcctatcttactagaaattagtatctttctgggtcacatttatttcactaattctccagttccttttttttttttctttttttttgagaatggagtcttgctctgtcgccaggctggagtgcagtgatgcgatcttgactcactgcaacctctgcctcctgggttcaagcgattcttctgcctcagcctcccgagtagctgggactacaggctcccgccaccacgccccgctaatttttttttttttgtattttagtagagttggggtttcactgtgttggccaggatgctctccatctcctgacctcatgatccacccacctcagcctcccaaagggctgggattacaggcgttagccacctcgcttggccctttagttctttttatcttaaactcctctcataaattacatgtgcttgaatcatattttcccagcctttgttccttgcattctgattctctaagctctaagttttttttttttctctttggcatacctctgtaagtctctttaaaaatgaccatcagggctgggcgcggtggctcacacctgtaatcccagcactttgggaggctgaggcgggcggatcacgaggtcaggagatcaagaccattctggctaacacggtgaaaccccgtctttactaaaaaaaatacaaaaaaaattagccaggtgtggtggcgggcgcctgtagtcccagctactcaggaggctgaggcaggagaatggggtgaacccaagaggcagagcttgcagtgagccgagatggcaccactgcagtccagcctgggcgacagagcaagactcccgtctcaaaaaaaaaaaatgaccatcaggaccgggcatagtggctcacatctgtaaccccaagcattttttttttttgtgatggagtctcaccctgtcacactaggctggagtgcgatgctgtgatcttggctcactgcaacctccacctcccaggttcaaatgattctcctgcctcaacctcctgagtagctgggataataggcgcctgccaccacgccttgctaattttggtatttttagtagagacggggtttcaccatattggccaggctggactcaaactcctgacctcgtgatccgcccacctcggcctcccaaagtgctgggattacaggcgtgagccaccgtgcccagccacaatcccagcattttgaatggccaagacaggaggatcacttgagcccaggagtttcagaccagcctgggcaacatcgtaagaccccatctcaaaaaaacaaaaattagcagggtgtggtggcaagtgcctgtagtcccagctgcttagtaggctgaggtgggaggatcgcttgggcctgagagggcaagggtgtccagtctgggcaacaaaacaagtcccagtctcagaaaaaaaagttgacccttagctcattgttgatgagattagattaccttaaaaataaccttaaaaattcattcccggtgaggcgcggagggagcactttgggaggccaaggtgcgtggatctcgaggtcaggagatcgaggcaaggcttttctaggatgctcactgtataatcagaatttttcaaccataattggaaataaatttgtcaaccataattggaaattaaaattgaattgcaatattcagattttcaatatgcttcatttttttaaagtcaaataatgacattaaaagggtattttattttctagaagaatcaaaagaacctgttgctgatgaagaagaggaagacagtgatgatgatgttgaacctattactgaatttagatttgtgcctagtgataaatcagcgtgtgagtgttctacagtattgattcttccccttttacataccaagcattcccaattgacacacacacacatacacacacacacacacctctcacctttaccaccattacctccattctattgctttttctttattttagcattggtaatatcattaaggaccaaatacctattaatatcaaaggttgtgaatgtagtgagaatattgtagacactctgtcatctgggtatattttgtgagtggactctggttagttttactgattggtgctgttgacttaatctcacctgctggatggcagaggagttatggcagttttaaagtggaagatctcaggatggctggaaagagccctatcagctgagagcagtcttcacccttcaccctgatgccagcagtcttaccaggactctgacccttttttcttggaaaatcccacgagccatgaagagattgcaatgatctctcataatgaactcttattattttatgacttgtcttttgcttcaaccgctttcaagattgatcttacaatttggcagattttgtaaatactgtggcgttttgtgtacccattaaatttatttgcactgatggttacttttattacaaaaaaagattggttacagtttaatttccttgttcagtggaggcaatgttcactgcaatgtgcgaatgccaggccttgcatccagatcctgaggatgaggattcagatgactacgatggagaagaatatgatgtggaagcacatggttagtgaaatggattttaaagtggtttttttgtttgtttagtgtttcattttaagcatttatttgtattaagggtagaggattatagttctttatatgactgtaaagtatgcagtatggtaaaattattattattatttttgagatggagttttcgcttttgttgcccaggctggagtgcaatggcgtggtctcggctcactgcaacctctgcctcctaggttcaagcgattctcctgcctcagccttccaagtagctgggattacaggcatgcgccaccacgccaggctaattttgtatttttagtagagatggggtttctccatgttggtcaggctggtcttgaactcccgacctcaggtgatccgcctgcctcggcctcccaaagtgctgggattacaggtgtgagccactgtgcctggctggtaagattattattaaaatagaatgacacggtagaacactttatgccaaagccctttgcaacagacaaatttttgagtgtaagaaatagagattgttatggggaagaatgggtaagtagagcatatgggaggaaagaaaatggtagatagggaagtggatggtcaggaaagtcttttaagctgaggcagctgcccccagagaacaagcttctctctctacaccttgagaacctggatcatttatattgttttattattactattattattttgcaacagggtctcactctgatgcccaggctggtgtgcagtggtgtgatttctgctcactgcaacctctgcctgctggactcaaatgattctcccagctcagcctcttgagtacctgggactacaggcttgcgccaccatgcctggctaatttttgtgtattttttataaagactgggctttgccatattgcccaagctggtctccaactcctgggcccaagcaatcctctggccttggcctcccagaatgctgggttacaggcatgagccaccgggcctggcctgcatctttatttaacatgttccttcaaacagctcactgccaaggtcatttctttttctcagaaccatacttcatttatttaagagccctttccgattgcctcccccagaccagaatgcagtcactagcgtgataagagtctttatagcttgaagtacctgctgttctcttttcttttccctactggtcttatgtacaccaatctgggtatccaaagccctttccttcatatgtacccacttcctggcctgagataaacacatttctgggatccgccatcacatacctaaatatatccaaatatatccttatctttctgagatttttgagtgatttaaaatttttcatcctttttgtatgttccagaatttctaattttttttttttttttaaacagggtctaactctgttgcccaggctggaatacagtggtaccattctccacccactgcagccttgaactactggaccaaagctgtcccaccccagtctcccgattagctgagactacaggtgcacaccacgtgcccggctaattaaaaaaaacatttttttggagagatgaagtcttactatgttgtccaggctgatcttgaactcctgggctcaagcagtcctcccagctcggcctctcaaagtgctgggattacaaacgtcagccactgcacctggccctgattttttttaagaaaggagcatgttttttaatcagaaaacatcttcattttacaaattaataccaaattaatttgtgctcacttgtaaaattcccacctcaggataatgtaggactctctgaccttaggaacacactttttttttctagtccctggacttgggattctttgggaattgctgtttactggcttgttatctcttttaataaccctagagagtaggtacatcttctttgtatttctgtcttcagcagtagcctatatgtgtgtataaataaatgttcaaaagtatcttcctggaagcctatttggacagtatattatcttcagcagattctttttttttttttttttttccaagacaaggtcttgctcggttgcccaggctggagtacaatggcgtgatctcggttcactgcaacctccacctctgtggttcaagcgattctcctgcctcagcctcctgagtagctgggacaacaggcgcgtgccaccacggcctggctaatttttgtatttttagtagagatagggtttcaccatgttggccaggctggcggcagatatattattgattccattttgttttttctaattgttgtatttaaactttaaagttttctgtttgtttagaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaaggtgagtgtccttttgcagtgtgaacagtcagatgagcacttgggcaataagttatggatagtcaatagaagttcttttaataactaagagaaagaattgactctctatagtataggaagcagatacagaattacatagtataggaatgcttatgtcatttgtttttagtgattttttttcctcattaccaaaaaagtctttgttcatagtcaaaaaaatttttttaatgtgcgcaagaaagtagaagtgaaaaagaaacaagtgtaattctaactgagagatatccactattaatttactgttgcatctgtgtattagtttgctagggctattataacaaagtgtcatacaggctgggtggctcaaacaatagaattttattgtctcatagttttggaggctagaagtccacgataggttatctctgagggctgtcaattcaggcatctcttcaggtatacacacacccaccaaagcaagagagagattttaagaaattggcccacgtgactgaaggctggcaagtccaaaatctgcatggtaagccggcagactggagacccagagaagagtttatgttgcattctgctgcctcagaagttctgctggcagaatttcttcttgctcaggggaggtgagtctttttcctattgaggcctccagctgattaaatgagacccaccacactatgcagggtaatctccttcacccaattttcaccagtttacaaggctaatctcatctaaaaaataacctccacagaaacatctagaataatgtttgaccaactatctggacaccattgcctagccaagttgatgcataaatttaactatcacacccttctttttttcttaagatggagtttcgctcttgttgccgaggctggagtgcaatggcacgatcttggctcactacaacctccgcctcctgggttcaagcgattctcctgcctcagcctcctgaatagctggggtactggcgcctgccaccgctcccagctaatttttgtatttttagtagagacaaggttccaccatgttggcttaaagtatgcacaggcaaagaagaggtagaaaaaaataaatataattctgagatgcatttactattaattttctgttgcatatcctttcagtcttgtgtccttttgtgtgtgtatatacactgattgtgtgtgtgtgtgtgtgtgtgtgtgtgtgtttgagacagagtcttgctctgtcgtccaggccggagtacaataacgtgacctcggcttactgcaacctctgcctcccaggttcaagtgattctcccacctcagcctcctgagtagcagggattacccactactatcgtgcccagctaatttttgtatttttgtagagacggggtttcaccatgttggccaggctggtctcgaactcctgacctcaggtgatccgcccgcctcagcctcccaaagtattgggattacaggcgtgagccactgcacccggccatgattctgtcttatttatttatttatttatttaagacggagtctcactctgttgcccaggctggagtgcagtggcatgatcttggcttacttcaacctccacctcctgggtttaagagattcttctgcctcagcctcctgagtagttgggattacaggcatgtgccaccatgcctggctaatttttgtatttttagtagaggcggggtttcaccatgttggccaggctggtctctaactcctgacctcaggtgatctgcctgccttggcctccaccttcctggttcaagccattctcctgcctcagcctcccgagtagctgggattataagcgcctgccaccatgcccgggtaatttttttgtatttttgttagagatttcgccatggggttttgccatgttggccaggctggtctcaaactcctgacctcaggtgatccacccaccttggcctcccaaagtgctgggattacaggcgtgagccactgtgcctggccaagacaactctttccgtggggcttgtattagtctgttttcacactgctgataaagacatactcaagactgggcaattagcaaaagaaagaggtttcattggacttacagttccatatggctggggaaacctcacaatcgtggtggaagacgaggagcaaatcacatcttacatggaaggcagcaagcaaaaagagcttttgcaggaaaactcccccttatataaccatcagatctagtgaaacttactcattattatgagaacagcacgggaaagacctgcccccataattcagttacctcccaccagatccctcccacaacacgtgggaattcaagatgaaatttgggtagggacacagccaaaccatatcagggctcttgttttttttctcttgttccctccccaccttttatttaatgagatgacaaaaacagggaaataagcaaaaagcttgctgtactgatttttgtcttttcactttgtgaggatagggctgtataccttaaaaagcctaacagtaaatacttagatctgtaaagggtgaacaattgatactgcatttgaaagttcctacatagagttattttagtattgagggtgagaatttacacagttagtgtcgcagactgattttgatgtggcctaaatccccaggtagcattttctttctcagtttgtcccttcagacttttccaaaaagaggaaaaagcaattcttaccagcagagggcactagcttccttctggtagaagttataagttgaatctacctgtctgaagtgttcatagggattgctcagtaattaatttttttgtttagatgggatggaggtggataccacaccaacagttgctggacagtttgaggatgcagatgttgatcactgaaaatgatttatgcaagtttaaggtgagtagttcattttctcccttgtcgctgatcatgaaaatcatatgaaatgattactttctactttttaaaattctttcttgagacagggtcttactctgtcacccaggctagagtgcagtggcatgatcctagctcactacagccttgaactcaagcaatccacctgcctcaccctcccaaatagctgggactataggcacatgcttaccacacccagcttattttaaaattttacgtagagacaaggtctcacatgttgcccaggctggtctctaactcctggcctcaaatgattctccctcctcggcatccgaaagtactgggattacagctgtgagccactgtatctggcctatttctttttccttctttaaaaaaatttttcttcttttaaacctcagattgttcctgacaatttatttgctactccattattctgagaaatatattgtcctttgccagcctaagtatttcaactatatgttagataataactgaaggtcatgttcatatcatacagagctagaaccagtaattgtagtagtcctttataagctgttgttaaattgttgtccctgtctccccactacaacttcctcctaccttatagcattgttttcttgaatactggctatcctccagtctttgagatgctctcgctagcctccttttattttactaaagcatatagtaatagcatggtaagatttatatgttttgacttgactctgctaccactgtcagtcatccagttaagttataagatcctttgttattccctgcaatgataaatatttcagaattccttctcttttcttctgatacagattttagttctgaacctagttctgtaatcattggcttttctccagttacaagttttaattcctttacccctgttctatttcatttcagaaaccagccttttaaagttccagttagcttccaagttactgctattgtgaaaactgtataacattgcttcttatactgaccatgaattgtgatactggacctgtgctttcttctcacatcctgccagtggaactatcagaaaataacctcttagagttctatgatttatattttcccttaaatacttaattttaatttccacatttacttttgtcagtggtagccatacagtttaaaattagcaatgtcttctctgttaaaatcatgtgttcacatcactggagctctgttaactttgatttttagctctcacagttccaattgtcagtaacttcactgttctacttcatgggaaatcctttgatatcaacttcagtattctttccttatttctcatcacattatagcatattaattttttcagttcagtgatacttgttttagtaactgttttattgcaattagaaaacagatttttgggtctttgggctttcacatatttcttttgaagaatagactatacagagaacatcagccactctattattaatcagaatcatgagaaactcatttggtatgtcactaacagttaaacaaatgggatgttactgcagtccttggcaagaattcttaggattctttttaatggtgaaatagccacaaactttttaatgagctttgttttctgttaattttatcctagagctcagaggcagagaattattttattcataacggttttttttcttttcttttttttttttctttttgagatggaatctcgctctgtcgcccaagctggagtgcagtggtgtgatcttggctcactgcaacctctgtctcctgggttcaagcgattctcctgcttcagtctcccaagtagctggaactacagacgcgcgccaccacgcctggctaatttttgtatttttagtagagagagggtttcaccatgttggccaggatggtcttgatcttttgacctcgtgatccgcctgcctcggcctctcaaagtgctgggattacaggcatgagccactgcaccctgtttataatgtataaacattatgtataatgtttatacatattcttcatctggataattgatctgaattccgaacaatgtctgtacatttttttttttttgacacgggagtctcgctctgttgcctaggctggtgtgcagtggcgcaacttggttcatggcaacctctgcctcccgggttcaagcaattctcctgcctcagcctcctgaatagctgggattacaggtgcccaccaccacacccggctaattttttttttttttttttttttttgagatggagtttcgctcttgttgcccaggctggagtgcaatggtgcaatcggctcaccgaatcctccgcccccccgggttcaagtgattctcctgcctcatcctcccgagtagctgggattacaggcatgtgccaccacgcctggctaattttgtaattttagtagagacagtgtttctccatgtttggtaaggctggtcttgaacttctgacctcaggttatccgcctgccttggcctcccaaagtgctgggattacaggtgtgagccaccacacctggctgtgtaaatttttaatcatttaaaattgtacatgctttaaaagaatgaataaggaataaataattaagagtagtttatgcaactgttaataatttcaggataatggaactaggacttctcagtgcatgaggtggggtggagacggcacgttaatcgtggaatcacaactctgccacatacttgtgtacacctttggacaaggcatataacttatttaatcctcacttcccccatctgtaaaatggggaggataatacctaccttgcagggttgttgcagaggctaagataaaatgtacctaagtcctctggcactcgtgactaggcattcaataagtagtagctattattattatcactactgtaaacactgtaaaccttttgtttttcagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctatattactttgctctcattcttgactaaaaccattaatgagaaatgttttttaaaaaataatgctggcaaatatgagaattttgttggctttatttttgtttacttgttgagaagatgaacatgaaattaataagaaaatatagttatagcttctggcaagtatttagtaaggcaaagatttaacacatttcaggggatttctgccacttccttttagatcagcagtaatttcttatatttatcaactctcaatttttagttttcatagatacctgggtattataaggctgatttgtaattactgatttatacttggacttttgaaatcattatgtgtccttaaaaataaggttatacaagctaaccttcttaacaggatcacatggctaattagtgactaaactgatgtttggtaccactcagcccagtgttcatttcagcactgtcacttggtttcccttatcttgcaaggtagactgaaaaaaaacgaattttcctttttctaaccagactctcagaatttctgagtctgttaacaataggcaagtaaaacagccacttgaaatggaaactaaaatttactgagacctctgtactagccactgtcctgagttctttattatgtattataatattcttaattatcttatgagatacgcttttatcccactttatagttgaggaaactgagttatagagagaggtaaaataacttgcttaaggtcatgtagatagtgaattgtgatttttgagcctgtgctttaaaacatcatacagccttaccacctaccagcagcagaaagcatgcacactctccccactgctgcagggtttcagtgttaacatttcaatggccagtacaagagcttccccagtttctctgctacccatctgagcaacacccataattctatcctagaagtttgtccattcttcagtaatcagtcaggacattctcacaggctaatattagaaattccatttgagttccttttaaaaggaacaaatttataattgtgactttccatgaacataaattgctctgatagcaaaatgtcgagaagattcagagtgtacttggtttcttgttggtgttgctgtggtcaatgcaatatgcaaaaaggcaggagaccaaagcatgtgggcacctctctgggcttatttcctcattagactaagtgactttcaaagattgagctgtaacattcactagatagttagaaccgtagcattgagaaaatagaagctgagaaaaaagagcaggtcaggcttttaaaagataaaatttataatgatcagccagacaatatttattgatttcatttgagcctaattttagggttgctggaattgttttctttgtgtgttcctgatgtagagacactttaaaggtacatagacatttcccctccaaaatgtaagtcatctaaatgttcctaaaagctagggttaatggttctctgttctaggttcttcatttaaaaaatgtattcattaagatatggtcccagccggacgtggtggctcacacctgtaatcccagcactttgggaggctcaggtgggcagatcacttgaggtcaggagtttgagaccagcctggccaatacggtgaaaacccatctctactgaaaatacaaaaattagccagccatggtggtgggcacctgtaatcccagctactcaggaggctgaggcacaagaatcacttgaacccaggaggcagaggttgcagtgagctgaggccataagcttgtttaaatctttataggggctgggcacggtggctcatgcctataatctcagcactttgggaggctgaggtgggtcgatcacctgaggtcaggagttccagactagcctggccaacatggtcaaaccctgtctctacaaaaatacaaaaaattagctgggcgtggtggtggggcacctctaatcccagctacttgggaggctgaggcaggagactcccttgaacctaggaggcagatgttgcagtgagc

SEQ ID NO: 15053 - DNA, 6507 bp, Human
ctttcatccagaacatacaggaagtattctgtattggcaataaatacaatggaaataatagaaaaataaaaataaaaaattcttaattatgctaacattaaaactgtacttaaaggactacatatatatagatatatagagagaaccatgtggaaaatgcttatgatttaaagtataaagcaagaaataggttggctgcagtggctcacacctataatcctagcacttcgggaggccaaggcagatagattgtttgaacacaggagttcgagaccagcctgggaaacatggcaaaaccttgtctctacaaaagaaatacaaaaattggttgagcatagtggcgcacccagtaggctgaggttggaggatcacctgagacctggaggtcaaggctgcagtgagctgtgattgcgtgattgcatcactgagctctagcctgggtgacagtgaaaccctgcagaaaaaaagaaaggaaaaggaaaagaaaagagaagataaaagaaaaaaaatcctatacacacaatgaatataactataaacacataagtagatatgatgagaaatcagtatacaagaatcagtcaacatgatgggatttacaattaactttttctcttttggaatgcccataatgttaaactactagcacttctttaaattcatcttttaaaatattctacacacacacacacacacacgcacatctatgtcaaaatttaaatataaatattgagacctgataatatgaactcagtctctatctcttaaattagtcccgtaagaccatcactcaaccagaaactctggctgtgagtcctgcaggcaacttgggctttccctctcctacctactcactgcccatgtcactgccagtcaccagctgctccttattctgcaaaccaggtcagtgcactcagccacacctttctgcattcagcccaggtggccccttcctactgccacctacctggattaagtcctggtacctctggctcagcctcttccaataagatatttcacgatgccaaagacttggttctgctgattcctgaatcatcctgcaaacccatcctccccctcctcaccttccatgtttaacacccagctctgtctggatcacttgcctgcttacagagagcaggccctctagagcctcttcaaccaccctttcaggctcatcgtccactatccctcactaatctcagtttccatccccaggactttttttctctaccaagaatgccctctctcccaacataattatctgaatcccacctacctttcaaagtccaactcaaatagtatcccctccttaaaaggatgttctgccctgctaaacatgcttcttcctcctgaatgtgcctcctgaactcttctcctgattaaacatacacagctaccttgaattgtggtaattggctgcctctttattgctttcctactgaattataaacccttgcctttgaatattttgtttttaatcctatatagttttatgcactgttggcaacaaaaatatatttccttaataaatcaataaaaaaaggtctaaaaaagcaacaaatttaaaagttccacgacttattttttcaagtttaatctgtaacaagcagattttgacttaatctcacagctgggtttttaagaagtcaaatttcattggtatgccccagataacaccctcactccttccttttctctttccctctcagactctctgcagaatgagagcctcatctcaaattgtctctgcccatacaaacacagaacttttgatagttttattgtttatacttatagacctgaccaagcaagctcctcaagatagggttgttaaagggctacagccaacctgattctctacatctgaaacaataattacagagctcttctggaataatcaaatcataaaactctacctcgtaggatggaacagaaacattggctcagctaaagagtgggtgttttccttagattgtggaatcatggctgatggttaggaccttaaatatatcgaggtggctaattgatgtataataatttacaaaattattcttctatgctacagagctacaattcaatttacagtagtaaatatgagggccttcttaaggaaccagaaatatgaggatatgcacaatattattcacattttacagatcagaaaattgaggcacagattaagtaacttcccaaggctaccaggcattctagctccagaaactgtgctcttaccattctgctacaaggtatttcgaaaaaaagaaaaagtaaaaagaagtcaaaaggcaacagagttcattgattattccatagaacagtcacaccatgcaattctcacacccttgcagacacacttgaccatgaaaggttcctcaatgaaatgttcctcattatcttcagaagccatattattcacattgactttgcagttaactcagaccctaggtctggaatgctgtcttctctacttatccaaaactatacatccacagatcatataaactctcagccctgctgcaaagcctttccagaaaaataaaaatggttgaaaaggcaattctgctaccaatgactgtttaagcccagccaagtaactgaaccattccaacttcaatttacttatgaaaagaatttgatgatgtaggaggttatttcaattctaaaatacaaacccatgttgatctttctcaatcttgaactcatagattattatctattatctcaatttagtttgttatttatcctagtgggccattaaaaactaccacatgtgtttctgtctctccattagtcaataactaaactaacgagcaattagtaagccatgtgccagatgctccgctaggcaccagagggataaaaacaatacttatagtataccactaattttcgcttagtaactagtgaaatgttcaagtcatgcctgagtcaagagttgaggagacattacaatgtgtaatggaaaccaaggaaagtgaaactttggataagtggggactagtgtatttatatatttaattgatttctgactctatcattggcctccaaacacagattgtgtttttctttggttttgttttcttcactatgggatcttctgtgcccagcacagtgcctgacacatagaaaacaatcaaatatttgctgaataaatgattaaaaaatcagagaactttcccattctgtttggatctatagaacatccagagtaagtgatgagggcctctgcatttatatgcgcttaaattaagattatgtgagaaaagtttaaagacacttagtagagtgattttgaaatatagtaaacacttggaaatggtggtgctttaaaaagatattaatagataatatgaaaatctccatctcaaaaataatgcataaactatttaaaggaaaatcacatctccaggctttcaatgtttgttcattactttttcatatatttttaccatctgctgaaggcagtcatatcaaagggtaaagaaagatgggaggaaaactcagtaagaattatattagtctgtttgcaaagtagaaaaagattctcatcactcaaccttatgagcaggaagagggaaggctgtttgagaaccatttacttagcagaaccacatattttagacacttccctgcattaactgcacaaacaatatgtttgcaaacttgttagatcaacctccaacaacgacacattcaggagttaaatatttttcatcaaacattggatttttccttaacgctagagattgctacaaatcttctgaagggtctcaatggcttcaggctaagaagagatttctccctgttataagcagcaagacaaattagccatttcactctcaaacttcactaatgatcacattctttccaaaaggaactctagaagaccaaatgccccgagttaagaacatcaaaactaaccatctgaagaaacttcccaagtgtaagactctgccattaaaacattaccgagaggggactcaaacagtctttcttcctttgtcgtgtttcttgctcccagaccaaggcactgacgacagtactgatacataatttaaaagcacactcccttccactttgtaataccagaactctaattggacaccctgaagcttaggactaccagccatacaaatagtaaactctgtccacgattcactcatctgtgtattttctatagatgtttactaggcgtttgttatataaaaataccccggccaggcacggtggctcacgcctgtaatcccagcactttgggaggtgggtggatcacctgaggtcgggagttcgagaccagcctgaccagcatggtggaacccccatctctactaaaaacacaaaaaattagccgggcgtggtggcacatgcctgtaatcccagctactcaggaggctgaggcggagaattgcttgaacccggaaggtggaggttgcggtgagctgagattgcactattgcactccagcctgggcaacaggagtaaaactcccccccacccaaaaaaaaaaacaacaacaacaaaaaaccaaaaaaccaaaaaaccaatggtaaattacactctctttccctttccccaacactctctctctctctctctctctttcacacacacacacacacacacacacacacacacacacacacacacaccagaccgattagctaacttagtggaaaagacacttagattccttcttcatatgtgaatttagctcacaggactagtgagggaatatcattatcacgggaagacacagaaaccacacaggactctgagccactcctagttttacccctccttagcctgtgacttggcttttctgctccatcatctacacaagaagaatagcagtgactagcacccacaagcctctcaggatagacttggcaggcaaggtaacccaccacttaagagcacaggtttaactccaggctgaatactgccctggtcatttcactagctgtgtgaccttagtatcaatatgtctggtgcataaaaaatgttaaatgataagcccctgtcatttctcctttaaaaattgcaaagcactctacgaatattcacttctattatctaaaaatgcacataaaaaagacacccagtaatagaatattcatcaaatgctctctcagtgtccagcatcatctccttccttatcgccaaagccagcctgccctccccagataggatgcccacatctcccacatgcttacagaggcgaacagccagccataattccattcggcagcctttgaagactcagccagctgtatcagttaataacctcactaaaggttatccatcagaaagaagggaaacaagtcctaactactctcgtcagagaagtcattagatccgtacatggctcctatacaatctgcctggcatttatggaaatagcacacaccataggaaaatgttgccaaagcagacaagtatttaacctaaatattcaatagtctactaatccatttccaaggtaatctatcttcagagcctctttctgattctgtacagttctgaccatttattgtttgctcaagctgtaaaacttttctttgggttccatagccatttcaataaatcaaacttgccttttctccccttcctgttaaatagtaaaaccatgtagaatagttcctagactaagtgatttaacctcattcctatttgtcagaagcaggcttcactgattttttttaaccctctgattgaaagtcttctttctaaatgagaatactatccttggaatattggatttcattattggcccgtttctgtttaatcttggagaaatctctacaaaaaggaaactatattattttctttccagaaatttaatacaattgttccatacactttagagtgtgacatggttcaatcttccatgtttataagcactaacagataccaatatgtgaataaaacgcatgatctaacttctaaaaaataacacctaggatccgttataacaacgtgctatgctgtggtcggacagacaaataaaaactgcatggtgtggccttatccctcctgaatagcatatccagaccaacatttgaagatgtccaccatatcttgttttaaaaggttttctgtgcctacaaaatacttatataaaatgactggaagatttttataggaaatttcttaaataatttatcatcagaatgagtcatgtagaagtgccaagactaaattaacatacccttcagatgtaatggaaatccagtcttttctctggggactcatctaattctctcttctataatttttgggagaatacagtaaaagcatttaatacagtaatggtattagcaaaacaaggacttatttaagaggctttacctggatcattacaagtattaccgaattataagataaagggtgttggcttctggagattattaaaaagttgatatagaaattcctcattcagagagaagagggataaaacttattattctaagccagaaagtctacactgtgaaccaatctctatac

SEQ ID NO: 15054 - DNA, 7360 bp, Human
  misc_feature (1)...(7360): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtaccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttacgattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtgccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacagtaatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgatactgtgagctgtgacttttttttcccactcagtcatacacttctcaccctttccggtgaaccacatgtatctttctcctcttgagtttcttcagtgatgctttctggtcccagttcaacagcttgcaaatggtaactgggtgtgggtgggctgaaggagaacttgggaggcaccacaggctacccgtggcccccaccctcccatttaccatctgctcctataaataacttccagaagtgtttctcctggttgtgtgtgtttcagatcagagagaaggttaaatgcttgctctacaagaatgtagctttcggccctgcctgaatttcttttccatgtttctcatggaaacattctctttcccctccggctcaactcaatgttagaattaccaactagaattggaaaacttgtccttatctggagtcttagacacataggaggccttggagaggaacatatccactcttttaacgtaagatggggctatagctgggatttcccaactagtctgggactcccaggtcactcgcctggttggaattagaacccagggctcctgcatcccacttgcgtaggcgtgatgtctgcgctccctgccgagcttccctttggactcagagtgctgcaccatacccagcccaagctgtttcatattaggttatgtgcttcttgcctcaggaattcttccatgtgacttctaattctgcaagcaattacagtgacaacttcagtggatgtagttccctgatcagtaagtcacctccaaaccgcagacaactgtcagttttacccagaagtgataaaatattcccaggttacccaaatccacgcccaagcacagagacacaactttttttttaaggtgtggtatgaggacttgtaaacattctatcaaagtcatgctgtagtccagaaagattctcacatgctaatgtacctgactggtaaaatagtgagatactagtccagccaaggaaaatgtccatatttccttttagctccctgtggttaataagaaagaaaatttatttaggctgggtggagatgtcattgccaccccctactgaagctcaccaccatgacccaccatttccattttttttaagtctgcaaaaggatgatgaagtgtgtgcaaaggtatctcagttccagctgctggagtcaccgtggtggagtttggggtgcccaagggtcaggactgcttgacgcttgtgcctcagagatgctggcagcacttggaaccacaggcttgtcctcaagctgcatggcacctgcacctccttaatgaaaaatttcggcacttccctaggcaggaggtataaaagaccaagggacacagaggtaggctggtcttaacttcaaaggctgtctcccctccttgggtccagaagtgctagcaattcacttttgctcctgagggtgggacatggtactaatcatccaatagcaattgaagggcagagggagaatcgttcttaaatttcagcctatgtgagtatcaccaaggggagcttactaatatgtgggtcttggctcccacccccagacattctgattgggaaagtttgggaaggttggcaaaggggctctagaaccaaggtgctaggtttctctgatgccagcagttcacgggatcttactttgcaaaacattctcataggacctgcgtggcccggggatgagaggcaggaagttattttgtcatctccctctccccacatccacacttcatattgccgcagtcccttctgaagctctgtgagttcatcttacccggcatcagctaatagaggcaagttaaatgcaagggggaacgagccctctttccttaagactgagtacatttggctgtccaaggagtgtttctcacattttaatatgtatatgactcacttgaggaccagtgttaaaatgccgattctgaagggtaggtctgaggtgggcttgaattctgcatttcttttcttttttttcctcatatttttccagttttatttgt

SEQ ID NO: 15055 - DNA, 4800 bp, Human
tatgttttatcagaagtcaaactggctgggcacggtggctcatgcctataatcccatcactttaggagatcaaggtgagtggatcacctgaggtcaggagttcaagaccagactggctaacgtggtgaaaccctgtctctactaaaaatacaaaaattagtgaggcatggtggtgtgcacctgtaatcccagctactcagggggctgaggcaggagaattgcttgaagccaggaggtggaggttgccataagctgagatcgtgccattgtactccagcctgcgcaacaagagcaaaactccatctccaaaacaaaacaaaacaaaacaaaagtcaagctgtatatatttttccaaaaaactgttcctgtcttcccctattaaaacacctaacgaagcttcctatgtgacagatttaattaccaaaaacttaatcaaaaattattctgttcatttattcagtaactatttcctaaacatctaatacatgccaggcaaccttccagcggcaaaagaaaggaaagaccttgctcaacataataatgcaagctagtaaaaaattcctgatatttgagttaatgaatataagcactcacgccaccaactacatgcaagctgtgataaattactttaaaagatcaccacgagagggcactcctacaattcttttatgtgactactgtcaagattcctgaacacagagttgagagccagatctgaaaccttaacaaaagtgaaggaggaaaggaagcaatctgaccccaaatcccacagaacaaaaacataaaatagcaatctctaagtttccagaaatctcagtgactctgggtagcagcaagagtgagcaggtggtaagcttctcaggaatccaaggctctggcccaagccgtcaactctgcacatgaggtgacccgggaagccagccaggcatctcccactccccacggtcttggtacccctcccccacaacctgcaaaaatccactctcatgacagactaatctgtcagcaggggagaaaagcaacacttctcccctttcctgaaacaggtgccgggggagacctcatgactccttgggatgcagctcccatctttttcccactcaactgtgagcccaaacagccattctgaatgtcccctgtctcattccctccccaagtgcatcccagcctccactgatggagggagaaaggccagggagggaatgtagggccaggtgagaagattccagccctagatccatgtcggtgctctggactccaagagaacagtgtaaacctgctcttacccactgagggtggaggggcaggaatgagtgtcagaggaatggagaggaacaaacaagccctcgtacccaggtgggccacagtagggagccctggcaactacaatcccacctctggcccatggcaggcagagaggcatcagcagggtgaggtgagaaatcatcatcactcggccaaaggatggagcactgaagctgggttaagtttagggtgctagcacataggaggagaaggtatacatcacctgtaactgtaaagaatacttcaaagatattttacaggaatataagcttcagataggctttttaagaaataagccataatcaagcacgtaaatcaaaagaatctgcaaagaatctgctgtgggtcagaccttatttctaaggtaaacattaaaaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttgaatctgggaggtggaggttgcagtgagccgagaacacaccattgcactacagcctgggcgacaagagtgaaactcatctcagggaaaaaaaaaaaaaagctctgggttgaaacccgggcgccgccaagatgccggctcattactcttctctcatggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgcaattccaaaagtcaaggtgagaaagaaatgtatacactgggaatcattagttttcccattcctggagagcctggttttccacttcacgcaatttataccaaacctgcaaacaaacaggaagatgaagtgatgagagcctatttacaacagctaaggcaagagactggactgagactttgtgaggaagttttcgaccctaagaatgataaacccagcacgtggtggacttgctttgtgaagagacagttcatgaacaagagtctttcaggacctggacagcgaagggagcccgggcagccgccatctccagagccctgggcagcattttccagcaagatgtacacaatcttttgcctttattcgtaacgttttatatagaagagagaagagcatgtctttacttgaaaaactcttgatcaagaatttgggtgggagaaaagaaagtgggttatcaagggtgatgtgaaattttctgcagcattaagctggcgcttaataaaaataagtaacaaaaaaaattctcccttacctccctcgtccatttggatgaactatatgtcttttaaggcaacatatattaaaatgtaccttatttcccactttgatcagacaattcattgattattgtttttagaacacaaggtctcaacaacaaatgaagttattaaacaggaattgagggcagacgctagacaatgacaaaaactgagtccttttcaaaattactctgaagagacctttagggaccacaaatgcttttgagactgatctaagtgatgaactagcccctccacccttccctatccagaagaatacacatatgaacactaacacaaccatcttcagactgcttcaggaggtccacacaccaactgaagccatcatgaactctctacacatccatgaatgccccttagttacggactcccagaagaagagaataaacactgcttcactaaatataaagtatgaatcttaaatttggaggttcacattatgtgaagattattccaatgatatttaggggaaaaaataactcttatgatgaatgctaacaggattttagaatacaaagtcctacatgtaaaattagcttacctcgaaattcacaggcaagttccgtttaagtgcaatctcaaacacttgacttatttcagatttattgagattttcttcttcggattctcttccattcacctgtaagaataattgtttagtagttagctcttattaaaatagtcaatggccaggtgagttggttcatgcttgtaatcccagcactttgaaggctaaggcaggaggatagcttgagcccaggagtctgagaccagcctgagcaacatggcagtttgagaccagcctgagcaaccttgtctctaaaacaaaaacaaaaacaaaaacaaaaaaacaaaacttaggtggatgtggtggtggtacatgcctgtagttccaactacttggagggctgaggcaggagcattgcttgagcccaggagatcgaggctgcagtaagccatgatcatgcgccactgcactccagcctgggtgacacagcgagacgctgtcccccacaaaaaaacacccatcaacatcctagctgcaatggtaaaccttaaaagcactgagctttggctttatgaatttaaccacacacataccaagtgtcactgaatttaagaggttaaaaagatacatgtcctgtcaagtttgagtcaaattgtacctcataagttcaccaaaaacaatccgcacataatagacctttggatatgtgtcagcctgactgtggttcagcaagatgtcactgctgctcggaacagtgacttccaaaagtccttctcaagtagtgggaagccacattttggaaaagtcaaaatacagacagatatatgtgggacgtggcaaattcagattaagtctgtccacatgagtatgcaggcttatttgaacataaattccctggaaaccactttttttttttgagatggagtctcgctctgttgcccaggatggagtgcagtggcgcgattttggctcactgctacctccacctcccaggttcaagcgattctcctgcctcagcctcctgagtagctgggattgcaggcatgcgccaccacacccagctaatttttgtatttttagtagatacggggtttcaccatgttggtcaggctggtctcgaactcctgacctcatgatccacccacctcggctcccaaagtgctgggattaaggcgtgagccaccacgcccggcgggaaaccactttaagagaatgcagccatgcgcatggcagtacacgactattgccccagtactcagcaaggtgacagttgaggatcagttgagcccaatagttcaaggctacagtgagctgtgatcatgcctgtaaacagccactgaactccagcatgggcaacaaagactctctatctctataattaaaaataaagaaataaataaggatgcgatgaaacacattacaaaactgccatgtatctcatactcaacggctgtt

SEQ ID NO: 15056 - DNA, 10086 bp, Human
  misc_feature (1)...(10086): n = A,T,C or G
aagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacagtggctcacacctgtaatcccagcactttgggaggccgaggcgggcagatcatgaggtcaggagatcgagagcatcctggctaacacggtgaaaccccgtctccactaaaaaatacaaaaaaaattagccgggcgtggtggcgggaacctgtagtcccagctactcaggaggctgaggcaggagaatggcgtgaacctgggaggcagagcttgcagtgagccgagatcacaccactgcactccagcctgggcaacagagcgagactctgtctcaaaaacataaataaataaataaatatcatgccattttgttatacttcagattctagctttttaaaggcccatacatcttaaactttgttttttggggatcaagtctcaaaaatgttgtctaagatagacaatgtttcctctggggtgtggagttccatcatttgtcaggcatcatgcatatttcagtattttaccatctagtgacatcatccatctgctgactcctgatgttttaatgacaaagttggcatcactgggctccgggaagcgtcatgctgggcatgcccttctaactctctgaactcccgcatccttactcacctatccacacgaggggctgtagaatagaaaattttaattttcaggtcagatttcctatgattctggaccctaaaatctttgtaatagagtccactctgctgtgattgggtcatccatacatcatcctcttgaccttcacagtctgatcaattcatggtcaggtttatttatctggattcatcagcccctgtaaaacatgccatgtgatttcatccttatgaagaaaaatgtgtaagcgcctggaggctaacgatattaggaatgcaatttaaaattataattgggagctccaaaaataaattcagattaaaacttaaaagaaaatgctgggaaaacatttttttattggatacaagttctaatgtgatcaagaagaattcatggaaaatggatgtctcatattaacatagcaggtggatgttcatctaagcctcttgagtggtgtttaaaatcacttgtaccagttagcatgtgatttaagtatcactggacccaccctcctagaataaactgaattagacacatcattgcttttcttttgtttgtttgttaagagaaaataggatgaaaagatagatcatgaattagtggcgtttgttgtagagcctcttcatggtgaggcagatacagtaattttggaaatatgtaacatgcaaagtgtgtgggcctgggtgagatcagaggccaggctggctcaaggtgaatcctgtactgagtccccagtagggtcacgcagtccaaccgggacaatttccttttcttaataaaacagtggcttggtaaagctaacagaaacttgaagatttcaagatctaatacattgaactttcggaataaaatcacagtgtactaatttcatgcaggaatggacagaccacaagttacgctggaatcctgatgattatggtgggatccattccattaaagttccatcagaatctctgtggcttcctgacatagttctctttgaaaagtaagtatcacattgtttcttacttatggggaaaaaaataaattttttaaaaagtgaaaaaaaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaataaataaataaataaataaataaataaaaaataaaaagtgaaaaaaaggaaagtaagtatcacagaagaaaactattttggtcagattaacactaggaatagaaaattctgattcaggcaaaatacttaaaagaaatattcaattttaaataaaaaaattgtttattaaaacagttacctggcgttgtggtagaaaagtcctaaaatagggcagggtgtggtggctcatgcctgtaatcccagcactttgggaggccgaggcgggcaattcatgaggtcaggagttcgggaccagcctggccaacatggcgaaaccctgtctctactaaaaatacaaaaacttagctgcgcatggtggccggtgcctgtaatcccagctactcaggaggctgaagcaggcaaattgcttgaacccgggaggcggaggttgcagtgagccgagatggcgccaccgcactccagcccgggcgatagagtgagactccatctcaaaaaagaaaagaaaagaaaagtcataaaacagaaatagtcaatgctgggaaaaagaacaaaaactagcaggtgctccaccgactgctaaggtgaaactgctttgattgcagtgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtgagtaaactggtattcctgataatgctgccgtaaaggtaggccaaagacaaatattttgacatctgtttacaataaaatattgtcatggtttaaatgtgacattatataagacatgctttttatacatataacatttaaagcaagccctgacataacatagcgacattagtatgaatttttaggaagtagttcacaaaaacataaggagcaaaagtgaagcaactgttgattaagcaactgttgattaagcattgtttcttataattctatattaaataattcaattacacattttaagttggttagcctggtttctggtaatttatctttcatttttcattggatgataaatatgttcaaccacagtatttagaaataaaagatcagaaagaatgagatttttaaattaatataaaatgtagtgttacaacagatattttggtgaggaaagaggatgtggttatttagtttacagattttttttttttaagtgtgagccaggcacagtggctcatacctgtaatcccagcactttgggaggccaaagcgggtgtatcacttgagtgcaggagatcgagaccagcctggacaacatagtgagaccctgtctctacaaaaaatttaaaaattaactgggtgtgggtgggcgtgcttgtcctagcactttgggaggctgaggcaggaggatgacttgaggccagaattgagaccagcctgggcaataaagcaagaccctcatctcagaaaaaagaaaaagaagataaaagagaaggagaaagaaaagaagtagcgtgggaagagtgtgaatttcagactgaaaacagtcctgggttcagatcataatctgaatgacttaagacaagttacttaacctgagcctcagttttctgaatcctaccttgaaaagtttgtgtgaggattaaatgacataaaatacaaacatgcacagtgtacccagcacacaggggctcagctccgttgtataagcagtcaacaagtgtgaattctcgcctttctaattatcatcctcatccttcttctttttttttttttttttttttgagatggagtcttgctgtcacccaggttggagtgcggtggcgtgatctcagcttactgcaacctccgcctgctgggttcaagcgattctgctgtctcagcctcccaagtagctgggactacaggtacacaccaccacacctggctaatttttcttgaattttcattaaagatggggttttgccatgttggccagaatggtctcgaactcctgacctcgggtgatccactgcctcagcctcccaaagtgctgggattacagccaagagccaccgtgaccagcccattcttctaaacagtccttccccagtggaatgaaaatattatttgacgtgcagatattaagcgtaaaaagtgatctgttgggccaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcagctcgagaccagcctggctaacacgttgaaaccctgtctctactaaaaatacaaaaattagctgggcatggtgacgagtgcctgtaatcccagttactcgggaggctgaggcaggagaaccacttaaacccaggaggtggaggttgcagtgagccaagattgcaccactgcagcctgggtggcagagtgagactatgtctcaaaaaagcaaaacaaaacaaaacaaaacaaaaacctaatacaaagatttcttttttttccccaagacggaggacatttatttactctagagggatgaggactccccttcctttcagacttccccagccagtcgtgccttgactttgtgtttatggacctgttgcccactctctgcacctccccttcctaataaaggggactcagtttcttgtctccttcatgaattcctgtcttgtcctggtcggttcttctccttggcagcacccttccttctggagctgcagcacaggtggagtggaagaaaagaaagcctgtgacatttggccacaaaaactcttaaattataaacttgtgattcttttcatacgtgtatcaggaagcaccctagtaagatatactggcttcctaagatatgctctgtctcctgggttcaagcaattctcctgcctcagcctcccaagtagctgagattacaggtgcccgccaccatgcccagctaatttttgtatttttagtagagagggagtttcaccatgttggccagctcgtctcgaactcctgacctcaggtgatccccccacccccaggcctcccaaagtgctgggattacaggcgtgagccaccgcacctggcctatagtggctctttattcatgtaaaaatcagacttttcctattctgatcaggaatgttgacatatgcatacagaattctattgtttctattttccttcttcagtgctgatgagagtgttccaagctgcttcttttgggcacaattagcgaagtccctgaaagaacctgagcctgtagtgtggttgggacattagatgcattttgaaaacttaagtaaatgctataaatctgaatgttactcttttttaatcccttgagatgaatacagaacagttgctcagtgtcttgagtgaaaggcatctttttctcttttgcaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaccccgaatgcgttgtctttgtggaaatggaacatctcctcatgggagaaactctggtaaatgtgctcatttgtggttgccatgagagtgagctgcttttaaagaaagtggagcctcctcagacccctgccttggctttcccagacattcagggagggatcataggtccaggcttgagctcacatgtggccagagtgcacaaaaagctgttgctacttggtggaggaacacctcctagaagcagcaggcctcggtggtgggggaggggggattcacctggaattaaggaagtctcggtgtcgagctatctgtgtgggcagagcctggatctcccaccctgcactggcctccttggtggttttgtctgagctgcaaactggggccgtgttatgcttgttagcaatgggccaggcaaatctcaacaagggtttggggattacactggcaggacagctggcactgcacacttaacaataacacagattccaagttgcctggcctaccgaagcaggtgttattcatggtttattcccagcatgataaggctttcagatggtgaaactggagcccactgtgagctgtgacttcctttaaggtcatgcataccaaaataactcacaatagaaacaaagccctttgctaccagaagtggattcattaatacccattatcttttcctagtaaactagtgtacagaacattctctgattaatggtttttgatgtcacctcgtctaatcggatccataccaacactatcccctaggctccacctgctgtttccctgtctcctggcacctgggtgggcttcacccccacccaccatcattccttctctaagactccgaggggagtctgctcaggttcttcttgccctccaaaattgctgcctctgcccaatccttcctgaattttagcttaaagcaatttttctctctgcccagttataaatccaaatccctttctggagtacttttaggcatggctcttgcaagcagtttgcaatctaggctgggtggagtggctcacacccataatcctagcactttgggaggtcaaatcaggaggattgcttgaggccaggagtttgagaccagcctgctctctacagcaagaccctgtctctacaaaaaatttaaaaaattaaaattttaacaattttagtgatgtgtgcctacagtctcagttactcaggaggctgaaatgggaggatcacttgaacccagtagttggaggctgcagtgagccatgattgctccactgcactccagcctgggcgacagagcaagacgcagtctcttaaaaaaaaatctaagtggctgggcgtagtggctcacgcctgtaatcccagcactttgggaggccaaggtggatggatcgcaaggtcaggagatcgagaccatcctggctaacacagtgaaaccccatctctactaaaaatacaaaaaattagccaggtccatgcctatactcccatctacttgagaggctgaggcaggagaatcacttgaacccgggaggcagagcttgcaatgagccgagattgcgtcactgcactccagcctaggcaacagaacaagattccatttaaaaaaaaaaaaatctaagcatgaaacaccttcacatattgttaccactgatgtatttcgtcttattaatgccatttagtttgtgctttctgtataacattctcttgttccttcacctttttcccttcaccttttcccccactttttcagccttggccgagtttgtagtttgtccattccttctttgcctttaatggcttgaaagttacatgtccgcttctattaatttattaataaacattcaactttttaaatcaatgttgagaattagtgtttgtggctgccactttctacacaaaataatttctttaggaccctcacttcccctcaccttcatttcacttttatcactttccacattttctttaaatcatccagaattttagttctacatgattaatttttatattat

SEQ ID NO: 15057 - DNA, 51403 bp, Human
  misc_feature (1)...(51403): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgcctgtaatcccagcactttgggaagctaaggtgggaggattgcttgagctcaggagtttgagactagcctgggcaacatggtgagaccctgtctctacaaaaaaaaatagaaaaattagctgggcgtggtcttgcactcgtgtagtcccagcaacttgggaggttgaggcaggaagatcactttagcctgggagattgaggctgcagtgaaccatgatcacaccactgcactccagcctgggcaacagggtgagaccttgtctcaaagaaacccagaaaacttggttcttattttgagtgggagaactactaagaatttcattatttggaagtattcataggctgctaaataattaatgttcacattatccccttagtgtcctaaattgttaggagatccaaacatctttccattctgaggtagactcatcatactaggtaatgacttccaagcttgtattacaaatctgacagtctacattttcaatttgcttaaagtctttcaaaaatctttttatggtgcttattttgatatcattaatttgtttcattattgataacaccatttaattttgtttcgtatctttaagtctaatactagtaatgagatgaagctaccgtcactgaaggatatttattataaaaaacaaagggaaaacaagcagttacctgagaggaatctcacttctgcttccaacccaaatcatccaccagaggtaaagttgtccacattctgccgagtgaacgtgaacaatgcttcctgactctaacttttacctcaagcttcattttccctaggagatctaaagcctactcacttcaaaacaagcaaaacaaagccgagttctgagggtaagacttcgttgttgtctggtttccaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagtatgtatttcagtgaatggcttgtaatgttaatagattttctgtgatatctgattgaaaatgatctttattgaacttcagtattgcataaagtcttagagatttagcatttttaagatggagcatataaaaactttttcacttgattgttaactttttgtgtattaatctatatattttgtagtatgcaaaggaaatatgctatatttttgcccatgagaatcattgtgttcttggtttctcttgtgggatggagactgaagatagctttcctaatatatattttttattctcactgaataaggattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacaggtaaaatttataatttagctgtgaagttttctccaccttggatgtattattttcacagaagtataatgtgagaaaacactttgaaaatactttggatctgaaattttaacagtcatgtttgcctaagtatttttgaagctaaacccccctcttataatacactaataactgacgtggagccatttgtttcacatgggcaaaatactgaaacagttgagcgaattttgtatatgcagagtaatgtcattgatgggaggagcagtactatggactttctaataagtctatggcttatgtcctgtggcagttcttcacctttttaataggcccattccaaaaaaacccacaaagatatgcaggggagaatggccttatattcaggatagcttcatacctattttagaatcacttagaaaatctgatgctttcactactagtattagtagtagagtccttgcaacatactttaccattaaacgggacttgatcaggcatggtggctcacgtctgtaacccagcactttgggaggctgtggcaggcagatctcttgagctcaggagttcaagaccagcctgggcaacatagtggaaccctgtctctacaaaaaattaaaacgttagttgggcatggtggcgtgtacctgtggtcccacttactggggaggctgaggtgagaggattgcttgagctcaggaggtcgaggctgcagtgaactaaggttgtaccactgcactccagcctgggtgacagagcgacaccctgtctctaaataaataaataggacttaaatagattgaaaatcgatgcaggtctagctgatagcaaggcattctctaaggagaaaagacaaagctcacttcaaagagcttaggagggaactaaaatcttccgtctggttaacagtttaactttcaaaaaaacaaaacaaaacagtttaactttcaaagttatgggaaaactagcctttatactgtaagtagttttggttgctgtggtagttaacatggctgtcttattgaatgtttctacagctttcattttgcatttagtagtgtgggggtacaatggtagggaaaagtaatttgaaaaagagccaaaccaaaagaaaagagacaggtttaggttttttacgacacaaacagtagatagcaggttatgggaagttggtttttttattattgtttttgtttagaaggcaaagatgaggctgagtgtggtggctcacacctgtaatcccagcagtttgggaggccgaggcaggcagatcactagaggttaggagttcaagaccagcctagacaacatattgaaactctgtctctactaaatatacaaaaagcagctggatgtggtggtgcgcacctgtagtcccagatactcgggaggctgaggcaggagaatcacttgaacccgagaggcagaggttacagtgagccgaaattgtgtcactgcactcctgcactccagcctgggcgacagagtgagactcagtttcaaaaaaaaaaaaaaaaatgcaaagatgactgtagttacttcctgtaggaaaacaagtatgaaagaagcccgccagtgaacttttgaagattaaaaacagtcctaaagaaggtacctagaataaattatagccagtcaaaacatttttatgactagaagatgtttgagcgtgtagggcaatgagcaaatataggtggagcaaattggaagccagggttttaagtaaatggctgtattatagcagttaataacagtggcaggcttggttactggagtagatgtaatcactgtgtaaaatgaatagcagtacattattttctcctcttcccaaaaaagatttgatctggcttatggttaaaaaaaaaaaaagctgtgttacagaggacagtagaaacaaaatacgtggcagtcatttagaactggagaaatgatttcccccaagataaaaaaccattgttatcagtgtatacactggttttttccaaacttaaaattgcaaattggagaatccccctggtgttacaaatggagccattagccagctgtgatatcagattactatgtcacggatttagaacttgggacagtgatcctctggcacattagaatccatagtactgaaaaaagtcaaatacaattaacacacacttgattatttgagtgattttttttcaagaatagtctcatcagtatttcatgtctgtgccgcattaatgcacagtggttaggatcatgaactaggagtgcccagcttatgttcccagtgtgactgcttacaatctgtgtgactttcagtgaggaactgaactgtctttgttttctcaactgtaaaatgggatcaatgataatctttttttctttctttctttttttttttttttgagatggagtctctgtcgcctaggctggagtacagtggtgctgtctcggctcactgcaagctccgcctcccaggttcatgccattctcctgcctcagcctcccgagtagctgggactacaggcgcccgccaccatgcccggctaattttttgtattttagtagagacggggtttcaccgtattatccaggatggtttagccaggatggtctcgatctcctgaccttgtgatccaccggcctcggcctctcaaagtgctgggattacaggcgtgagccaccatgcctggctgggaccaatgatagtcttaatggacagaattgtgaggataaacgaaacgtgcttaaagacctggtgtatagtcagtgctaaataaataaagcttttattattcatactatgttaaacaccgagtcaagatggtaactgaattcttctatgtattttgttattttgaggatctgtgataattaactttacaaaggaagttaattataagaatagttatattcgtgctaaattcgaaatagtacagaaggtcataatatgaaaagtaaattggatcgcatgagtccaggagtttgagaccagcctgggcaacaaagtgagatcccatctctacaaaaaatcaaattagctgtgtgtggtggtgcatactcaggaggttgaggcaggagggttgcttgatcccagaaggttaagtctgcagtgaaccgtgattgcaccactgtacttcaacctgggttatggagtgagatcctgtctcaaaaaaagaaagaaaaaagtaaatctccctaccccaacctctagtcccaaatcccaaatccaaatttaattttttgcatttttccagaaatcataatgcatatatatagatacagatttttttcaagctaagatcaagctattttatgcatgtcttttttttatatcttttaaaaaaattattttaggctttttttttttttttttttttttttgagacaggttctcactctgtcactcaggctggagtgcagtgttgtgatctcagcccgctgcaacctcagcctcccaggttcaagccaccctcccacctcagcctcctgagtagctgggactacaggcacatgccaccatgcccagctaatttttgtatttttagtagagatagggtttcaccatgttggccaggctgatcttgaactcctggcctcaagtgatctgcctgcctcagcctcccaaagtgttagtattacaggtgtgagccactgtgcctggccaattttagccttttctctacatactatattattagattcattgggctatattctattaaaatggcatcctgagtcttagttaacactggagaatttgtcttatgttatatattagagaattggttagatttatgtaatacttttaagggtaataattttatcttctaattgaagctaaatttatggtttttagatgtggccaattagatagtgctttgcatgaagctactagtcgcgtgagaacacttgaaaataagaataacttactggaaattgaagtggtaagtactctttttttggtgggtgttctggtgagacaaatgaattatttcgtgataacatcagttatgtttcttgtctttttaaggaaggcttatgaagtttatatttttagtgctgttggcttcatataatgctataaactttacccttttttttttttttgagacggagtctcgctctgttgcccaggctggagtgcagtggcgcggtcttggctcactgcaagctccgcctcccgggttcacgccattctcctgcctcagcctcctgagtagctgggactacaggcgccctccaccacgcccagctaattttttgtattttttagtagagacggggtttcaccgtgttagccaggatggtctcgatctcctgaccttgtgatcctcctgcctcggcctcccaaagtgctgggattacaggcgtgagccactgcaccctttttttttttttttcttttttttgagatggagtctcgctctgtcgcccaggctgtagtgcagttgcgcgatctcagctcactgcaaccttcgcctcccaggttcaggcgattctcctgcctcagcctccctagtagctgggactacaggtgcatgccaccgtgcccagctaatttttgtgtttttactagagatggggtttcaccatgggggtcaggctggtttgtaatgcctgacctcgtgatccacccacctcggcctcccagagtgccgggattacaggtgtgagccaccgcacctggcctaaactttacccttttaaaacttaccttttggccaggtgtggtggctcatgtcagtaatcctagcactttgggaggctgaggtgggagagttgcttgagcccaggagttcgagaccagcctgggtaacatacagagacctctgtctctacaaattagctgggcatggtggtgcacagctgtggtcccagataatcgggagactgaggcaggaggatgacttgatcccaggaagttgaggctgcagggatcatgattgcgccacagcactgtagcctgggcaagagagcatgaccctgtctcaaaaaaaaatttttttttaattttttgcaatataatttgcataccataaaacttacccttttaaagtgtacaattccatgaattttagtatatttagagttgggcaaccaccaccacaatcaattttaggacattttcctcaaaaaaaaaaaaaaaaaaaaaaaaaaaacccacaccccttaaccgtcaccccccacattctgtccttccacaccctggcaaccactactcagttttctttctctgtgcatttgccttttctgaacattgatataaatgaaatcctagactgtgtggcctttcgtgtctggcttcttcacttagtataatattttcaaggtttatccatgttgtaacatatcagtattcattcctgtttatggctgaatatatttcattctgtgaataataccacatttttgtttacattcatcaggtaatgtttatatactttctggctatttaaattatattgctatgaatgtttgtctacaagattttatgtgccacgtaagtttttagtttccttgggtatataactaaaagtgcataaactttttatgctaaaattacttttttccccacgcattaccaaattttatttttttacaggtaactttttttctttctgaacaaagacctttgttatgtcattcccaatcttttggtataaggcaatctttttaagggtcaaaagtttctcaaagtctgtgtttacaagttttatttttaatatctattagacgataaaatgcatgatagctatcatagagtagtgtgtatatgtatgagatacatatggccttatgaacaaaattttggtggaaactgtctattttgtttttttgttgagatggagtctcgcccttgttgcccaggctggagtgcaatggtgcgatcttggctcactgcaacctccatctccctggttcaagggattctcctgcctcagcctcctgaatagctgggattacaggtgcccaccaccaagcccggctaatttttgtatttttagtagagatgggatttcactatgttggccaggctggtctcgaactcctgacctcaggtgatctgcccgcttcggcctcccaaagtgctggggttactggcacccagcgtattttgttttatatgttgttttcatcttagccttttttttttttgagacagggtctcactccatcgcccaggctagagtgctgtggagccgtcatggcttactgcagtctcaacctcttgggctgaagtgctcctcccatctcagcctcctgagtagttgagactataggcacacaccaccacacccagctgatttttaaaattttttgttgagacacgctatgtcgcccaggctggtcttaaactcctgggctctagcagtcctcccaaagtgctgggatttccgctgtgagccacagtgcctggcctgtttgcttttttagttcctctcctcctaagcttcatgacattcgggactattatcttttttgttaatcttacatttctagcaccctagtgcctagcacctagtgggtattccagaaatgattgttgagtgaatattaacatatcagatgggtttttaatttcctgtattttcttttttttttttgagacagagtctcactctgtcaccagggctggagtgcagtggcatgatctcggctcgttgccacctccgcctcctgggttcaagtgattctcctgcctcagcctcctgagtagctgggattacaggcgcctgccattaagcccagctaattttttgtatttttagtagagacggggtttcaccatgttggccaggctgctcttgaactcctgacctcgtgattcacctgcctcggcctcccaaagtgctgggattacaggcgtgagctactgtgcctggccaactgaatttcctgtattttcatagtgagagggtatgaaatgtttttctcctccctaaatgttgatgttgggcaacaaagtccagctatactttcaaataatttccctaatagcagtggttattttttccttattaaagtgaactgtaggagctattaggtgagtcctagagtcatagtgccacagatgatagtttcctgtataccttatgataatgtcaggggctggtattccagtagaactattctttctggactctccatcccagaatacaacaaaatagatttgttcatttccatttctatgttttgttcattttttaatgcccacaatttattagctattattaaggcatctttttttttcatttaaaataaattttgggctgggcgtggtagctcatgcctgtaatcccagcactttgggaggccgaggcctgtggattacttgaggtcaggagtttgagaccagcctggccaacatagtgaaaccctgtctctactaaaaatacaaaaaattagccaggggtgatggtgggcgcctgtaatcgcagctctcgggaggctgaggcaggagaattgcttgaacctgggaggcagaggttgcagtaggccaagattgcgccattgtactccagcttgggcaacagagcgagactccatctcaaaaaaaaaaaaaaaattatgtttgtctttgttttatagaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatgtaagtagcgaataatagtaacttaatgacgtgattggctaaaagtaatttaggtattatactcttacaagtgattatgactttctaggcttattttattatttattgatttattttgagacagagtctcactctgacacccaggctggagtgcagtggcaggagctcaactcactgcagcctccacctcccgggctcaagagatcttctcgcctcagcctcccaagtagctggaattacaggagcccaccactgcgcccggctaatttttgtattgttagtaaagacagggtttccccatgttggcctggctggtctcgaactcctgacctcaggtgatccgcccgcctcagcctcccaaagtcctgggattacaggtatcagccactatgtccggcctttattttagttttacataactttgcagcaactgtgaatatgtaccttcctgatggagtcaattgggtcttgctttgcagcacgaagtcagatacttagaacgatggcatcactcccatatcttttctgtttctagcaggtcaacttaaaaaaaaaaaaaaaactgtgtctgcatcaggtcaactttcaagctatcttaacatttgtgtgtctggcaggataaaatgctatgaacagatttagagcaagtttgattaaattttttcactttgatataatttcacttaaaatttggatttgtataacattgaaaccagattaggtttcaggttgcttatttttttctaaatttttctttctttttgttcttagaaacagggtctcgccatgttgcccaggctggcctcaagctcttgggctcaagcattctcctttcagccttctgagtagctgggtctacacgtgtgtgccactgcacctggcttctaaatttttcttaacatcgtttttcaggatattacaatacatgagtaatctgaaagtatttaggctgttgaaattttctgattgctttagatttgcatctcatgaaaaacagcagtcttccctacctaccttttagtatcctaccctagaggctgttactttcagctcttttagctatttcttctagcattttcctccatgtttacaaataatattcttatattgcactctcattttcttttccatctatttcagacatactgactttctcccatgcagggtcacagtgtggctttcttacaccatttgctgcaacacagacacttctcctgctccttcccatgtggttcgtgtgtgtgtgtgtgtgtgtgtgtgtgtgtgtgtatatatatatatatatatttttttttttttttttttgaaagacaatccctctctgtcgcccaggctggagtgcagtggcgtgattttggctcactacaaactctgcctcccaggttcaagcaattctcctgcctcagcctcctgagtagctgggagtacaggcgcgtgccaccagctaatttttgtatttttagtagagatgtgatttcaccatgctggccaggctggtctcgatttcttgacctcttgatccgcccacctgagtgcgggattacaggcctgaagcagtatttttttcttttagtaatttgtaaaataatggtgtgatatataatcaatggtgtcttaaaatggaaattatacatcatttattacagctgtataaatattgttcacagttaagctatggtggtatactgtaattacatattacatttccttttctctctgtttttttttttttttttttttttttttgagacggtgtctcactctgttgcccaggctggagtgcagtggtgcgatcacagcttactgaagcctcaacctccgcgggctcaggtgattcttccaccttggcttccaaagttgctaggaccataggcacatgccactatgccctgacaattatttaacttttttttttttttttgagatggagtcttgcttggttgcccacgctggagtgcagtggcatgatcttgactcactgcaacctctgcctcccgggttcaagtgatgcttctgcctcagcctcctgagtagctgggattacaggtgcacgccaccacacttggctaatttttgtatcattggtagagacagggtttcgccatgttgcccaggctggtctcaaactcctgggctcaagcgttcctcctgcctcagcctctcaaagtgcagggattacagggattacaggcatgtgccactgcacccagcctttttctcattaagcttttacctcctagttttagcttccattgaggagtcttgcctgaaagaagcatgtactgtggtgtgtttttctaattctgtattccttctgcatttgactgaaaggagcttccctctttccttgacttatttattatttgcctttagagacaggtccttgccctgttgcccagcctggagtaagcaatccttctgccttagcctcctgagtagctaggatactactactaaagtgcatgtcctttctttgttatatcagtaaagaagattgatggattcttattttactcagtggattgcggttctttaccatgattattttgatactcatggtgtcccaagtttggccagtgggagacatgtcagactggtcccgtgtccttttgacttgcttttgtcattctttgagcatgtccatatttcctggcacagcactatgttccaggctcatcttgtacttttccaagctccagtcctagaatcagtctcattttttctgttgagttctggttccttttcatggaaaatggtattcagacattaagatctggtgctaggctgagtgtgatggctcatgcctgtgatcccagcactttgggcagccgaggcgggcagatcacctgaggtcagcagttcgagaccagcctggccaacacggtaaaacccttgcctctattaaaaataaaaaacattagctaggcgtggtgatgcacgcctgtagtccaagctactcagggtgctgaggcaggagaatcacttgaactggtactgagtatgttcattgctactgggatgtcattgtttctttttctttttctttatttttggagacgaagtttcattcttgttgcccaggctggagtgcaatggtgcaatctcagctcaccacaacctccgcctctcaggttcaagtgattctcctgcctcagcctcttgagtagctgggatttcaggcatgtgccaccatgcccggctaattttgtatttttgatagagatggggtttctccatgttgggcaggctggtctcgaactcccgacctcaagtgatccacctgcctcagcctccgaaagtgctgagatctcaggcatgagccaccgcgcctggcctgggatgttattgtttctaattattcacaaacccaccacagttatgtttgagcagcaatcaagcagcaaaggatagctagaatgtgttgtttttagctgaaattgtattaatgtagacagtgatacactgactttgcatttatcatatacaacatttcaagcatacagaaaagtatagagagtaatataacaaataccgttctagccttctctagatagagtgaaacactgtcttctattcctctcttccccaccctagaggtactcactttgttaaatgtgctctgttatcctcatgcagttctttttgcttttactacatatgcctgtgtttgtaaacaatatttagtaatgttttatgtgttcttaagcaatgtatgaattgtattgcattgcatatatcctgctgcaacctggtttttccctttcaacattgtttctgagatttgccatgttgacacattcagcttttattgattcattttaatttaaacatttacatttgaaatatcttaggtacataaaaagatatagagaataatataatgtacatatgaatccaccacctattttaagaaataaaatactccggccgggtgtggtggcttgcacctgtaatcccagtactttgggaggccaaggcaggtggatcagagtcaggagatcaagaccatcctggctaacacgttgaaaccccgtctctactaaaaatacaaaaaattagttgggcgtggtggtgggcgcctgtagtcccagctactcgggaggctgaggcaggagaatggtgtaaacccaggaggcggagctttcagtgagctgaggtagcgccactgcactccagcctgggcgacagagcgagactccatctcaaaaaaaaaaaaaagagaaataaaatactacaaaatgcagttgacatcccctgtgcacccttttctgatcacttctgtcttcctgggagtaactgatctaaattgtgtgaatatcattaccttgtctttgtatggtcacatgtgtatgtatgnnnnnnnnnnnnnnnnnnnnnnnnnnnnnnnnnnnnnncccaaaccgcctgaccgcctggcaacatgactttcttttttttttttttttttgagacggagtctcgctccattgcccaggctggagtacggtggcgtgatctcggctcactgcaagctccgcctcccgggtttgtgccattctcctgcctcagcctccctagtagctgggactacaggtgcccgccaccacacctggctgatttttttggtatttttagtagagacggggtttcaccgtgttagccaggatggtctcgatctcctgacctcgtgatccgcccgcctcggcctcccaaagtgctgggattacaggggtgagccaccgtgcccggccttaatactgtctttaatgttatgcaacttttttcacttgtgagattcacctaactggatacatgtagtagtagcacaacttcatttctgtttattcctgtgtcgtccatcatgtggctcttccatagtatatttatccactttccttttgccagtttgtcattgctgttaggagcaatgctactatgaacatttcttctatgtggctccttatgccaatgtgtgcaagcgcctctagggtattgttctagctgccatagctccaaaactcataacctcaaatcttgacatattctgttcgtggactctgttgttcaggagcttgcactgggcccagcagggacagcctgtctgctctgcagtgtctaggacctcagctcaaaacttaaggactgggagctggaatcttctgaagggcatgttccatcatgaatggtggctgtcagctaaggccacagttcctctctatgtggttaggttgggtttctttgcaacatgatggcttactactaaggacaagagtcctgaaagagcatcccaacagctacatttacattgccttttatgaccttgccttggaaactgtacagcatcacttgtaccacattctatttttttgagacagagtcttgctctgtcattcaagctggagtgtagtggcatgattatagcttactggagccttgaagttctgggctcaagtgatcttcctgcctcagccctctgagtagctaggactataggcatacgccaccacacctggctaattatttatttttatgtttactctttattttatttttttgagaaggagttttgcttttgttgcccaggcaggagtgcagtggcgctatctcggctcactgcaacctctgcctcccaggttcaagcgattcccctgccttagcctaccatgtagctgggagtacaggtgtgcaccaccatgcctggctaattttttgtattttagtagagatgggttttcacagtttttgccagggtggtctcgatctcctgacctcaggtgatccgcccacctcagcctcccaaagtgctgggattacaggcgtgagccaccgtgcctggcctctattctattttttaaacaattccaaagtcctgcataggttcaaggggagggaaaatggataccatctcttaatggaacacagcaaggttctgcaagagcttatgggtctggaaatattgctgtggctgttactgggaaatatagcctgttataatagtctctttctctgaatgcagtggttgggacatagaatatgagctttgttatcttttttagatattgctaaattgctctctgaaatggttgtaccagtttattttcctgccagtagtgtatgataattcttatttttctagattatttccagtgcttggtattgtcaagccttttaatttttcaagtgtgattaagaggaaatggttatacgtattgcatccatcttcttttggtatttttatgggatacaagttttgggtgttttttgtttgtttgtttttgagatggagtcttgctcttgttgtacaggctggagtgcaatggcgcaatcttggttcactgcaacctctgcctcccggcttcaagcaatctcttgcctcaacctcctgaatagctgggattacaggcacccaccaccatgcctcactaattctttttgtatttttactagagacagtttcaccatgttggccaggctggtcttgaactcctgaactcaggtgattcacccgcctcagtctaccaaagtgttgggattacaggtgcgagccacggcgcccagcccagaattacctcttacgtaatatatggtatgagtaggaattgaacttgatcctccctgcctccaatgattaaccagttgtcccagaatcatttttaaatagattttccttcccttactgacttctgttgtacattttatttccttctcgtgtaaatctcctttgaggctctgagctgttccattggtctgtctctgaattggaaccacatcatgtaaattattagtattttataacaagtgttgatttttggtgccatttccttatctcgtttttttgctcttgtaaaaattattttgcctatttcttggctttgttttgtttcatacaaatattactgtcagcatgccactctgctttcgattggaattgcactgaatttacagatttatttggagacagctgagacttgaaatattgattcttcccatacatgaacgtggtttaaatctcaagtatttttcttttttaaaaattaaggccttttacatcctttgttcatttttttctcgaggtatatcatattctagtatttatgtatttctaaataatgtactgatattgttcgttcgttctttttttttgagacagagtttcgcttttattgcccaagctggagtgcaatggcgcaatcttggctactgcggcctctgcctcctgggttcaagtgattctcctacctcagcctaccaagtagctgggattataggcgagcaccacaacacccggctagttttttgtatttttggtagaaacagggtttcaccatgttagccatggctggtctcggactcctgacctcaggtgatctgcccgcctcagcctcccaaggtgctgggattacaggcgagagccactgcgcctggcctctttctttcctttttgagatggaatcttgttctgtcgcccaggctggagtgcagtggcatgatcttggctcactgcaacctccacttcctgggttcaaacaattctcttgcctcagcctcctgagtagctggggttacaggcgcgtgccaccatgcctagctaatttttgcatttttagtagagatgagatttcaccatattggccaggctgacctcgaaatcctgacctcaagtgatccacttgcctcagcctcatgaaaggctgggattacaggaatgagcccctgtggctggctcgatattgttatttcttaaattttacatattatctataattgtggtgggtgaagatctaggtcctagctgaagatgaagatctagatcctaactgtgattctgggtgtatgttttcttcagatttgaaggctttgttttattgcctatgacatgatcaattcttttcctttctctcccctcccatggctttcaaagtttcaagcctgcagaaaaattgtaagaatgatacaatgaaaacccttgtatattctttacctagatttaccagttgtgagtatcttacagcattgctttgtcttcatagagatataaacttttttcttttgctgaactatatttgagagtaaattagacactatgataatttacccttaaatacctcaataggtatctctgaagaacagagatattctcctgtgtaatctcttttttttttttttttttttttgagacggagttttgctcttattgcccaggctggagtgcaatggcacgatctcagctcaccacaacctccgcctcccgggttcaagcaatgctcccgcctcagcctcccaagtagctgagattacaggcgcacaccaccccatgcccagctaatttttgtatttttagtagaaacggggtttcaccatgttggtcaggctggtctcgaactcctgacctcgtgatccacccgcctcggcctcccaaagtgctaaggattacaggcttgagccaccatgcccggcctctcctgtgtaatctcaatgtacttttcatcctcaggaaatttaacattgatataatactaatatgtaaatacattctgtctatattcaaatgttgccagttgtctaaataatatcctttatagatgtattgttttttgctttttaatccagaatccaatcaaggatcacacattgcatttattgttatcatttctttgagacaggatctcactctgtcacccaggctggagtacagtaggcatattcatagctcactgcagcctcaacctccagggctcaagtgatcctcttacctcagcctctccgactgctgagactacagacactacaggctatcacacctggctaattttatttttttgtagagatgcggtctcactatgttgctcttgctggtctccaactcctgagctcaagcgatactcccacactggcctcccaaagtgctgggattacaggcatgagccaatgtgcctggcccacattgcatttagtaatcatgtttctcattcctttctaatgtggttctttttttctctttctggaagttttttaggatcatctttttatccttggtatgccgaaattttgtaacaatattttttttttttttagtttctaacaactctttttctgattgatcatttttaatagctttctattcctgttttgaatctaatgttgttatttctttgagaatattatggcttccattggactgtttctgtagttttcattattctgagttaagcttttgttttcatttgaagtatctttcatatttaatgtctttttccaagtgttggttcttttgcaggctcacatttaagaggcactaggctgggtgtggtggctcacgcctataatctcagtgctttgggaggctgagacgggtggatcacttgaggccaggaatttgagaccagcctggccaacatggtgaaaccctgtctctactaaaactacaaaaattagctgggtgtgatggtgcacatctataatcccagctactcgggaggcagaagcatgagaattgcttgaacccaagaagtggagattgcagtgagttgagatcacaccactgcacaccagcctgggtgacagagtgagactctgtctcaaaagataaaaattaaattaaataggccgggcacggtggctcatgcctgtaatcccagcactttgggaggccgaggcgggtagatcacaaggtcaggagatggagaccgtccttgctaacatggtgaaaccccgtctctactaaaaatacaaaaaaattagctgggcgtggtagcggatgcctgtagtcccagctactcaggggactgaggcaggagaatggcgtgaacccgggaggcggagcttgcagtgagtagagatcacgctactgcactccagcctgggcgacagagcaagactccatctcaagaaaaaaaaaaaaaattaaattaaagcgaagcagtataaaaagctattgaaagactcttaagtgtatggatgggacttagttcctggtagccttcattttcaggcgattgtagagtcatgcaccagccattttgttaggggacctccagatgtgaatgtttagaaggttttttttctggggttgttcagttttcgtaaagacaggtcttacagtctcttgcctgggacctatcagtcagattctggcagtggaggagggggaggtcaccttttttcaaaagaaaattatttgttaatatatttattttagagacaggtctcaccttgtcaccgagactggagtgcagtggtgtgatcatagctcactgcatcttcaaacccctgggctcgaggaatcttcctgcctcagcctccccagtagctgggactacagggcaacatccaccagacctggctaatttttaaattttttgtagagatggggtcttgctatattgcgcaggctggtctccaactcctgggctcaagtaatcttcctcggcctctcaaagtgctatgattataggtgtgacctgccctgggtgtttttgaagtcttttactttgtcattttctctttatcctctgcctcccactccactattatccttggatttccaaagttccatttttctccccattcattttctcctgctgtcctgccacctggctgaacagtctactgctgtatgggatgtgtcctgggctctgattacttaaggaatttcaaccagttttctgtggtcagccctgtgcctcaaccctgtccatctctaaacctgggtttcaaggtgggcatctctcacagttatgctgacatcagcctgcttttcatcagcatttctggattcaggcacttggggttgtatccacttccaccctgctaaggcacttttttcctttttctttttttttttttttttttttttgagacagagtcttgctctgtcaccttggctggggtgcagtggcaccatctcggttcactgcaacctctgccttccaagttcaagcaattttcctgcctcagcctcctgagtagctgggactacaggcacgtgccaccacacctgactaatttttgtatttttagtagagacggggtttcgctatgttagccaggctggtcttgaactcctgacctcagatgatccacctgcctcggcctcccaaagtgctgagattacaggtgtgagctaccacgcccggccagcactttgtttcttttcaattttctaagactttattgaaatctctcacctgttactgtcacctcgtttgttttctctttaatttcttcattgttagtttagtggactctgagggtgaagagaagaaaattctgttattaatttgtcatctttaaccagaaatctcacatatgtgttcttatatttatttatttttattttttaaaatatttttggtagagacggagttttaccatattggccaggctggtcttgaactcctgacctcaagtgatccacctgcctcagcctcccaaagtgctgggattacaggcgtcagctaccacgcccggcctcttatttatttatttttgagacaagatgtcactctgtcacccaggctggagtgcggtggtgccctctcagctcactacaacctacgcctcctgggttcaagcagttctcccacctcagccacccaagtaggcaggattacaggcacgcgccaccacacccagctaatttttttgtatttttagtagagacaaggtttcgcttatgttggccaggctggtctcgaactcctgacctcaagtgatccacccaccttggcctcccacagtgctgggattacaggcatgagccaccatgcccagcctcacatatatatatttttaaataaagactttggcattgtgcttttactaggtagaactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttcatggccgcatacgcctgtaatctttgctacttgggaagctgaggtgggagaattgcttgaacccaggaggcaaagtttgcagtgagctgagaacacgccactgcacttcaacctaggtgatggagcaagactccatcaaaaaaaaaaaacaaaaaaaaaaacacaaaaaaaacaccgggcatgatggctcacgcctgtaatcctagcactttgggaggctgaggcgggcggatcatgaggtcaagagatcaagaccatcctggccaacatggtgaaaccccgtctttactaaaaatacaaaaattagccgggcatggtggcgtgcgcctgtagtcccagctactcgggaggctgaggcaggagaattgcttgaacccgggaggcagaggttgcagtgagccactgtactccagcctggcgacagagcgactccatctaaagaaaaaaaaaaaaagtaatagttccaaaaagagcaatgcaaattttagtcttttaaaatacttacatggtattgatattttattttgagacagggtctcgctctgtggcccaggctagagtgcagtggtgcaatctcactgcaagcctcactacaagctcactgcagtctcaacctcccaggctcaagtgagcctcctgagtctgtaagcatatatccccatgttcagctatttttttttaagacggggtctctctttgtcccccaggttagagtacagtggcacgatcatagcacactgtagccttgaactcttgagctttcaggctcaagcaatacttccacctcagcctcccaaagtgctaggattacaggcgtgagccaccgagcccagcttttgttttttttttgtttttgtttttgtttttgaagagacgaggtctcgctctgttccctaggttggtctccagctcctagcctcaagtgatcctctgtcctcagcctcccaaagtgttgagattatgggtgtgagccaccgcatccagctttattttgaaataatatcaaatgtacagaaaccattccagaaattgagaattgtcccattccctttacattgaatcaccagttctctattgacctttctctttcatgacattggcatttttgaaggctataggcagttattttgtagactgtacctcagttgatagaataacgtttaattttgtggtataatttttttttgtttttccttgtagcttttaggagagtatgagtcccttggaaaagaacacaggagagtaaaggtaaggggtaatggttcatgttctagatttcatgcagaggcagaaacattggattgggaatcaagggatctgactcttctcctccttgcaccccttcctgaacctccgtagctgttgaactggaaccttgcttatcctgtttcagtatccttattttcaaatacctgccccatttaactcacaagtttgttagattcattaatctgacaaatatttattgaatggctattgcatttgaaatgaaattgttcaaaagagtataaggtaccatacagatgcaaattattatttaatactgtttgttttgtgacacccaggttggagtgcagtggtgtgatctcggctcaccacaacctctgcctcctgggttcaagcgattcttctgccttagcctcctgagtagctgggattacaggtgtgcgccaccatgcccagctaatttttatatttttagtagagacaggatttcaccatgttggccaggctggtctccagttcctgacctcaagtggtccacctgtgtcagcctccctgagtgctgggattatgggcatgagccactgcacccagccatttaatactgattaaatatcaagctttgattttcactgcattagcttttggtagggttgagtttatcaattatgtttgaattctttttgaaagctctgtttggagactacatatttgcattcagtaaaacccttcgacgatggtgtaagtggggcccaagtatttctgttgcatagaatggagggttgtggttattgaagctcagcaaaaaggcctgcatagcttggctgccaaagcattctgagggttcgggagcagatcccatgatatctaaatctcattgaaaatatttgttttaccatccttctgaggttttagtcaagttattttaacactgatttgtttctaattaagcaaagtataaagggctgtatctgttacccaggggacttacacagagggacttgtgtaggccggtgctttgctctcatttgttttccttgaactgttggtcctggctgtatggttgatgccatacttgctgagtatggtttgtagctagttggtttagccttagattcattttcttttatgcattttaaaataattcatgtgaatatttgtcttcagttatctgaatttctcctttatttccataggatgcattaaatacaactgagaacaaattgcttgatgcatatactcagatttctgatttgaaaaggtaaaatgtattaacttactaatgtacacatacctcaattgttcttttatgtgtctgtattgaacatgatgagaaggaagtttttcttgaggatttttaagcagtttgagaactagttttgtcttaattttcccttgacatggaaataggtttcattttagccaaacaagatttcttctctctctctctcttttttttttttttttttttaaagagacagggtctcactatgttgcctagattggctgtgaattcctgggctcaagcagtcttcctgccttggcttcctgaatagttgggactacaggcactcatcatcatgcctggctgattttttgttgttgttgttgttgatacagagtcttactctgtcacgcaggctggagtgcagtggcacaatcttggctcactgcaacctcctcctcttgggttcaagcaattctcctgcctcagcctcccgagtagctgggactacaggagtgtaccaccacacccagctaattttttgtatttttgatagagacagggtttcgccatgttggccagactggtcttgaactcctgacctcaagtgatccgcctgcctcggcttgccaaggtgctgggattcaggcataagccacggagcccggcaagcctggctgatttttaaaaactttttttagaagtaagatcttgctgtgttgccctgactggtctcagatctctcgacctcaagtgatcctctcgtctcatccacaaaaagtgctgggattacaggcatgcgctactgcacctggcttcaaacaacatgttttaagtaattaaaatgtactgatggttgtgcctcagaggtggatattttcccaaacattatgtattttctcagcataggttaaaatccaaatgatatttaaccactggcaagaactttaagaagcagcctagttcacagaattattttggtgcttcaaaaagaaaacagcattaacaccaaaattatggtcatctactttcagaaagaccggttggagactgtattaatgatctgatttgtttaattaggtagggacagaatcgtaaatggtagtatccattgcaaatgattagaaatatccaaactgggctgggtgcagtggctcacgcctataatctcagcactttgggaggctgaggtgggaagattacctgaggtcaggagttcaagaccagcctggctaacatggcaaaaccctgtctctactaaaaatacaaaaattagctgggcatggtggtgcacacctgtaatccctgctactcaggagggtgaggcaggagaatcgcttgaactctggagacggaggttgcagtgagccaagatcacgccactgcactccagcctgggtgacagagcaagactctcccctccccaccaaaaaaatgaaagatagaaaagagaaatatttaaactagttcaagagcaaattttatgtttgtatttggatataagtaacgtcccttatttagacattttactgcagtcttaaggagttctcatagagaagaacagaaatgctgtctaggtttctcatctgccactcttctgtgattcattcagttctagtgatagctttcttatcagattgttataaaacatcagtcttgttagggctattatttctcaaatcttccttgcatcaaagtaggtaagaattcgagtttgaaagataagatgaagtcatacacagagcttaaaagaacaagccaggcatggcggtatgcaccagtactcccagctgcttgggagactgaggcaggagcatctcttaagcacaggggtttgaggctgcagcaagcaatgatcatgccagtgcactccagcctgggtgaccgagcgagacctcatctcttaaaggggggaaaaaagaacagcatgaatgccaggatatctttaaaatagtcagttggccagagtagttatttcctgttggtaaacttgaaaataggcttttattttgaacatggcacaaatcagatgaaatacctataggttgtttgcaatattttagccttggcctctttttaaaaattagaaaggtttttttttttttttgaaatttttttggtaaaagttctgtttttggaagttaagcctgcttccttgtttgtgaaagtgttacctattgtatgcatggttatatacatattaggattaaacacattagaatgcagtttatttgacaattttatgtttatttataaatgttatgttttgatctgtatagtgatgaactactcgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatgggaaatgttcctttgtagagttttaatgtatttgtttttctgtttttctatttatattcactgatttttgtttagcttttattttttttttgagacaaagtcttgctctgttgcccaggctggagtaaagtggtgtgataacgcctcactgcaacctccgcctcccgggttcaagccgattctcctgcctcagtctcccaagtagctgggattacaggcgcatgccaccacacctggctgatttttgtatttttagtagagatgggggtttcaccatgctggccaggctgggctcgaactcctgacatcagatggtccacccacctcggcctcccaaagtgctgggattacaggcgtgagccactgcaccctggcttatttagctttttaaataatggtgatgttttactatgaaaaatgtttatggacttgcaactctttttttgtgtgtgacggagtctcactctgtcgccaggctggtgcgatctcggctcactgcaatatccacctccctggttcaagtgattctcctgcctcagccccccgagtagctgggactacaggtgtacaccgccatgcccagctaatttttgtatttttagtagagacagggtttcaccatattgaccaggatgttctccatctcttgaccttgtgatccacctgcctccgcctcccaaagtgctgggattacaggggtgagccaccattcccggccatggacttgcaactcttttaccacccattttttaggagggtctgttaaataaactgtggttgagctatattttacatttgttgaaatgtacttaatttatctttattgcttttgaattagaatgatttcaaaacttgaagctcaggtcaagcaagtagaacatgaaaatatgttaagccttcgtcataattctagaattcacgtgagaccctcgcgtgccaagtaagttatttcatttactctctataaagctagaaataggtgcatgcttttattaagacgagaaactcatctgtctaaatcataagaaagtccgggttaaatgtcattacagaacttaaatgtgttagattaattactgaacattgtaaaccctcttatgcagaggcatttgctaaaatgaggaaatatcttaggatcaaattgggatccttggaatgtattttgttctttgcccagctgtgtgaccttaggcaagtcacttaccttttttggaattcatttttcttatctgtaaaaataaggacaaggggctagaacatctcaaaaggtcttttagccctaaaatttcagacattttattcctatgttaatggaaggaactatgaagatggatcttcattaggttgtatgggttttctttctagtttttttagttctttcagaattagcttggctataatctcaacattgtcttggtgatacccttacagaatacattatttttatattagatctggcttttattatgatttgggtgtaaataaagaatattaataagtaaataataactttataatgacatttattagaaaaatgattttaaattgtaatttgtgacccaagttgtaattgtcaaatgaggagctttttctagggccgggcacagtggttcacgtctgtaattccagaattttggaaagccaaggtgggaggatcgctagagtccaggagttcgagaccagtctgggcaacatggcgagagcccatctctataaaataaaataaattgtaagagaagatttttctaggtctttgttaattaatcttagtagaacataggaaattctttttttttttttttttttaaagaaaagatgtaagtaacaaattgaacatttgagagagataaaagagagagcttcgggttggggaccagggaaggcctttctttagaggaggctcataagcagaggagtcacctgtgcatagaattgctggagcaggaggtgtggggtgagggatgggagggtgggcagggtggggtgtctgggaggtggtccatgcagagaaattgccttggtaagtcctcaggtaggaaagagcttagcatatttgaagagcctaagggaggttagtgtggcctgaatatttccagcaagaggcaaagttgccctagatgaaatcagagattgaccatttatagctttctaagccgtgatcaagagttggatcttggctgggcgccgtggctcacgcctgtaatcccagcagtttgggaggccgaggcgggcggatcacaaggtcaggagatcgagaccatcctggctaacacgatgaaaccctgtctctactaaaaaatacaaaaaaaattagccgggcgcggtggctggcgcctgtagtcccagctactccggaggctgaggcaggagaatggtgtgaacccgggaggcggagcttgcagtgagtcgagattgcgccactgcactccagcctgggagacagagcaagactccgtctcagaaaaaaaaaaaaaagttagatcttgccctaagtccattgggaagcctttgaaggtttttatgtggtaaaatgatgttatctaatttttattaatgtacctgccatgagaagatggagaaggaaagaatggaagcaggagactagttagtctggtgcagtgctaggagagagatggtgttagctaggtggtggtcacagaaatagacaatagagactcttcgggagagattctagaggtaggatctataggatatggttgtgaattggatggcaaggtaagaaagggaggtgttggaataattccttggtttctctctcaaacaactaaaggtagctagttcatgtgttgaacttagggaagagatcagaatttccatcttgaatatttttgtttgagattcatatcgattctaagtggaaatcaaataggcaattataaatgagtttggagctcaaaaataaggttttaggatggtatgataaattttggagtcatgccgggtgcggtggctcacgcctgtaatcccagcactttgggaggccgagatgggcggatcacgaggtcaggagatcgagaccatcctggctaacatggtgaaaccccatctctactaaaaatacaaaaaattagccgggtgtggtggcgggcgcctgtagtcccagctactcaggagactgaggcaggagaatggcgtgaacccgggaggcggagcttgcagggagccaagatcgcgccactgcattccagcctgggcaactgagcaagactccgtctcaaaaaaaaaaaaaaattggagtcgtctctttctagatggtgcgtaaagttgtagaatggatgtaaactgagtgtgtttagtgagaagtaggcctggggcaagaactctgacactggtgttggatagagagagctggcaaaggaacccgagaaagcgctgccaaaaagctagaggaaaacaagcagccaccggtattgagtgcaaaacccaacttgtgtttccctgtgctctcacaccagcacaacaaaaatagactcagaagacttttgtgacccagaatgtgtgacatttctcctcaccagcaagcgagcaatcagttcttcatgggacctagctgggtggcctcccattcatctctgatactatctacccagagatagggtcagatcccataagctgagggctcagtccccaagacttcccatttcagacaccatttgcaagtccaggcctccaaaacgtctaaccaactggcttcaagttgaggttcccacagccctctctttgggtttgattaatttgccagagtggcttatagaactcagagaatcatgtttaccaacttattacagatgatattttaaaggatacaaataaacaaccagttgaagagatacagagtaaggtctggaaggatctccagcacaggagtttctttcccagtagagctggggtgtgatgccccctcagtgcgtggatgagctcttgttcagctctccagaagctctggagccctgtccttttgggcattttatggaggtttcattggacaggcctgattgaagcttggacgactgtgttgaaatgtgattggacagaaaggatgtgatctaaacccagcaaggcctttctgttcagatccttcttggcctctttgtgcagcattccttcccccagaggatgaggcaggaccctctctgattcgaacaagagtcttatgacccataatcagattagagtcctaccctggtaaggtaaaaggaagacaggagaaggttagagattctgttgactgcaacaagggatatgaaagttatgagccaggaattgtgaatgaaaactgatgtataatatatgtcataatctcacattgctgcttgagagatcaaggtgaagactgcaaggtctttgcaagctggaggctaatgcttagtgaacagtctggatagagtgataacagtagaagcccattcagagggtactcgagtgaatgcaggctgggcgtggtggctcacgcctttaatcccagcactttgggaggccaaggcaggtggatcacttgaggtcaggagtttgagaccagcctggccaacatggcgaaactccatctctactaaaaatacaaaaataagccaggcatagtggtgcaggcctgtaatcccagctactcgggaggctgaggaatcacttcaacctgggaggcggaggttgcagtgagccaagatcgcaccactgcactccagcctgggtgacagagcaccgctctgtctcaaaaaaaaaaaaaaaaaaaaaaaaaaaaaaagtgaatgaaaacctgaaagtctaacagctggaatatggaaaatactgtcatacactcaagcatgacactgcatcatgacaatgcaggtggcagagaccgagttggcagaccccagcctgtggggccacatgtggcatgaactacctgtttttgtgaggcccctgagtaaagaatggtttctacattcttacatgtttgggaaaaaagaatatttcatgacacatgaaaattgtatgacggactgggcgtggtggcccacacctgtaatcccagcactttgggaggccaaggcaggtggatcacctgaggtcaggagttcgagaccagcctggccaacatggcaaaaccccatctctattaaaaatacaaaaattagctgggtatggtggcatgtgcctgtagtcccagttactcaggaggctgaggcaggagaatcgcttgaacctggaaggcggaggttccagtgagccaagattacaccactgcattccagcctgggtgagaaagtgagactctgtctcaaaaaaaaaaaaagaaagaaaattgtataacattcaaattttagtgtccacaaatacaattttcatggaatacaagcttattcacttacatagcatctacggcagcttttgtgcaacagcaaagtggagtagttgcaacagacactggcccataaaacctcaagtgtttactctctggccctttacagagagaatttgctgatcctcagctagacggtcaacgtggattaatcttaaggacataatatggaacaacaaaaaactagttgcagaagaaataggatactatttatattgactttagcatgtgaagcaattttgtatttcttatgggttcatgcaaacatagtaaacgtatgaaaacgtgcatgggaatgctgaacacaaatttagtataaatggttgcttttgggagggaacgaatgagattggagaggtgcacaggggctttagttgtctttatagtgttctactcttaatttaaagaatatataaccaagatttataaagctggatggttggcatgaatattacctgtatgtctatgtgtgcttgagatatatatataatatatgttttttgtttgtttgtttgtttgttttgagatggagtctcgctgtgtcacccaggctggagtgcagtggcacaatctcggctcactgtaacctctgcttcccatgttcaagcgattctcctgcctcagcttcccaagtagctgggattacaggtgcccactaccatgcctggttaatttttgtatttttagtagagatggggttttgccatgtcagccaagctggtctcaaactcctgacctcaagtgatccgcccacctcagcctcccaaagtgctgggattataggcgtgagccacagttcctggctgatattttattttagagacaaagtctcgctctgtcacccaggctggagtgcaatggcacaatcttggctcactgcaaccttcgcctcccaagttcaacgattctcccacctcagcctcccgagtagctggtactacaggcacgtgccaccatgcctgctaatttgttgtatttttagtagagacggggttttaccttgttggccaggctggtctcgaactcctgacctcaagtgatccgcccgcctcagcttcccaaagtgctgggattacaggcgtgagccactgtacctggccccggctgatattttgtatttttaaagtgaacaggaacgaataaaggaaaagtatccagaagatgaaagaactcttacaaatcaataagaaaaagataactttctcaacaaaaaatggtaaaagaatataacaagcagcgcacagatccctgatggctaataaaaatgagaacatgttaattgtcatgaaaatgcacattaaaacaataagatacaattcacaccatcggacaggttatatttaaaattgaaacactttaacgtttggcaaagatatggagagacaggaactctcaaagtaatgattgacagttgatacagcttgtctggagagtgatttggcaacagtcagagaggttgaagatgtgcaccaaatcccacagttgcatgttaagatgtttgccttagaggaattttcacacgtgttaattttagcattgtcgaaaggctgcatattaaaaaccatatttccactgccgggagaaaggacaaatatattcatactatgggtaaatgataaaaatgaatagagcttatatgtactaacacagataaatttcaaacataatattgaacagagaaagcattaaaggccaggtgtggtggctcacgtctataatttcagcattttgggaggccaaggtggggaaattgcttgagcccaggagttcgagaccagcctgggcaacatggcaaaaccctgtctctacaaaaaatataaaaagttagcggctagacacagtggctcacgcctataatcccagcactttggtaggctgaggcaggtggatcatgaggtcaagagtttgagaccagccttaccaacatggtgaaaccccgtctctactaaaaatacaaaaaaattagccagatgtggtggcacgcagctgtcatcccagctactcacggggctgaggcaggagaatggtttgaacctgagaggcggaggttgcagtgagccgacatcgagccactgtactccagcctgggtgacagagcgagactctgtcttaaaaaaaaaaaagctgggtgtggtggttggtggtacgcgcctgtagtcccagctgctcgggaggctgaggtgggagaatcacttgagcctgaggggtcgaggctgtactgagccatgatcatgccactgcactttagcctgggggacagggtaaaaccctgtctcaaaaaaaaaaaaagacatttaaaaatgtgtattaatacattatgccttctgtgtaattaaatatataaaaattggtcttataattaaaaacaaattttgcaagatcgggctgggcacgtggctcacacctgtaatcccagcactttgggaggccaaggtgggcagatcacttaaggttaggagtttggccaacatggtgaaaccccgtcacttctaaaaatacaaaaattagctgggcacagtggtgggcccctgtaatcccagcaactgtggaggctgaggcaggagaattgcttgaacctggtaggcagaggttgcagtgagctgagatcacgccactgcactccagcctgggcgacagagtgagactctgtctcaaaaaaaaaaaaactgagggaaagagtgactggagttgaagtgaatgtagatagaagaggcagcctctaaaatgtttggttgtgaaaggggacagagagaaaacaagagttgtttcatggtttctggtgtttctttgaatttgactcaaaagtttcacctgtcaacgaaggtgggatgggaggtttgaggagggtggaaagggtgtgagatagtcatgtttggagaactgaagcttgctggttacagaaagtcatgttgccggccgggtgcgttggcgcacacctaaatcccagcactttgggaggctgaggcgggtggannnnnnnnnnnnnnnnnnnnnnnnnnnnnnnnnccttggcctctcaaagtgctaggattataggcatgagccactgagcctggccctgaaatagttcttaatttaaaaactgggccgggcgcagtggctcacgcctgtaatcccagcactttgggaggccaaggtgggtggatcacgaggtcagcagatcaagaccatcctggctaataacatggtgaaaccccatccctactaaaaacccaaaaaattagccgggcgtggtggtgggcgcctgtagtcccagctactcgggagtctgaagcagtagaatggtgtgaacccaagaggcagagcttgccgtgagccgagatcgcgccactgcactccagcctgggcgacagagtgagactctgtctcaaaaaaaaaaaaactgagggaaagagtgactggagttgaagtgaatgtagatagaagaggcagcctctaaaatgtttggttgtgaaaggggacagagagaaaacaagagttgtttcatggtttctggtgtttctttgaatttgactcaaaagtttcacctgtcaacgaaggtgggatgggaggtttgaggagggtggaaagggtgtgagatagtcatgtttggagaactgaagcttgctggttacagaaagtcatgttgccggccgggtgcgttggcgcacacctgtaatcccagcactttgggaggctgaggtgggcggatcatgaggtcaggagatcgagaccatcctggctaacacggtgaaaccccgtctctactaaaaatacaaaaaaattagccgggcgtggtggcaggcgcctgtagtcccagctacttgggaggctgaggcaggagaatcgcttgaacctgggaggcggagcttgcagtgagccgagatcacgccaccgtactccagcctgggtgacagagcgagactccgtctcaaaaaaaaaaaaaaaaaagaaagtcatgttgccaggcggtcaggcggtttggggtgtccgcttgaggtggtgatgagtctgcccagctggtggcttttttccagcaaagctcagtggtaggagttgagacctgaagcgcggcctttgtagtcagccagtcctcagattttgctgccagtcaggtgtggtgaaaggtgagagagaaagtatcgtgagtgtggacttcagggtagatcaagaggacctagtcagactaggaggggttgataaatggaaaatggagaggccaaggatcgtaggtcacgttgctgaagcttgagggcgggaggcagaataggggcacagtctttggagtattggtttcttaaggggagtgtgttctctggttttgacaaaagccagcaagtaccctctgaggtggctggctgaggagtagagggtcacctcactggagagagtggtcaggaagttgcctagtgtgagaacaggcataggtgtggagaaaacaaggcaggctctaaagtctggggaatgactgggggttaacatgatggtgggaacctcagatgagctgggggagcaatgtctagaattgcgctgttcagtacagtcctgccaacagccactattactatttaaatcaatcatgtcaacctaaaatcagtgacagagactgactctccaaagaaatttatttggaaatgttgggggtttgcaagctggagtacgcatgctgtggtgaaccataagcatgtccaaaggggttgggacacaggaaactttaaaagacaaagggcagtccacagtccactaagctattttaaaacaaagaccactggttacaggagcatgttgcaggcattagcattagctcagtggtggagacatcccttgttagggatgtttccttgtacaagcagcttattatctggaatactgtcgttctgaggaattcagaatagttcccataatcagcatctgtgtgagaggctgctcctttgtgcctcccagctccattttttgggagtttgacattagtgactccattttgatactgaaaactttcattattaaaattaacgttttataattggttcttcagtctcagcagccacatttcaggtgttcagtagtgacacctgacttgtgactgctgcattggacagtgcagatagcatttctggttttgcagaagattctgttggacagtgctggtctgaagggaacaagaagggcagccctgcttccttcagcactttaccctcagctacagtaggggcacagagtgtaaagggtgtgaaatgcctgagagacagtgaggggaatgttcagagccgcaagtacctgaatcttgactgagattcagaagtaacagaaacctagaacaacagttaagttgaatcataaaactgtaaaataaattgtatccaaaatatagattgttacatgtgatttttaaattagtgtacaaatgtgtaaatactgtttgagagcagattgttttatatgcacatgcagtctgaaatgaagtgcagacctttataatgcctgaccgttttcattctaatagcacactagcaacttcagacgtcagcaggcggaaatggctgattccaggtgcagagtattccatctttactggccagcctctggacacccaggacagtaacgtggataaccagctggaggaaacctgtagcctagggtgagataactttgctaaagattctatttagggatgttatgttttcttagagatttcaattgcttttaaaagtttgggaagccctctctttggttctttaatgtcttaattttgagaacctgacttttattttactttgaaaggctactacttttagaatattttacttccatgagctctgccaagcttccccacctgtgctcagtggcacagtatgggtttgtgattaggataggatgtcgatcctcaggccaggtgtggtggctcacgcctgtaatcccaacactttgggaggccaacgtggaggatcgcttgagcctaggagttcgagaccagcttgggcagcatgacaaaatcccacctctacaaaaaataaatatattagccgggcatggtgacatgcgcctgtagttttagctacttgggaggctgaggtgggaggattacttgagcctggggagctcaaggctacagtgagctatgattgtgccactgcactccagcctgggtgacagagtgagaccttgtctaaaaacaaacaaaagatgtagatcctctcccacttcagatggctctggccagcccgagccccgagcctgcgtgagcagcctcagccgcttactccagggtgctgtgcagatgctgttcctctaagtgtaggactagaaggatgggaaagcactgtatgcaggtttaatttatttgcattgcaaagcatgctcattgtggagtataattgtcaactctgttattcccctaacaaccccagtaaagtgtgtgttttagcttggactgttataacaaattaccgtagactgggtggcataaacaacacacatttctttctctacctctggaggctggaagtgcaagatcagggtgctgagtgtttggtgagggccctcttcctggttatgtcctcacatggcctttccttggtgtgtgtgcacagagagagcgctcctgcctctttccctttttcataagggcattaatcccatcttggaggcttcaccctcatgacctcatccaaccctaattacctcgtaaagaccccacctccacacaccatcacattgaagattagggcttcaacatgtatgtttggtgtgggggcggggggcaagatacagacatttagtccatagcactgtatgtcttaaaattattgtttaaggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatagtgagtatttccttgtttgagatagatggatatagatatcttttccccatttatattaccttcgttaaaattaaaatatttaggtaatgaaattaaaagttttagctctgtaaacttgctattttactgctacttcagccccgtttcatagagaattgaatgtcctagttaataatttatcacagttctggcataacatgtaccttttgtacaaagccagttgaatcttacattccgattatgaaaaaggcttacatggcattcttttttttttttttttttttttgagacagtgagacagagtctcactcttttgcccaggctggagtgcagtgcgtaatctcagctcactgcaaactccatctccagggttcaagctatcatcctgcctcagcctctcaagtacctagaattacaggtgccctccagcacccccggctaattttaatatttttaacagagacggagtttcaccatgttggccaggttggtctcgaactcctggcttcaagtggtccacccgccttgtcctccacaacacaacacaaagtgtaaacacaaagtgttgtgattacaggcgtgaaccactgctcctggccttacatggcattcctaaggatatttgaaaaattcctgtcagtccatcttacttgcacacatcagaaggctgtgataggcatttggtattcatgaagtgagatataacatttcctcttctttcttggttactgagcatctgtagataaggcaagtagtgtctttaatactgtgttttttcacaggtccaggtcaccaatacatttctctccttttccactatgcttgctttctcagaccccttagtcatcctgccagcgtctttgcggttacatctcccaagcagtgtctcttagtaaataaattagtaacctgctttctaaaaataaccctcttgaaaatcaccttgaatgccgattgtaaacagggagccagaatgaattcattataaactcccatatttttcttcatcaagcattttttatcattataatgtggtgcatttgcaaatagtcactataacctagctggtgagaataaatgctttgagcagaacctaagctgtggggcttggtgtgtaaccatgtgtaaccacctgttaataaaggtggataactgaagcgtaggcttgttttgatttgttttttgttttgcttttttttggtctgctgtagtaaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaagtaagagttagatgtgtacatctcttgggttcaaaagcgtgatctctgagtcaaatctatttgtgcccgctgcttgcctgtttctggtttctcttgtatcctcagcacctagtagagtactctgagcagaggacccctaaataagatcttgttcataaataaaattgtctgatcacatagatactacaaatgtaaatgaagaaatctgtttattaaagtgagattttttattgtgtccagtaaattgtttacaactaatactaataatttattgtgtccactaaattgtttgcaactaatacttaaaaatgccagctatccaaacattaattcaatcaaattaatccaagctagtctcaaatatacttcttatgtatttgatctcaagtacttagcattagtcaccatttttctttagccaataacaggttggttttaaagttgaagcattgaattcctgtcctgaatttccgttttcacaccagctgaggagattcttattattgtgttataggaatgttcagtagtgtactgctgtttccatcttatttccagtcgacttctaaaatcctgaaaaaccagttttgagtcagagtgctgaaagtactgtctgatatactacagtgttacagtggttacctctaggtgttaggattatgagtgattttatttttttgtacactcttatttctctctcaaagttttacgttgaaattatattcctttcaaaattagaaaaaaaatactgaataagaaactgttatgctgatacatatagaaggaaaagaatatttcctcttcattttcttctatagcaaaaagagagattatgctaacaccagtgactgtggcttatagtccaaagcgatcccctaaagaaaacttgtccccaggatttagtcatctgcttagcaaaaatgagagcagtccaattcggtaagttctctaaaattgtagaataaagtttactatattagtgatttttttctaaatgttgacttatgtctctagctatcactaatttttcagttaccagtgggaactctgtgaatttcatttaaatcataagtgaatgtcatactacaactaaagtactgcagtacaatgaacacagtttttaactatgtaaacttgctactactagattttaaattatcacctcagcacccctgtcagcttttgtatgtagaatgatagttctttgttttcctgaaaaggtttatgatacgggaaaacttttgggccatttgtacaggaaagtgggctttactggtatggccctggcaccaaatgcatgtttacctgtgctgctgagaatctgtcccctccgaagtgtgggcagctgtgtgtgctattagcggggagggatgttgcttcttggttccagacccaactctgtcaggctcttgcggagatgagttaagcacattgaacctcagtttcctcttctataaaacggggataataataactaccctgcttatttcataaggtttttataaatatcaaatgagataatgtatgggtaagtgttttaagtctttagtttgtaaatacaattttgttagaaaatagaaataaatttcagttttagacaattacataaccagctttcttttaagaaaatacataaatatgtgagttagctggatgccagctcatctttgtagtggagatagggaaaatcagttaacattttttttctcacaagtaacttgcttcattcaatagatttgatatacttttggatgatttagatactgttcctgtgtctacattacaacgtaccaatccaagaaagcaactccagtttcttcctctagatgactcggaaggtatcttttcctaaaaaatattagttatggttttaatcattcattttttgagattctggtatctctcagtgttctaaatattataatatcttgcacttaaatattttcccactcaagggcgtctgaaactaagcactcatgatgctacgtgttgttatgtcaatgttgttatcctcattgaaaagttgggaaactgaggtacagggaatgttgatgtttaattaccagggccacactgctcagttattctctttacttttattctctatatgcagcttaggctttgggtaactttttttttctcatttatattctaaatttggaataaagctataagacaatgtatgtgaaatcacttgggtaggccctcaaaacattaactgtttagtgttggtgtatgtccactaaatgtgatgtattatttagtttttaagcttttttttttttttttgctttaagtttacttaaagttcatttatgtttacatgaagtttgcttaagttcattaagggaagttgcaaagattgtcaaacagagggcaaagctttcagaattctttggagaaaaaagcactgagtaaataagattgattattgtatctcttttcattacttttttgggccacatagcagctatatccagaaagtgaaattgggcaacatatttaatatatatgcaacctacacgaaaaattgataagaaatataagcaatttctctcctctctgacagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccaggtaaaaacaaacaaatatttttaaaaattgttttctgaacttaatgcttatgtctaaggagaagggaattattgagtcaaacctgtctcaggaaattacaatgggataacataccagagctgtgctagcaacggatttgagccatgtggtcgttactaattgacagagggaaattaagttgagatgaaatggacaaggaaatactaagccaaaaccttttctttccattctgtgtgataaacctccctgccagtaatttaaacatatttttttcgtgtgttaacagattgaggcagcactaagcaggatgccttctcctggaggacgaatcactttacagacaagattaaatcaggtgaaatgtcttagcttgaatctgctttagaggcttgatgccagtcagtgttccagttatctaagaggggtttaaaaaatcatggcacagtgaaaattagacacactgaagcagcagtcaaaacttttagcttttacgggaagtgtttgattatagcaattttataactgcaagctagctttcaggaataaaaattgattttacctttagacttagagaagaaggtgttcatgcccttgtattttcaagaaactaacttgagagcaaatggcaatatgcttttcaacagattttacactaagttagtgctcacagattgcctctctttttgtttgatttctccctcctcaaatctgtaatttatttctgaactcctttccattagcaagcagataaaatggttacactttggaaactgaatagctgtagaggttcaaaaagtgagccgtaggccgggcgcaggggctcacgcctataatcccagcactttgggaggctgaggctggtgtatcacctgaggtcaggagttccagccactgtgcccagcccccaacttctttttttctgactttgtctttttgttctgataaatattagtcaataatttataggctgggcgtggtggctcatgccggtaatcccagcactttgggaggctgatgcaggcgggtcacctgaggtcaggagttcgagaccagcctggcccacatggtgaaaccccgtctctactaaagtacaaaaattagccgggcatggtgtgggggtgggcgcctgtaattccagctactcgggaggctgaggcaggagaattgctcgaacctggaaggtggaggttgcagtgagccaagatggtgccactgcactccagcctgggtaatagagcaagactctgtatcaccaccaccaccaccaaaaaatcagccaggcatgatgatgagtgcctgtagtcccaactattcaggaagccaaggcaggaagactgcttgagcccaggaattcacagccaatctaggcaacatagtgagaccctgtctctttaaaaaaaaaaaaaaaaaaagagagagagagagaagaaatcttgtttggctaaaatgaaacctatttccatgtcaagggaaaattaagacaaaactagttctcaaactgcttaaaaatcctcaagaaaaacttccttctcatcatgttcaatacagacacataaaagaacaattgaggtatgtgtacattagtaagttaatacattttaccttttcaaatcagaaatctgagtatatgcatcaagcaatttgttctcagttgtatttaatgcatcctatggaaataaaggagaaattcagataactgaagacaaatattcacatgaattattttaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgatctctcttaatttttttgagacagggtctcattctgtcactcatgtgggagtgcattggcacaatcatagttcactgtagtcttgacctctgaggcctcagccccttgagtaagctaggactacaggcatgcaccaccacacctggctaatttttaaaatttttttgtagaggcagggccttgcagtgttgcccagggtggtctcgaactcctggccacaagtgattctcccaccttggtctcccaaagtgctgggattacaggtgtaagccatcatgcttggccttatttttcttttaaaaatgatacacggctgggtgcagtggttcacgcctgtaatcccagcactttgggaggctgaggtgggcagatcagatcacctgcagtcaggagttcaagaccagcttggccaatatggcgaaaccctgtctctactaaaaatatgaaaatgagccgggcatggtggtgggcacctgtaatcccagctacttttgaggctgagggaggagaatcgcttgaacctgggaggcagaggttgcagtgagctgagattgtgccactgcactccagtctgggcaacagagcgagactccgtctcccccaaccaaaaaaaaaaaaataaaataaaagtggtatgcatatatatgtatgcagaaaaaacaggaaagaggaacagtttttttttcttttttgcttatttgtcttctaaattttctatattctaagtgttctataatccttttataattaaagaaaaaaattttaagttttatttcaggacaccattggaattaatactgaataaattaactaaaatgaggctgggtatagtggcttatgcctataatcccagcactttgggaggccgaggtgggtggatcacttgaggccaggagttcgagaccagcctgggtgacatagtgagatcttgtctctgcaaaaaaaaaaatgtttaaaatcagccaggtgtggtggtgcctgcctgtagtttcagatactcgagaggctaaggtggaaggattgcttgagtccaggagtttgaggctgcagtaagctatgatcatgccattgcagttcagctttgggtgacagagcaagaccctgtctcaacaaaaacacagaagtatgtataatgatatatagtccaggtattatttaacagtaatattgtttattttaaaatagcaattgttaattcattgtgaaatctattttttttttaagaaaagtatccttcagtgttttttttttttcctttttaacttaaaaattttggtgagaagaaagttatttgatctatgtatgtgtgggatgcagcactgatcaaatgtgtccatttcttctggtgaaatgtgtgaagcacctcctaggctcctcttgtactgttctcacttcagcagagccaaagaattatcctcttccagttggttgtattgctattactagaatttccatatactcaatgtgtcaaacatattgagaatattttaaagtacagcagttatttggaatagttgaaaagctaattcatattgtccagtttaaaagaaatcataagatgtttcgtgtagaaagcaaaataattgtaattttagtgtttatacttgctcttttgctaaaagaaaggtcagtttggtggtgattatagaacttggtatagaattctaattaaacttttcccattgttttcacctaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcgtatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggagggctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaaccaagccatcccagttattccaagcaggctctcaaatgacctttgagcacccttcacctggctggtccccaggccaggggtccacagccctgctcccttctcagcaaggagggtggcctgtctgacagtgcagttgaacctttgctccctactctgcaacttttgaagacttcaggctaatcaaaattacttataattagaatcaagtgcctttattcttgttttttatttttattttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatcttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctt

SEQ ID NO: 15058 - DNA, 15148 bp, Human
ccgcctactttttgtaattttagttaagatggggtttcactatgttggccaagctagtctggatctcctgacctcaggtgatccgcctgcctcgccctcccaaagtgctgggattacaggcgtgagctgaaattttttttttctgaggtggaatcttgctctgtcacccaggctggagtgcaagtggcaggatcttggctcactgcaacctcctcccggtttcaagcaattctcctgtctcagcctcccgagtagctgggattacaggcgcctgccaccacgccccgctaattttttctatttttagtagagacgggtttttgccatgttggccaggctagtctcgatctcccgacctcgtgatctgcccgcctcggcctcccaaagtgttggggttacaggcgttagccactgtgctcggccaacagttttaaaatgatgccatggacttacagcgaggagtggggacaatggaaaaaatacaacgctattggctgacgcctgttatcccagtgctttgagatggaggtggaggcgggaggatcacttgagcccaatagttcaagactacagtgagctacgatcaagccactgcactccagcctgggtgacagagggagaccccggttcttaaataacaatatggaaatagatcggttcagagcactcatagaaaggaccgggcctgccactgagatctggattcttgccccgaagaaatggaggcctagtcaaacagccagtgggtgggggagtcagagtcagtacccggtgtgtccgtcgcaggagccctccgctagtagctgcagccctgcactgttcaatacggtgacccctagctatggtggctactgagcgctgaaacgtggctagtctgaattaaaatgcgttgtaagtataaaacacacactggattgcgaagacttcgtatgataagagaatgtaaagtgtcttattaataattcctttcaattcattatatagtgaaatcacgctgttctggagctattgtattaaataaaacatgttaaaatcaatttcaccagtgttttttgactttctcaaatgtgactactgaaaaattgaaaattagctatgtggctggcattctatttccattggactgcgctgctctaaaggactgggcgcccgggaccagccacatgggtggcattaatttattcatggaataaggtttcactgagcattcttcgctagtgctggcctacagctgatctcaaggatgggggttaagctggggagggggtgtcgtcgcctgcgcctttggtcctaaaggaagaagcaggcctgggtgggcatccctaggtgggtgcctttgtcatcagatccggagatgatgcttgcacgcctgtgtctaattaaatctgcaaaccatgacgattaaaaacaacagaaaagggtgggcatcttatgtattttaacgagctttactacttcggcagaactccaagattaaaaaaaaaaaaaaccccaaaaaaccccacaaccttcaggttattcatctaatccaaatccaaaatacactggatggttacatttcaatcggatccaaggatgggctgggggtggggtcgaaggaggatctaaaattgtcccgtaaactccagggggtagaaactttgccaagttcaattcttgtatcctcagcgcttggaacagtgagtggcgcatagtaggtgcttcccttaaatactggagtgagtctacgcacgaaattgtgcgattcagggatgagttttccggggaggggggtgaggggtggagaaggcctctaagcttttgtcagtctcaaaggagtcttggatccccaaagggttaaaaaccacttcatacagacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcgggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccggtgagtgagccgcgtgcgacgcgccccaagcgccgccaagttgggggtccgcgcgcccggccccggcccggggatgcccggggcgcccgcggaggccgggggcggggggctcagggtcccggcccggggcagcgctgccgccgccatgattcccgagcccgcgccgcgaaagttctctggtgcgccccgcacgccgagggcctcggctgggggtgcggggcgggcggcccggggtgacccccgcgccggcggctgcggatcgcagggagcgcggcgggcgagggcgagggcgggggaggcttgttctcggctcctttttcctccggcttctgggcggctcggcgagggcccctgccggcgggagtcgggagcggcccgggccgcgccgggagcggggcgcggggccccgccgccctggggagcggggtcgtgaagcagcccgggcggggggcgctgcgggcagggccaggacccgcgcgggcgggcgcggatggagggctgcggggctgcggggctgcggggctgccgggctgccgggggccctgaggtcgcggggccgccgggactgggaccaggatggggtcgccggcgggcagcgtactcggaggcccgggggcctcggccgggagcgtgggagcaggggctaccccatgcggtcacgcggggacccccgtaaggtgagcgcggagtgaacgaagttggcgcagctctggggctgctggggcccgcgcgcgggcgtgggggcagtgggtcacgtggacgccccatctgggagcccccaagggctggccctggaaggccctcgatgcagaagccgggaggggctcccctcaagcttcctggggctgcggccgcagccgggcgctcccaggaaactcctccagaagttgtcaggcagcttcgggctgagcccaggggaccgagggagccatggggagtgggcacaacattgagggattcgtaggtgccgggctttgtgacctcactggggcccttcttctctgacacttggtcggaaacagacttcccaaaaggcggttgtgttgcggggcgggatggggggaaggactcgacggggagaggagtggccccgttggtcaccggtgccacgctggctctcctgctcgagttttgggccttgtttgcaaacgttgacctcgtaaccccccaaatcggaagtgggacccataaaaacgatacctaaaaaaaatcttggacactgaggtgtaggggcaggaaagggttaagcgtcagggtgcggagggagagttgaattgctcacttgtgggctcggagtcccaaagagcaaacagccactgtttttttctcaaacattctcacctcctctggggtccgcagaccttacaaagacgggctttgttgccaggtaggactgccagcagccttcttcctctggcctgtggggagggcaggggctggtgttgccagcctgggcaaggctgagctcaggcttaccctggtgtcattggggccggggccctaaactgggaccctcggggtttggggtcacagggacagcggcactcacggggacccctgaagtcctgttctgggctggctggacctgtactcagcttttcttctttgtcctgtggagaattccaggagtgccgagatccccagatctgggctttttggtgcccctcccaaccccccacgggcccctttgcagaaccccagctcccctcctgccatttgcatccaagatggactctccgctgccgccgctgctcctccggcttccttgtcatcatccctcacgccctgcagccctgcctcctgttcacgggttgccaagccgcggcctggccggtggtggcagtggcggagttagacaaagcccccgcctcccccgccccagagccccccaggcgccccaagtggcgggaaggccgccagctccccaggccccgcgctctttgtctggcgtgggggtggggagccgcgcctggccccaggagcttcctggcctctgccaacccctcgctcctgcacactgcgctcattgtctgagatgcgccgagacggccttcgctgacgtggtccctgtgtcctggtccctgtgtctgcaggaaggagtgaccaggagtggaactcggagcccttccgccatctctctccaggactagacacccccccgcccccgaacaagggagtggcctggacagagcactggggtcaccgagctattgctcctcgtcccccagccaaaatgggacgatttctccttcctcctccctctcagccctgcaaaacctaaccccagtatcatcaaatagtaggaactggagcccatagaccttctcttgggaagcactgcctctaacaaatggagaaactgaggactggagggcggggagcctgtctgaggtcacacagccaggagtggcacagctggggctggcacgaagtccagtggggaggacagaaaaggggaggtgaggagcagtgggcagagcagttggggaagaggacgggggcacaccgagggaatgcgagggtgcgtgggaagtggccagcacccctcctgccagggcgctgggatcttgcaaacgcctggggtgctgtgcgcgatgctacccccagcgactggccctggagccagagaggtgtagtgaccaggatcagaacccaggtctgtgccggcagagcctgtgttcgccatgccatgcttgctgccacatcagaagctcaggaaactggggtttggctgatgtagttagggggctctgggggacatcaccctgcccaattcctgcagtggccatggacgtgccagatatcgtgggcgttgtgcgtccccctcccaagcaacccgcccctatagcgcacgtgtctcatcatccgcatgtgtctcatcatccccacgtgggaggcgtggaaactgaggctcggagtggcacggtgctctgcccagttcaggatccaagtccacgtttgcagttccagcccaagctggagcataaccctgggctgcagtggcagcatccagggctggcctgagactcaggagacagctcggaacggtccccgttctcggagagaggggcaggtgccggggtagctggctccctgctttggtctcctctatgctgtgtgccctggggccaccccttcaggtccatttctctaaatcgaggggcctggagccagggttctccagtgctcctcccggctcccccagcttgaggccctgaacttccttcctcctctgcccctcccctcacccacaccaagcgagcagctggtgggtttggccagcctggcaccagctgtctgtccccgaggccaagtctgcggcgcccactgtgtgtgtgagagagagaccgtgtggctctgggggcggcaggcgggcagctgccgaggaggactaggtaaattctccatggttaccgctgtttgtcattctgcaggatatcctttacccgctaatggccactgggacgccattgcggggccgcgtgctcctagccacggactcccctgccagatccaggaggctgcgttctgggctgggccctgcttggtcactgactgcagctctggacaggccccaatgttgcatcccatatgtggggcctcaaccctcctgtcttgggatacagagcccttggggcatagactgctaagagtctggtcccctctttggggagggggagacaggcacagaggggttgaggggctttatctggggcacacagaggccatggtgttctctagatttctgatttgatgtccagcgtgcctgtctccagccagggttgggtctcaaatactccaaggccttcctgtcttccctgtcattgagcacagcagagatttgagcgcatagaagcaaaaaggcttggaagctcagcctggtttcgaccagcctatgtggcgctgtggtgtgatgtggcctctaggttctcagcctctggggaccaggacacagggagaggggatgggcagagttcaggccaggagtggcaataattttatctttgggagcagccctgctgcttggaaggttctggttggatgggatggagctctgtgaggaccagcggctgctgcagagctggggatggtcaggtgccttgtagctacatttcattatccatcttatatgctggtcaaaccggaggtggagagcagggttctccatcctgctacagttggtggtgtgggtcctgggcaagggctgttgcaggacccggagtccttgccttggtacaactggctgagctgactcctggcctctctctccccaccccacagctgggagtgtccactcgccttccaccagcatggcaacgtcttcacagtaccgccagctgctcagtgactacgggccaccgtccctaggctacacccaggtatgtcaatgggggtgatggcatggtgggagggccagggggagacatgcttcccaccatcagaggagagaagttggtggaagagacgaaggagcagaaaggatgggacggagctttctcagcccaaggccctggctgcgctcctgctcagaacacatcagagtggagggcactggggactgtgcttcgcggggacgtgtgaggtggaggggacaggagagcaccaggaaggggcagcagcccaagctgtgctgaggctcccaccccacgcgttcctccagtgggcctcctcactcctctttcttgggcaagtgaggcctgaccttgatgctggctctccaagctgggacagaagatagggtcagttcccacttgctctccacgggcgcgggcccagcagagaggaggtggccctgtcttgagagcccagctgccttttgtcgagggccagtatttgagagtgtggcctgggcgaggccgctccctggttccaccactttccagactgtgaccccccacttggtaactgcccaagacccgggctcctcatcagcccaagggtgatcctagtacccccagcccaggctggcgaacagcaggaatggggccgccaccatctcagctgcaccctacatctccaagggatgagccgccccggggaaggtcccagcgggaagatgctctccctggctgggccccagcaccagtgttctgaggtcgctatggagcctgttcctcgccaagtgggcggctccccggccatgccccaccaggctgccctgccccaggaggagaagcaggtgtgggcctgtgagcgggaccggctgaagaagcggtggctgtgggaggccaggcagaggggcagccgggagttggcagtgccacgttctggccatgcgacggcggcgccaggacaggcgggaggcccgtgaggcctggaggcagtgccgtggggaggcagagcagccggagcaggacgaggacaggacagagcgcgaggccaggggacagaggcggtggtggaggaggggggaggcaaggacctcgcccagggagctggcgtgtctatgggaggaggtggccaaggggaggtagcctgggcttgtgggcttgcgggcttgtgggcttgccggaagcccagcctcgctgatccgggtgcttgctgtggggctcccagtggtggtgggaggaaaggttttctgggggttgggccctgttggtgggaggatgagagaagggaatgcattccaggctctggctgggccatggcggatcgctgtggtcctggtggcccaggtgtggcctcttgtctccccactggcttggaggcttggcacctgggatgtgccctcccatccatctgcatcctgggaaatgctgtttggactcttttgtgccaaaatgagctgtttcccctgttttgttcattggagataataaagttgcttcctggagacgactgggtggcctccctgagtgtgtgaggataggagggtgaggaccgtctccctaacttgtagttgtcccctagaatgggacgtgccttggcccagctgaggtggctgccccagaagtctgaggctgggctgcgttccctatcctgaccggcccggggccctctccacccacctgcctgtggccttggggtcaggctgctgaacccttttttttttttttcccccgagatggagtctcgctctgttgcccaggctggagtgcagtggagtgatcttggctcactgcaacttccacctcctgggtccaagcagttctcctgcctcagcctcctgagtaactgggactacaggcacgcaccaccacgcccggctgattttgctgaacccatttctttctgattctagggaactgggaacagccaggtgccccaaagcaaatacgcggagctgctggccatcattgaagagctggggaaggagatcagacccacgtacgcagggagcaagagtgccatggagaggctgaagcgcggtaagcccggccccgctgccctgtcggtgaccacagtgctagacctttaactctggaaagacttttggggaaaatgtgggaaggtgggctagggatgaggctcactcatgggagctcctgtcttgttacagagttgccgtctgtggtggaggcctcaggcaggcgatgggtctggtagcgaggggcctggggggctggatgtcttcagaggggtcttctgggaagggcagcccaggcagggagcccttcttaccctgtgtgctgccagggggtctgctggctttcaagggtgtgttcgaagtgccccctgcccccgaccctgcctggtctgctcctgtgggccgacactggtcctagggaagccaagctcagggttcatcggtgcctgcactgccctctgctgtcacctctttggagggagacccaaggaagtgtgtgggtctgtgctagggtctggggagggaggctgagagcactttgttctttaatggttggagagggagggcaggcaggagatgacagagcacaagggactcgtgttaaggtgtgactgtccgtctgatttcgaaaggacgttaaataggttgctaccttctgaaataaaaggggagtggaggtaggacaggatttctattttagaaggcgacagtgcagcagagccatagcccatgaacgcattcaagatgaggggagacttggggctctttttttttttttttttttttttttttttttttttttgggagacggagttttactcttgttgcccaggctggagtgcagtggtgcaatctcggctcaccgcaacctccgcctcctgggttcaagcgattctcctgcctcagcctcccaagtagctgggattacaggcatgtgccaccacacctgtctaattttttgtatttttagtagagacagggtttctccaagttggtcagcctggtcttgaactcccaacctcaggtgatccacctgccttggcctcccaaagtgctggcattacaggcgtgagccaccacgcccggcctgggacttggggttcttaaaaaggctggagaagcaacctgggagaggaacatttttttttttttgagatggagtctagctctgtcacctgggctggagtgcagtggcacgatctcggcccactgcaacctccgcctcccgggttcaaacaattttcctgcctcaagcctcccgagtagttgggactacaggcgtgcgccactatacccagctaatttttgtatttttagtagagaccaggtttcgccatgttggttggccaggatggtttcgatttcttgaccttgtgatcctcccgccttggcctcccaaagtgctgggattacaggcgttgagccaccgtgcccggcctgggagaggaactttctttggttgtaaatctgtagcataaatgggggctgtagttgaagttatgccccagtgacacgagggccagttgaggacaggctgctgccaggagcggggttgctctggagtttatgaaacctttgtgaagaggttgacgggtctcaaagctaggttgggactaccagggttagaggatgtgattgaagagggcctgggggaagggatgcagagcccaaccctggtctcgcctggagagttgggtggtcccagggctgctctccggtagctggggtgctgcttacctgaatggaaattcctgggaagatgctgggtcccagagtccaacaggtaatttgcagtcacccagaaaaggcactggttcaagtcagcaaatgcgtacaaactgccagtcttttagtaacaaggaagacctagtgctaccccttggccaacagccaagcccaagcttaccaagctcatgtcacagcagggtgaaaacacgtcatagaggggtcagggagttaggagctaggagcattgtaggtaggttggcaactacagcccaagagccaggagccaagaatagtggttttttttttttttttttttttttttgagacagagtctcgctctatcacccaggctggagtgcagtggcgcgatctcggctcactgcaacctccgcctcccgggttcaagcagttctgcctcagcctcccgagtagctgggattataggcgcccaccaccacgcccatctaatttttgtatttttagtagagatggggttgtaccatgttggccaggctggtctcaaactcctgacctcaagtgggcaacccgccccggcctccgaaagtgctgggattacaggtgtgagccaccgcgacaggcatggttcttaatggttgaaaaaaaaaatgattttgggacgtgtgaaagttatctgaaattcagacttaagtgttcataaataaaggtttgtgggtccaggtgtgatggtgcatgcctgtaatccagcagtttgggaggctaaagccaggagcaacatagtgaaactcccatctctacaaataatgataaaacagccaggcatggtggtgcgtgcctatagtcccagcttctccggaggctgaggtgggaggatcacctgatcctggcaggttgaggctgcagtgagctgtgatcgtgccactgcactccagcctgggtgacagggcaagatgctgtctcaaaaaaaatttgagtgaagtagttgtgtcagagactgtagcctgcaaagctcaaaatatttgctgtctggtcctcacagaaaacattctccaaggctctgagttagtttctaagatttgtgaggtgatgatgtgggatgtcattcccagtggcctctgggagtcatgtattagaaggaatagaatccttagtgtctattaaaagatcatatttcatgaagttcagtagaggcagaaagaaaaaaaaggtaagcaccaaaccacagagacaaaagactggggaagattcatcgggcagaaggtagctgcagtcttgtggggttgtccccgtggacccagggtcccgcgtgggtagtagtcagttctctgcgccctcacgtgtgcagctgaagccattctcttgcttacttacgccggtcaagccctgtctagaattcagactgaagaagccagagaaaaatctccatagtgggtcaagcaaaagaatttgggtggagacatgtctttcatccaacagtgtcgtggaaggacagcttgctggtgcaccttgaatgcaggaaaaaatgtttagagagacaggaagagttgtggtgaggagggaagggctttagagagggatgggattgttagcgtccttcagggttgcttggttataggtttccctggttctctttatgtctgagggttttgtggacaggctgtggaaggatggatcctcttgctgtttcagaatgggctttgctggctggtcctgtgcacttgctgacctcaggtctctgcctctgtttcaggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttattttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattcttacgtgctgttttatttttttgagacagggtcttgttttgccacccaggctggagtgcagtaatataatcttggctcaccgcagcctcaacctcctgggctcaagcaatcctcccatctcagcctccctagtggctggaactacaggtgtgtgccactatgcctgaataatttttaaaagactttttgtattgaatgaatgggtgtgtgatggaaaaaaaattttttttgcagagatgaggtctcactatgttgcctaggctggatcctgggctcaagtgatccttccaccttagcctctcaaagtactgggattataggtgtgagctaccacgcctggtgtaaagaagtgctattttaaataatctctcatgaaagtgtttgaaatgcttgttccccggtgccgtgaagaaatagcacttgaacataaatttaatttactcagcaaggccatttttacttcccgcagaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggtaaacacttttaaataaggaagaggaacaggctatgacctaatgcttgctccgaccagtgtaagcatgccagggcaaatatttaggctaaattgtgggagctaagaacataaagtacattgatttctttaccacggctagcagataattaggaatgttagcacaggtctttgaataaattttgcttcgaagagaagttaccgtttattccaaattaaatggggaggaaagtctttggagaggaacctctactttaccttttacaagaggtaggagatgcctgttcaaactgtattttcccatctgacacggaaacattttggtgatatcattagcacagttggctggggaaagaatgtgtttgctaagtcagaggtagggataaagtgaagttgcattatgggtgtattttaagtgcagcaaacttaagtgtatgctaggaaaaaaaaatagcagcagtttttaaaaaaaaaatttttttttttttagatggaatctccctctgttgcctaggctagagtgcagtggcttgatgttggttcactgcaatctctgcctcccaggttcaagcgattttcccagcttagcctcccgagtagctggattacaggagcgtgccaccacacccagctaatttttgtatttttagtagagatgggattttaccatgttggtcaggctggtctccaacttctgacctcaggtgacccagccgccttggcctcccaaagtgctgggtttacaggcgtgagccaccacgcccggccagaagcagtattattgagttggcctgttaccccatggttaggccattctcagttcgtaggtgcttatcctgtgggcttttggtgggtgctacaggaatctttttcataaagtacggctcctaacttcaagctacttcatatggtgctcactggaagaattatctgctctggtgccagggaaaaaatgggctgcactggatgtgttgagagtccacgtggtggtctctgacagtgcctcccaaagggattttaattcttactctataccttaggccctaaatacctgcaatgagaatttgctttgctgagcagtagacaaagacaaatgagagagacttgtctttctttgatgcaggcatgaggcgaattctcagccatgacaaggctgaaggccagcaggaacaggctctagcgaaatgggtgctgtgtccccttcctgcatgtggcagaaagttgcaaaggtatgagagaggagacaaacggaaaccattctcccttatctccagctc

SEQ ID NO: 15059 - DNA, 24972 bp, Human
atgtgtttggggtggtgcgtgcatgtagtccttactactggggaggctgatgcaggaggatcacaagcccaggatttcaagaccagcctgggcaatttattgagacccccccatctcttaaaaaaaacccaaaaaacaaaaatccaaatgaatgattaatgtgttgtggtagcctgtttagtttagagaatagaattcctcttaacagtaaaatcttgacgtaggaattgcttttccctctgttttttaacttttttttttttttttgagacagagtcccactctgtcacccaggctggagtgcagtggcaagatctcagctcactgcaacctctgcctgccaggttcaagtgattctcctgcctcagcctcccgagtagctggaattacaggtgtgcaccaccatgcccggctaatattttgtatttttagtagggacggggttttgccatattggctaggctggtcttgaactcctgacctcagtgatctgcccacctcagcctcccaaagggctgggatgggcgcccagcctggtttttttaccttttaaaaagtgactcttaattacgattggccttgctgctacatgatttgatgagtacgggccaaattgacagctacgcctccctttaattttttgctcctgaaattctaccactgggattcctactactagttaaccagtgccttctgtccttgaccaggcattcagaatgcagtaggtggttttgtttgtttgtttgtttgtttgtttgtttccagacggggtctcattctgtctcccaggctggagtgcattggcaggaacatggctcactgtagcctcgacttcccggtctcaagcgatcctctctcctcaccctcctgagtagctgggactacaggcatgtgccaccatgcccggctatttttttttccccgagatgaagtcttgctctgttacccaggctggagtgcagtggtgcaatcttggctcactgcagcctccgcctcccgggttcaagtgattctcctgcctcagtctcccgagtagctgggattacaggtgcttgccaccaaacccagctaatttttttttttttttgtatttttagtagagatggggtggctcaacatgttggccgggctggtcttgaacttatgacctcaagtgatcccccctccttggccttccaaaatgctgggatcacaggcatgagccaccgcgcccggccctaatttttatatttttagtagagaaaaggttttgcgatattgcccaggctggtcttgggaacttctgagctcaagccatctgcctgtcttggcctcccaaagtgctaggactacaggcctgtgccaccacacctggccctcgttcagtagatatttattgagcagctgcaatgtgctaggcagtgtggtaggagtgaggataagcagtgaacaaaagagacaaaaattcctaccctcacagagtttacatttagtgcattggagatatagtggttcaggacgtagacaagaacttgctaagggcccactgtgctttaaagctttttttttttttttttttttgagacagagtcttgttctgtggcccaggctggagtgcagtggcgtgatctcggctcactgcaagctccgcctcctgggttcacgccattctcctggctcagcctcccgagtagctgggactacaggcgcccaccaccacgcccatctaattttttgtatttttagtagagacggggtttcaccgtgttagccaggatggtctcgatctcctgacctcgtgatctgcctgcctcggcctcccaaagtgctggggttacaggcgtgagccaccacgccctgcccagctttaaagctttaactgggtcttctgttaatctcataattataaggtgataaacatttaaggcatatagtggtgctctggatttaatttatgaattgggaatgttagctttgattcatttttatggagctaatgttttaaattttatttcttgttaatattttcagaagatgaattgaatcttctggttattgtagttgatgccaacccaatttggtggggaaagcaagcattaaaggaatctcaggtaagactgcttgaggaggcctttggagaattctggtttaactgagtgtttatattgcttttttaaaaaatggctttattaaagtataatttacatactgtaatattcagccactgtacaattcagtgattttttttaagtaaatttgcgaagttgtgtaaccagccccacatttctgctttagaatatttctttgactgcgtagcgttccctcatgcctgcttgcagtcaatccctgcttctatctccaagctgcaagcaaccactgatctgccctctatctctaaattcccttttctggacatttcatgtattgatttcatacaatatgtggtcttaaaaaatactttctattttgaaatattttatttttaaataatatagacataggaaaccagaaaagatacagagaggtcctgtgtacccatcactcaagttctttcagtggtgacattttacataatgatagtacaattttgaaactatcagtgcaatctacagacctaagcagattgcaggttttacatgtgctcacttgtgtgtatgcgtgcgtgcgtgtatgtgtgtggttctgtgcagttttaccacattcattgatttgtgtgtccatcagcaccaccatctcatgcctcagcctcccgagtacttgggactacaggtgcgtaccaccatgctcagctaattgtttgtatttttagtagagatggggttttgccatgttggccaggctggtctcgaactcctggcctcatgtgatctgcccgctttggcttcctaaagtgttgggattatgggagtgagccaccgcacctggctgattcttcatgtttgttcgtttgtaatctggtcccactctcgaccacaccttctttgcctgtctgtactcccaggcaactcttgatctctttgtgtcactgtagattagtttggattttctagatttttttcatgtaaatggaatcaaacaggttatagtggggaggtttttgtggccttttttttttttttttgagacggagttttgctcttgttgcccaggctagagtgcaatggcgcgatctcggctcactgcaacctttgcctcctgggttcaagtgattctccttcctcagccttccgagtagctgggattacaggcatccgtcaccacgcccagctaattttttgtatttttagtagagttggagtttcaccatgttggccaggctgatctcgaactcctaaactcaggtgatctgcctacctcggcctcccaaagtactgggattacaggcatgagccactgtgcctggccttgtctgttctttttaatgacaggttagctgttttccacttttaaatggtttaaaataaaatcagaagaataacatttttgtgacttgaaaattatatgaaattcaaatttctgggtctataaataagcctcactcataaatttatgtattttctgtggcagcttttgcattacaaaagcagaggtgggtagcaataaagattgcatggctcaaaaagcctaaaatatttactatctggcccttcacaaaacaagtttactgacctctggccgattgtgtggtctgttctggagaatgttgcatgtctacttgaaaagaatgtgcattcttttgtttctagtgaagtgttctataaatgtctattagtttaagttgcgtgatagcgcacctatagtcccagctacttgaggcgctgaggtgggaggatcactggtgcccaggcggttgagtctgcagtgagccataactatgccactgcactccagcctgggagacagagcaagaccccgtctcaaaaaatataaaataaaaaaataaaaaaattatcgagaatggaatattgaaatgaagtattgttgttgaattgtgtatttcttttttttttttgaaatggagtttcgctctgtcacccaggtcggagtgcagtggtgtgatctctgctcactgcaacctctgcctcccggttcaagcgattcttctgcctcagtctcccaagtagctgggaccacaggcgtgtaccaccacgcctggctaatttttgtattgttagtagagacggggcttcgccatgttggccaggctgatcttgaactcctgacctcaagtgatctgcctgcctcgacctcccaaagtgctggggttacaggcatgagccacgtgtctgcccccgtttttttttttgtgtgttttttttttgagacagagtctcactctgtcacccaggctggatagcagtgctaggattacaagtgtgagccaccatgcccatttccccatattttgatagcagcagttagtgtactcacatttaatataattattagtgtggttgcgttcatatctgctattttgttatttgttttctgtatgtatcatgaattttttggttctttgtcctcctttactgtcttttgtgttaaataaatattttttacgtactatattaattcttctgttgatttgattaattcttctgtatatttttagtttttttgtttgtttgtttgttttttgagatggagttttgctcttgtcgcccaggctagagtgcaatggcacgatctcggctccctgcaacctccatctccctggttcaagcaattctcctgcctcagcctcccgagtagctgggatcacaggcgcgtgccaccatacctggctaatttttgtatttttggtagtgacagggtttcaccatattggtcaggctgatctctaattcctgacctcaagtgatcctcccgcctcggcctcccaaagtgctaggattacaggcatgagccactgcacccagccttcagttattttctttttcttttcttttttttttttgagacagagtctagttttgtcgcccaggctggagtgcattgacatgattttggcttactgcaacctctctctcccgagttcaagcgattctcctgcctcagcctcccgagtagctggtatttcaggcatgcaccaccacacccagctaatttttgtattttcagtagagacggggtttcgccgtgttggccaggctggtctcgatctcttgacctcgtgatccgcccacctcagcctcccaaagtgttgggattacaggcatgagccaccacacctggtcaatctcttcttacttgtgattctatttccaaaaaagatcatgtacacatgtaccagaagttaggacttgaacatatcttttggggggacataattcgacccacaacagttgctgtagggattactgtatgtatcttatcattgtgtactttagattaatactcatttaattccagtaaaatatagaggctttgctccaatatagatccacttccaccccttccccatgttcttattgtcatacatattacacctgcgcatgttataaatctgataacgcagtgttataattgttacttacacagttgcttacaccaagtataagcatcttttctcttgttaacaaaaaataaaaatatcagacaatattcatgttagaactacactcatttttcagctgaaaccatactcttttttctttttttgagatggcgtcttgctctgtcgcccaggctggagtgcagtggtgcaatctcggcttaccgcaatctccacctcccgggttcaagcaattctgcctcagcctcccgagtagctgggactacaggcacacgtcaccatgcccagctaattttttgtgtgtgtattttagtagagatggggtttcaccatgttgcccaggctggttgcaaactcctgagctcaggcagtctgcccgccttggcctcccaaagtgctgggattacaggtgtgagctactacgcccggcccaaccatactcatttttcaattagctatggatacaagaattcagcaaaaatcaacataggcattctgtgagaatccattgacttatgcaatttactataaagagtattgtgcattttactgttatttgtaaattgtgtgctacatactgctgtatcagtaatattcgtatgtacttgtgtacatgggtacctcggttttggggagcgaatggttaaacatccgccagcacatcactgcatgctgccctgttactccagaaaggctgcgtttgcactcatcagtgctgtatgagagttccttttttcttgtaccaacacaaaatgttcattctccttatttcatcttttgtcaatatgaggcaaaaaacaacgtaatctcaatttgcttccagtgtatttcgtggccatttgtatttctctcttgggacatcacccacttctttctttggatattcatagtgtgtggttttttttaaattaatgatttatggacagtcttttatattaaaggattaacccattacttgccatgtgttgcaactggttttttccagtttgtaacttgttttctttcacttttatttatattgtcacttttcgccaattagaaattttaatagatttaagttttttttccagtagggtgaaatttaccagtgtgttggtctattttttgagatggagtctttgtcacccaggctagagtgcagtggcacgatctcagctcactgcagcctccacctcctgggctcaagcagtcctcccacctcagcatcccgagaagctgggactgcaggcacgtgccaacacgcccagctaatttttgtattttaagtagagatagggttttgccacgtaagccaggctggtctcaaactcctgaccacaggtgatctgcctgcctcggcctcccaaagtgctgggacgtgagccaccacgcccagccaccagtgttctgttttctacctgaagtatttatttaagagaaacaggccatattccaggattatgaaaatatctacttatgaagactgaaacttcaaggatcatttgtttagtttgttactagagaagtttctctgaacatatgagtaccaaaaaaaaaatactgacttatgtttcttaataatattagttcttgtgggaaggtgagctcgaggaaagaagggatattctttatttgttttttcaaactttaaaagtttttaggctgggcatggtggctcacgcctgtaatcccggcactttgggaggccgaggcgggcggatcatgaggtaaagagatcgagaccatccttgccaatatggtgaaaccccatccctactaaaaatacaaaaattagctgggcgaggtagcacaggcctgtagtcccagctgctggggaggctgaggcaggagaattgcttgaacccgggagttggaggttgcagtgagccgagatcaggccactgcactccagcctggcgacagagtgagactccatctcaaaaaaaaaaaaaagtttttaattcatttacccactaagtatactgagcaacaactatattgttcactaagtatataccagacgtacagtagtggctcagtatagttagtgaacaaatgaattaaaaaattgtaaaggtctccagtgttttcagtatgtattcattatctactccacatatagtaatagtttgctggaaattttatcacagaacatgtgacatgtttgttattctttaaatgttacactgcaaatatttgtggaatattgtactgatgtagaaatgatctcatataagtacaattagaaaactatagttttcaagtgtttttgtttatggctttggaggaggggagctcctgagcaaatttttaacagtgaataattgtctaaaatttaaatgaagtcttttttttgtttgtttgttacagggtctagctctgttgtccaggctgcagtacagtggtacaatcttggctcactgcagcctggctctccagggcttaagcgatcctgccacctcagccttcagagtagctaagactacaggtgcacaccaccatgcctagctagttttgttttttttatagagctaaggtttcattatgttgcctaggctggtctcaaactcctgaactcaagcagtcctcccaccttggcctctcagggtgctgggattacaggcttgagccactgcacccagcctaaacgacatcttaattatgtcaagacctgacatggttatttggatagctaatttgtttttctaatgtctttttttttccaacagttcactttatccaaatgcatagatgccgtgatggtgctgggaaattcgcatttattcatgaatcgttccaacaaacttgctgtgatagcaagtcacattcaagaaaggtatgaccattgtgattgcttttgctcttcagtgcttaatattcatgagttttctgtgccagttggcatgtattgttcctactccatgttgcaaaagaaaatgttttctgtaccagtgaacagccacagcaccaagagccagtacatgtacattgtgatatccatgaaatttgcaaaccttattattagtagatagtagagttacacaatggcccatgtaatttgcacagattgaactatattatttaggcaaaaagggaaagagagctatcaaatcggacagctactttccctcacctgtcttcccattttgtgtctgccccagcgtgcaagttagatgggagatgtgattctgttttcctttagctctgcgtagttctcatggcctgtttccctgctctgtgagtgaacctggtgctttgaaataaggatttttcttataacgttggcttctaaacccaagccaactactccatctggtgcttggcagaagaaacagtggtcgcttctaacactagtgtgaaaactggctgtgttagactcactgcaagatggtgcatagcctgcagctgatgtgtaaatgtgaccgcagatacagcaaagtttttgtgaataatttgggccatatttacttctcacattatgcactgacagaagagttgaattaccatgtaagacacagctcttctatgtctttttttttttttttttttggagacaggatcttgctctgtcacccaggctagagtgcagtggcactatcatgggtcactgtagcgtctgaccttctggacataagtgactggacctcctgcctcagtctcccaagtagctgggactacaggtgtgcaccaccacactcagctaatttttgtattttttgtagagatggggtctcactatgttgcccaggctggccttgctctcctgggctcaagcagtcctttcaccccagcctccccaagtgctgggactgcagggatgagccactacacctggctcttctatgtcttaatcaccacattacaatagaagtgactcttgctcaccaacatatttcatatggtagctgtcagattttcttggttcttagggctgcctgcttcctctggtgaggtgagagagcccatgggccaccaaacacatactcttactcccatcctcgctgcatattttttctcagaattggatgaaaagatgatattagtttggttaaaataccagtaaaaactatacctgtcaaagttttttttttttttttttaatcaaaggtatcctctacctgattatcttaaaagtcacaaggccatggctgggtgcggtggctcatgtctgtaatcccagcactttgggaggccgaggcgggcggatcacgagatcaggagatcaggaccatcctggctaacatggtgaaaccccgtttctactaaaaatacaaaaaaaattagccgggcatggtggcgggcacctgtagtcccagctactcgttaggctgaggcaggagaatgtcgtgaacccgggaggtggagcttgcagtgagccgaggtcgtgccactgcactgcagcctgggcgacagagcaagaccctgtctcaaaaaaaaaaaaaaaaaaaagtcacgaagtcacgaggccgggctcggtggctcacgcctgtaatcccagcacttcaggaagctgaggcagattacttgaggtcagtttgagaccagccatacatagcagccaacatagtgaaaccccatctctactaaaaatacaaaaaattagctggacgtggtggtacactcctgtaattccagctacttgggaggctgaggcacgaaaatcacttgagcccgggaggtggaagttgcagtgagctgagactgcaccactgcactccagcctgggcgacacagcgagactgtgtctcaaaaaaaaaaagagtcatgaatcactgggagaatcttttcagggacctttgggccagatttttattactgggatagatatgtacctcaaataataaactagtagtgagttagaatttggtatgaacctgttgtggttgtcatttgagaaaggaaggcacgggcacccctctgcagcatttctgagattataacccaacgccctctgtatttccccacacttttcagaaaacactggaatcagtaaaacattctgtggtgatagacaaatgttggccagtttgcctattttatacattttttctttgtttttatacgctttttctaattttatcttacacattttttttaaaaaatgaaatttaccgtggaatcttgtgagtcccacattgttgtaattttgtttgttgcctctgctgaatttcattctgatcatgagtgagcctgggcggtgaggcctggtgtaaccaggttttttcccctgctgtttcagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtaacaacttttaaacattgttattttgcaaatagtgttgattttggaggtcctttaggctttaagttcaaagatgtgaggttctttatgttgtatgcctgcacgttctcactttttaaaaatcattttcgtcaaagttggttcattatttgcctagcctctacagcatttgacgctgctgagcagcctttacttctggaaacacgacttttggcttctacgaatgccctgtgacctgtttttcctcttttcttgaaacattatttcatagtctctatttctggcttttccttcatcttgtctcttaaaatatgtttttaattcggcacatgattttcatcttttctccctctatatgttctcatccacttttgcctttaattatcttttacatatggacactttccaactttgtttctaacccagactttctttcatgctcaaatgcctccatttcagcgtcccacagtctctggacatggcccaggctagtctcattatctttgctctcactcacaccaccatttccattccctatttctgtcagctcccatccaagtagttttctaaacttaaagctttcatttttaactcctgctcacatccgacatctaatcagctacaaaatcctagtcgtttagcctcagaagtgtctccagaatcccgctccttattgtcatctttttatttttcatttttaaaatttttatagggacggggtctcactatgttgcccaggctggtcttgaactcctgggctcaagctatcctcctgcttctgcctcccagagtgctgggattacaggcaggagccaccacacccagcccccatccctattgtcatctcttttttttgagatggagttttgctcttgttgcccaggctggagtgcaatggcacgtgatctcagctcactgcaacctccgcctcccgggttcaagagattctcctgcctcagcctcccaagtagctgggattataggcacgtaccaccatgcctgactaatttttaatatttttagtagagatggggtttcaccatgttggccaggcttgtctccaactcctgacctcagttgatccacccaactcggccttccaaagggctggaattacaggtgtgagccaccacacccaggccccatcccttattgtcatcttgatcggcctcagcattattgacattttggtctggataattctttgttgtggcagctgtcctatgcgttgtaggatgtttagcagcatttctggccttgggccattagacaccataatatcccccagttgtgacaaccagatatgtctgtagacatagccagatgccccctgtagggcacattcaccccacgtttagagccactgctctagattgttatagcctctaactggttttctgactcctgtctccccagtcaagcctttgcactcagcctccagagttatcatcttaaaaatcaaagctgccattcctgggcttataggcctttcctggctccctgctgcctgcaggtgatggtttccaaaccttagcctgaatcagaatcacctgggggaaaagacaattctgtggagacagaaagttggttagtggttgcccagagctgggcagagactggggagtgattgcaaatgggcccaaatgatcttttagggtaatggagactgttctaaaattggattgtgatgatgattgcataattgtaaatttactaaaaataattgaattgcatacccaaaagtacttttagaccagaatttatggtttgtacattataaacctgttaaaaaatcagctggaaggcttgttgaaacagtgtcaggccccactcagtttctgattcactggatctagggaggtcctgagaatttctatttctattacagtgccaggtggtgcccctatagctggttccagaatctcaccttgagagtcactggcctccaggattaagtctcagctcagcttcacagtatagtgctcaagaccttttctggtctgacctcacccatgaggtgtcagttctcctggaccagctctaagctggcttgcacagagtgtcaatctgagctccttgccctcttgaactgcagttttagggttttgatatcttgagtgacttttttcacccaaggcaccaaacaagtggcaaactcctccctgcttctcatggctcgaggaaagagcttctccagtcttccccgcactggctgagcacggagagtgatgggaaggaggggatggtgggagagggagggcaagggggcctcagagccttgtaccctgtccaggctgctagacttatgcgtgacattttgtaccacatagatcatgaataaactggaacctttccaagtaaaaacgggatctttttgtgtgtgtatgtatggtaaagtacaaataacaaaatttgccattttaccgatttttagaatttttaatgtaaaatttacttaccataaaatttaccattttgacaatatttaagtgtacagttcagtaatgttgagtatattcgccttcttttgcaatcatcaccgccatccatcgccagaactttttcatctttacaaactgaaattctgtacccattagacactaactccctgttccccctgccctctggctagcccctgaacaaccaccaggatgttttacattgagaaaaggttaaaaagttgcttagttaaccattaccaagaacacattgctatgtttttaaacctagtttgaaaatgtcttgtttgatttcatttatgaagaatgctttggtgtgaaagcatacttagttcaataaagcacccaatgattttagttcaagaaagtacttaaaaattcccttttaatgttttctgttatttgcaggtgacataaagggtcaacatacagaaactttgctggcaggatccctggccaaagccctttgctgtatccttggtgtctgaatcatttagaaggtgtcttctgtaataaacatatcttaacttgtgacatttcttaggaccttgggtgcccattactgggacatgtgagtactctgaagtggagggtaattttttaaaaaatagtttacattggctttgaatttttttttctttttttgagacagtctcactctgtcgcccaagttggagtgcagtggcacaatctcggctcactgcaaccttcgcctcccagattcaagcagttctcttgcttcagcctcccaagtagctggtacaggcacccgccatcactcccggctaattttttttgtatttttagtagagatgtagtttcaccaagttagccaggctggtctctaactcctgacttcaagtgatccacccacctcggcctctcaaagtgctgggattacaggccacagtgtgtggctggctttgaaatgtttattaagacaagctgtaaaggccgggcgtggtggctcatgcctgtaatcccagcactttgggaggccgaggcaggcggatcatgaggtcaggaaatcaagaccatcctggctgacacagtgaaaccccgtctctactaaaaatacaaaaaaattagctgggcgtggtggcggacacttgtagtcccagctactagggaggctgaggcaggagaatagcgtgaacctgggaggcagagcttgcagtgagctgaaatcgcaccactgcactccagcctgggcgacaaagcgagactacatctcaaaaaaaaaaaaaagaaaaaaagataagctgtaaaaactggaagtggggaagagtgagaaaactctagcttctccattatgtctttctgccttcaggaaacactgcttcagggtgctttcttgtttcttattttgataaattcagactttttaaacattttcattttcttcttgacttgggaacagtgtttgatttttaaaagccatttaggagccctgaagcttaataaatgagtggctccttctccataggtgaacgggttgttttgcatagggcaataccttttcattttatctgtgtgacgttttctcagtcttatggcattaattttttggaggaggggcagtattgagtgattattttgtcctggagtttgatgtgggttgcctgaacatatttgtaaatcagtacttgtcccaggattcaaatttaggacatggtaggtaagaataggacagtcaagtgttgggaattttaattttctgggacagagattatattttggtgagattacaaagtccagttgactgcagagttaggaactgaaaacccccaatcactcttgtgtatttatcttggtgagtggagcatttcccttcttagctaggtagatgctgggtttatttaaaattggaggttatttttctttttactataaatatttatgaagcaaaataatatttttgtattccttaatgttaagaaattaagacattcatagaatgaacaaggaagttaaaggtaagagcctacgttttcctatgagaactgtaatcctacttattttactagtatttctttactagactgtttaaaaattggttaggaaaccatatatgattagtaagatttagttaaatttttttctgcttttttctctttgtagacaatcaggaaatgaaatcaaggatattggtaagataaaaaaatcattacttttttatatgacaactataattagaaaacataacgggagaccaggtgtggtggctcacacctgttatcccagcactttgggaggccgaggtgggcagatcacttgaggtcaggagttcgggaccagcctggccaacatggtgaaaccccgtctctactcaaaatacaaaaattagctgggcgtggtggtgcatgcctatagtcccagctacttgggatcccgaggcaggagaatcgtttgaacctgggaggcagaggttgcagtgagctggaggttgcagtgagccgagatcacaccactgcactctagcctgggtgacagagtgagactccgtctcaaaaagaaaaaaaaaagaaaacataatgggaaataaaacgcatttatagtaggagcaaaaaatgttaactatccaggattcatttaacaagcaatgtgtaaaactgatgataaggaaaactaaaattctgagagcgatagaagaataagtggagagccatattttgttcttggatgtcagttttcccaaaatcacactgtaaattcaatttacaatctcagtcagaatatcagggaggtttttttttttcctggcagggtggggagatttaaaaaagaaattcaaggctgagcacggtggctcactcctgtaatcccaacactttgggaggccaaggcgggtggatcacgaggtcaggagatcgaaaccaacctggctaacatggtgaaaccccgtctctagtacaaatacaaaaaatgtcgtgggcgcctgtagtcccagctactcgggaggctgaggcaggagaatggcgtgaacccaggaggcagaggttgcagtgagccgagattgcgccactgcactccagcctgggcaacagagcgagactctgtctcaaaaaaaaaaaaaagaagtgccaagtaacgagatattcattgtttgttgcttagcacaaatgaaaaagctggcagttcccagggttgatggtgatgttggggattgcttattctcatgggttgctgataggaggataaattggtaaaaatcttttctggggtgcattttggtaatctgtgtcaaaattaaatgttcatatactttagtaatcactgcttattttccggaggtaattagagagctgtgcagatggtatatgagggtatcatcagggtattgtttaaaactgagaactggaaactgcttaaatagtggaaatttatgaagtccgcaaggagcatagtatatattataattcattgacattagaatattttttcccacatatattgtggactgaaaaagcaggttgcagaatgctaagtaatcatcttgatacgtgtgagtgtgtgtattttggatgtgtgtgtattctggatgtgtgtatgtgtgtatattttggatgtgtgtgtgttttgggtgtgtgtatgtatttggggtgtgtttgtgtgttttgggtgtattttgggtttgtgtttgttttatgtgtgtatttggggtgtgtatattttgggggggtgtattttggggggtatgttttggatgtgtattttttggggctgtgtatttggttgtgtgtgtgtgttgggtgtgtgtatttagtggtgtgtgtacttttggggtacgtgtattttggttgtgtgtgtgtgtattttgggtgtacttacctgtgtattttgggtgtatgtccgtgtgtgtattttgtatatgtgtgtgttttgggtgtatgtgtatttggggtgtgtgtatttggggtatgggtgtattttgggtgtgtattttggagtgtgtgtatttttgggtgtgtgtgtgtattttgggggtgcatgtgtgtattttgggtgggtaggtgtgtgtattttgggggcgtgtgtgtattttgggtatatgtgcgtatgtgtttattttgtgtatgtgtgtgtttgtgttttgggtgtgcatgtatatacctgcccatgtaggtgctctccagaatgagttcatcaaaccgttacgtggagcgggatttcgggggaaatgttactgtcatctttatactttaggtatcatttaacaatgataaatgggaagacaaactggaataatgttggttgtggttcgcagtatattgtgtgacattggtgtgagaggactggcatgtgcctgggtggaattaacatgactgtgatttttaggtgattaaggctgcagaagacagtgcgttgcagtatatgaacttcatgaatgtcatctttgcagcacagaaacaggtgaactgagagcctgccgtttaaagtatttgtttcataacgaaggagtcaatttcattttttgaatgctctactctgaggtattctgactacgtaggcttatgaatgggcaaggaatccagaatctgtattatgttctagtcttttctctattttgggtcctggaccacttgagaatctgatgcattcccaaaacaatatgcactcaaccacagttttgcatagagtttcatggtattcaggtaacctttagcccatccttggaccccatgccaagaatccctggtttgacagtttgctgtataaaccttgcatcagtttctttatcttgttgctgtggcgaagctgtaaaaattcagtatttttactttgcaaagagctgaaatgttcagatgaagtataatacattttcttctttggtgtgtttatgaagaaagaaaacctccttaaaatttcagttttaatgtaaaatgctgctatagccatgcataatgttctctgttgtggagtggcagcatgatgtagtgaaaagagcctggactttggagacatgccgagtggggtgacagctttctcacccgctggctctgtgaccacagcccagccatgtcctgggtgcttcagctgccaaatgcaaatatctgccgtgcagagtcacgttgcatattgagtgagctattttaagcatagagtatggcatgtagtaggttctcagtatagggtaatcattattgttattattcctgtaatattttcaaaatgtttcttttagaatattttgattgatgcctgtgttttagactccgactcagggctcctccaacaggtatgttttaaaaccatgctttgtgtcggtggttatgacaattagtgatttttatattgattacaatttaaaatgaaagctttgggtatattgggttaaataaaatatgttattcagcctaattttatctatgtctttcccccttacgtatggagctactggaaaattttaaattacatattgcttgcgttatatttccgttgggcagcactaaaagacaaaaactgaattttactttaacccgaaagggaaacaaaaccctaaagtaagtctgaagaaattactgagtttttgttagatgttttttggccacaaatgttgtttcctaaaggatcagttacaagcacaaaactatgacaaaccctgaatttaggttactgctggggatgaaggatggggagagcgaggtccaatgggaaaatttacatgcttcaaaggctctgagattgtactgtttcttcagcttgatcgtaggtatatgatgttcattttattatttaaaccatacttacacattatgtatacagactcttgtacatattatatttcagtagtaaaaattcaaaaagtttgaattcattttttagcaacacatttcagtctacacattgtctattaactccaagacgatcttgtctctgccatgaattcacataccagctctacctcctcagccctcacattcatttttctagtccagtcccagactctcctgagttccagacttgcagaatcagccgtgtacgtagtacctcctcttggacgtctggcaggcatcttcagtgtcatgtgtcaaaagcagagagctcttggtttgtcctctcagcctcttcctgctccactggtagccccatctccctaagtggcagtgcagttcactcagcaactcaagcaaaaacctgactcttccttgtctcttctcttccctcctttcataaccatgagcaaatcctgttgattctgcctttaaaatatatcctggctgagctcagtggctcatgcctataatctcagcacttgggaggctcaggcgggtggatggcttgagctcagaagtttaagaccagcctgggcaacatggcgagacaccatctctataaacaatacaaaaaaattagcctatcatggtggtgcacgcctgtagtctcagctgttcgggaggtggaggcaggaggattgcttgagccaggagttcgaagctgcagtcagctacgatcatgccactgcactccagggaaaccctgtctccctcttaagaaaaaaaaatgtgaaagttggttctcagaacagctgtcagaatgaagctttcaaaatacaagattggtgcaaaagtaattgtggtttttgccttttttttttttaacagtaaacactgcagttacttttgcaccaacctaatataaattagaacctgttgctcacttgcttaaaaccctcccatagcctagcatcatacgttgactaaaacccagagtcagggcctgccagggccttccagatgctgcttgctgaggctcctgggaaccttttgccccgcatcttccacactctccctcttcagtccggccccaccgcccccttgctattgcctgaaacaggcctgcttcggccagaggggcgctgcactttctgttctctctgctcgcaagctcttcccgcaggtgtttgcatggcctactccctgcctgccttcacgtctctacttctgtgccacctcctcagagaagccttccctgaccaccattgttagtgttactccctctccccttagcctactttatttttcttcatagaaatgatcataacctataacattatttttgcatttacttacctgatttactctctgccttctccactagaaccttaacttcatgaggatggacactgtgatgtttactgctgtaaccctgcacagtgctctaaaacagttgttaaatgtgtaaatgaatctaacggaccaactgaaccaggactgtactatcagaggagcctcagggtcctaggatcggagctagggttttcagtgtaaatggaagcactgctgtgttaaagcgagaaagctgtgtttatgaaatgaatagatgaatgattgttgggaaaaactattaacatggacaggaaaccttagtgtcagcaaccaggagagcttgagtgttttgtgtctttggaaaactctgaagatagcaaaagtttggaaaaagaggaccaaattcaaaagagttttatttttattttattttattttatttttagacagagtcttgctcttgcccaggctggaatgcagtggcatgatcatggctcactgcagccttatcctccccagctcaaatgatcttcccactcagtctcccaagtatctgggaccactggcatgcactacaatgcctggctaattttttaattttttgagacagtttcactcttgttgcccaggctggagtgcaatggtacgatctcggtgcactgaaaccccaactcctgggttcaagcgattctcctgcctcagcctcccaagcggctgggattacaggtgcccgccactacgcccagctaatttttgtatttttagtagagacagggttttatactctattggttaggctggtatcgaactcctgacctcaagtgatccgcgattacaggcgtgagccaccgcgcccggcctaattttttaaatttattgtagagacagggtttcactatgttgctcaggctggtcttgaattcctgggctcaaacagtcctgaagccttggcctcccaaagtgctgggattacaggcatgagccactgcacctggacaaaaaagtgttatttcttaaagagaacagaataaagccatctcacagtttctttttacataataaaattaacaaaatacaatgaaaacaaatctcataaaaattaaaaatttttgtgcttccaagggcactatcaagaaagtaaaaagacaactgggagagatatttgcaaatgatgtatctgataaagggactagtattctgattatataaagaactcttaaaattcaaaaataagacaaataactcatttcaaagtgggccaaggattgaacagctatttctccaaagatctgcaaatggccaagaagcacatgaaaagatgcttaatatcattaccgaccagggaagtgcaaatcaaaaccacaatgagctattacttcactccactaggacacatgtaatcaaaaagtcagctaataataaatattggtgaggatatagagaaattggatccctcctacattgctgctggaaatgtaaaatggtatagccacttcaggaaacagttcagaacttcctcgaaaagttaagcatagaattaccatgtgactggggaaaccccgtctctactaaaaatacaaaaattagccaggcatggtggcgcatgcctgtaatcccagttactggggaagctgaggcaggagaatcacttgaacccaggaggcagaggttggagtaagccgagattgtgccactgcactccagcctgggcgacagagcaagactctgtcaaaatataaaaataaaaataaaataataataatctgcagtgtcatatcctcctctgattttgtaggcccaaggcattgctcatgagaacctcattcctctggaaaccctaggtaagtgcgagtttggcagcaagccgcctgtgtcttgcaggcttgtgacatcacgggaggactgtacctgaaggtgcctcagatgccttctcttctgcagtatttgctggtaaggagacagcagcggcgaccctgatgcctggagggaaggatgacctctgtgtcctgggaaaggaatggaagcaagatggctggtgctagtactcaggagaagggaataaatggaggccttggagttccaaggcctagaagggtgggcttcatgttatttttttcccatgttttaaataaaagtttcttttgtttgtttgttttacagtgggtgtttcttcccgatcaagatcagagatctcagttaatcctcccacccccagttcatgttgactacagggctgcttgcttctgtcatcgaaatctcattgaaattggttatgtctgttctgtgtgtttgtcaagtaagttaatgtacctagtttttcttttttttctatgttggggggcaggaaaacagtttctcagctgtgttgtttttcagccaccctattgtttctttttttttttaatttacagtattctgcaatttcagccccatttgtactacgtgcgagtaagtatctttgagattgtgtgggtggctaatacttcacagctctagaacattaaaaaatgttttcctctctgtaatttcaggacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatcaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaacgtggtgaaaacatggtgaaaccctgtctctactaaaaatacaaaaattagctgggcgtggtggcaggtgcctgtaatcccagctactcaggagactgaggcaggagaattgcttgaacccaggaggtggaggttgcagtgagccaagatcaagattgcgccattgcactccagcctgggcgacaagaacaaaactctgtctcaaaaaaaaaaaaaaaaaaaagtctgtactgataaaacccattgtgtacaaaactttgtatgtaaggaagattttaattttctcttta

SEQ ID NO: 15060 - DNA, 18458 bp, Human
tcaaatcttccatcacgctaggaaaacagcatgcaatccaacccacctagccaatttgcctttgccttcttccatcagaggggtggccttccaaataggatgttgaccattcacctaggaatgactgtctacaaactaagtagctcttggttggtcagtaaagagctgcgtatagggcagtgtccaagtgaccacagaatccagcagctcctcactcagttccagactcagtctgtggggaacagaggctccctgctcatgagtgtctcctctttgccttcctcaggcaccaggatcccgtatcaaccatttccattttgtaatagaactcttcggggactgccctccccgttagagcttttccaagatctctgaagacatcatgagtttttcaggtttcaagattattttatgtccttcagtcacagggggagcttcagctagtgttccatcgtaagctagtaagtgcctctcaaatggaaactttatagtctaaaggcccagttccctggaggtgctcacagccttttgccattagccctaggcagtgctccacacagggcacagagaatgtgtgttacctgcagtctggtttctagtctacactgtgtagtccaccctccagggccaaggggcctggagtgctctaaagactttcctgcaggccctcgtggctctgtgttaatgctgtcagtcttcctgaagtcctgtcctctcacctcctgcctagatctgcccccagcacacattcctgactccacacatttctcagtgcctgcgacctggcacacatttctgatccgaactcagtgcctggggcctggcaggtgcccagggcactccattgctcaaatccaagcctgtggagaggatgacatatcattcccaggtttctgatgagcagaaaaaaaaatctttgtttctatagtgctatcctcttttatccaccatgtgagaggtcaggagccgactcaccccaagggtctaggagttgtgccattgaccttactgcctagggtcacaggctggcacccttcagtaccacacattggatctctccacacagcagcagtgtgcttaactcaatggggaggtgagtagcccaaggtcagatagttggacctggatagacacttgactgggggacaggctttggaagccactcccctgggcctcctctgtccatggggcctcaatactagagcccacaaggtcggccagagagtgtctgtgcctcgaccatgcaaagggtgccaggttgtggctagggatgcccccggggttcctctccctcctacctactcctcagcctctgcatgtgcccgtcatggcccctgtgtccttcattctgtccactcatgtgttcactgggcccctccttggtgccaggcacccgctactgagggataccaagcccctgccagagaagcttggagctgggtcacagcagcaaggaggctggagacatcagtggcatcagtgcactggtcagtgaggccgctgtgggaggagggagtgggagcagaagctaagagtggactgaagtccttaggccaggaggtagttcagggtttaagaagaggagagacaggcgtcccggggagggagcaggctcaggatgggcctccagtgcctcctctggagctcactacccagactacagcagcgcagtgggcagcgcctcagctccttccccttctgctgcctacagcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacagagcggttgcctctctcattaattaattaattagttaataaaattaaccccatgtttacattcttaaacgtgttccttggagatcggtttaaccaacagccagtgaaaaaacttttcagcgctgtctttagcaactttcacctcctctgtcctgaaagtggcaggaagccggaatgtggcaggaagcggttaaccaaggtgctgccttggttaatgtcttccactaccacccgtgtgtcccctctgtatcccataggcaggaccggggctggccccttccttcagcataaacggtgtaaagttgttgtgagttggctttggaaactgagattggtagtagtgtgagtgcaaggacatattatgtataaaatatgcagacttctaggtctctttcagattgattgaggtttttgctaacagccctttttaagattctttatgtaatacaaaaaaaagaaaaaagaaaaagaaaaggccaaagcaaggttacagaaaccatgagagtttgcatgttgtctttctacaaattaatgctaaattcagaaaagcagtaacattttcacctctcaaaaattacacaactgacttttaaaatagtttatagtgggtggacttacctgaggcagctagaagaatggctgtgtcaggacagtggccctgaagagagaatgcatggatgaccagtgtagacaaggccagcaacatcagtttcacggttttgggaatgtgaactctatgcgtcccaaaggaggctttaatccctccatcagtcttgccttattaaatgcatttaaatgtacaatcactttgttaaattttggagctaacacaaatcacattagatgttttatggcagtacattcagattgatcttcttttaaacaagggtattgtattttactgcatgggtaagccacattttaattcactgttgccgcctaggggcagctggttagatcccatcctgacggcctttgctaattccaacagcattgtactaaatacccttgtatgtatcgtgtgtccacatatccatgcacaccagcttattgggcaactccttacaagttgaattctacttctccttctgtgggataaatgacttcagaagtttctttaaatgttcacgaattttcctccaaaaaaccactgaacccagcttacagtcacacctagtccacaaatgtgcctgtgtccctacacctttgctacacttagctttcattctttactagtctaagatgtaaaacataacacatcacattgctatgtatttttgtttcctcatggtattaggaattttcaaggatataggagttttttggtactgggagtagaccagggtatccagatgagacagcagggaagactgaattctgagctgtgcacttggaaaaccctggtcagttggggccagtccctgccacccaccatgcctgtgaatggagataaggtctccatcctcagcctgtcagggtgacttcagatgagcctggagctgagttcagttcctgaccccaggtcctggctctgtcaatgctgggctggtccaatctgtgcgccaggtccttccacaccattcctctctctatcaaagtaggaattgagaagttccaacggctcagaatctcggactctcaggctgtcaaggactcctgagattgaaggttgtgaatggctgggccctgccgtgctccccctctggctctgtgactctggtgtggccccagctcctgcctgtaaagtgaagaggaggtaaaaatcttcagcagccctgtgtaaacctcagagggctgtgttaccaggtgtgggaggacaaatcacatcctcagggctggtgtcactcactctggactggatccccaggcacctgtcctccatccagcagaggctgcccctgttcctacctgcaccctggtacttgctccctgagcttggggcagaagcttctgaagactagggtggagcaccacggggaggggccatggaggaacagaggagccagacgtcaagtgaggacagcgatggcactgcagggccacagcctggtttacctgccatgcttccagttgtccttctggtaggcgcctggcccgggttgtagtttgaagagtgagcaggaaatgtctccatccaggtggctgcagatggctactcacccaggctgtactgagaggccacagtcccagttctggtcctctgtcgtgtatccaggagtggcagggcagtgaggctctagcttctaggtcagggatggggacagtggggacagtgccatgccccgagcctctgccgttgggcagctggtatcctgcttccagccagagaatgcacatcttcatgtagtggatttcctaacaacccggggagatgaaggtaggttgtttttcctgttttacaagtggtaaaatgagattcagggctagagttctctgagcagctgcttctctgatctctgtcctgcccttggcctctgggagctcttatggttcctcagcagagttcacagggctcttggagcctgtccttcggccttgagctgaggccacaactgcgcgcacttcataggcttgaggggaaagtgattcatccaggaagtaaacagtgagccctttactctgagaacacctgtgcctggagtccgccggagtttgggaggacaaatgaaccccatgtgaatcctgttccctggagcccgcagtgtggtgggagaggtgacaccagggattatataactaataggaggtagcatgaaggaggcctgagatctcactacccttgcctccccctcctccagagaggctgtgctggagagaggccatgctgttgcagggccataggatgtggtactgttggcctggaagatgtggtttgattacagtcaccattgagggtcagggaggggagcgaagctctcctttagatgcccccccacccgatttttttttttttttttttagctgggcctgagaatttgattcacctaagagaggtccacaggagacaagcacacacatttatttaattcaagttttacctggcatggaagaacctgtgagagtcagttacttatttactgaattagaccaagtaactcatgaagaagcaagtaactatgtgaggagctaaaaagatgagagtggatccattctaacatggtctgcacagtaccctcttggcctcgacttctcatccttaaaaataaggaaattgtcagctgggtgcggtggctcacgcctgtaatcccagcactttgggaggtcaaggcaggtggatcacgaggtcaggagatcgagaccatcctggctaacacagtgaaaccccgtctctactgaaaatacaaaacaattagcggagtgtggtggcgggtgcctgtagtcccagctactggagaggctgaggcaggagaatggtgagaacctgggaagcagagctttcagaaaaaaaaaaaaaggagattgtcctatgtttccctggggactttcatctcctgcttttaggaaacacaaaagaggtcaaaggatcttcttgcacctgttgtttttcaatagcctttaattcataatagtcaattgaccagggtgggcagggtgcgatggctcacacctgtagtcctgccaagacaggcagatcacttgagcccaggagttcaagaccagccagggcaacatagcaaaacccggtcacaacaacaacaacaaaaaaccaaacaaacagaaaaacagaaaaacacagaaaattatgtcgtgtgaaggaatccacacagaatgcttaccatctgattccatttctcattaaaattcgaccaatctattctgacaaaaagcagaattattgctggggacataggagcaaagcggaagagaggattacattgaagaatgaagaaattctggggtgtggtggacatgtcattttcttatcgtggtggtagttccacaatgtatacacacgtctcaatctaccaaactacatgcttcaaaaatgtacactttgtttcatgcccattatacctcaatgaatccatttttaaaaaaccttcaatagaatgtaaacacttgagtgtatactgtattccctatagcacttgcacatagatcatggaaataggtatgcataaaaagtcagtttatccaattaaaatggaattctaaaaggtaattaacattaaaatgtgcagggggaaaaggagtaaaaaaattagactagacaatcatagcttaaatggtaaacttacaggtctatttcaactatatcaattattgcactccctgtaaatccactgagcactacagttcaatggtagaaatgtttggaagggctgagaaagcaagactcaactatatcttgtctatatgagatgggccttaaaaggaagacacagatgttgtctgttgaaagtaaatagatggaaaaagatacaccatgcagagtgtaaggccaagaaaactgccatggctatctcagtatcagatgaagttgattttgttagcggtggatgagatccgagttaccctacgttgaaggcggcgaatccgtatgcgtccacagcaccttcagctcttcgcctcctgagaagaaagaactggtttgaggggcataaggcagaagcagagatggaggcaagtttcagagcaggagtgaaagtttattaaaaagctttagaacaggaaggaaaggaaggaacaggaaggaaaggaaggaacagaaagaaaagaaggaaagtacacttggaagatggccaagcaggtgacttgagaaacagtacgcagccggaccgcctgagttggggttttataggttggcctacttccaggatcttgccttacttctccccactcctgaaatcttattgggaagctgctgatcagtttcaagtgttttctatgtattaggaaactgcttttttctggcatcggctgtaaccagttattactttagagacacagttatcaactacctgatggtcgcccaacactgctggtgtcagaagcggggacccctctcctgtcctgctcatacctaactagctgcctactgtgacaattttaggacattgaatattatgggagatgaaaagggacctttgtagttaaaagggttaattcttcaaggagtataataacaacaaattgtatatgcctagtaatacatcttcaaaacacatgacacaaaaatagaattaaaaagagattaactcagctgtttctctgcacttgctagcatgattagatgaaaatgccagtaaagtggcaagcgatctgcacactatcaaccaccttgatttaactgacatttaaagagcaggagtggaacattcactgaacactcattcctttctatgctcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaactgggggttagggagatggggagttactgctgaagggtatgtagttcctttctggagtgataaaaatattctaaaattgattatagtgatgattgcatagctatgagtatattaaaaactgctgaagtgtagactttaaatgggtgaattatatgaataatcataattattaattatgtgaattgtgtctcactaaagctgtcaaaaaaagaaaaaacgtgaaaattatgggccgggcacggtggctcacatctgtaattccagcactttgggaggccgaggagggtggatcacgaggtcagaaaatcgagaccatcctggctaacacggtgaaaccctgtctctactaaaaatacaaaaaattagccaggcgtggtggcgggcacctgtagtcccagttacttgggaggctgaggcaggagaatagcatgaacctgggaggtggagcttgcagtgagccgagattgtgccactgcactccggcctgggagacagcgagactccatctcaaaaaaaaaaagaaaaagaaaaagaaaattatggcctgaggagctacattaatcaatcataaaatataagtgtaaatttaaaccaaacaaagtaacaggaaggagcataaatcaaagaatacaaaccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcgttgtggcacacacctgtctttggggactgaggtggcaggaccacttgagcctgggaggcagaggaggcaaaggttgtagtgaaccgagattacaccactgcactctgcgctccaacatggaggacagagggagacactgtctccaaaaaaaaaaaaaaaaaaaaaaaaggccaaaatgaaaagttggtcttctgaaaggattttaaaaaacactaataaacccctcattaaatgagagggagtaagagtgtgagagcagagaaaggagacgcagacatcgcctgaacctagagggactccaacccgggaaagaatgatttgggaaaagtgggttagcttcactgtcaccaactgctagtcaggctttgatgtggaagaaagctacattttgtcttgtttagatccaggcagttgaactgagcccaacataagcagctttcattgtaaccattttggttttgcttaaattaatttcctactttaaaacactcccaacttaaagaaaagttacaaaaactatacaataaaaacatttgaaaaaatggctgttggcatgatgaaagctattattgaattctttagtgtgtactttctacaaacaaggaaattaacatcaacacattaccactatctatccgcactctattccgatttctccagttgtcttctagttgtcatttataacatagagatcatggccagaatccctgaattgctgtttcatcttttttgtcactctttgatatttagtgggagcagcttgacaaggtcctttgtaaagcagtaattaattacttaatgtttgatgctatatcctgactttctgtaaggttatatatattataaccttcatttgtaaagctgagtatgtttaagtgtgtgtctgtgtgtatttgtgtgtgtgtgagtgagagacagaattcacctattggtcaattaaacacttggtgaaactaaatatattaaatgctatttctgcatgaagggctcatatgtgtgtggttttttaaaattcttataaaatcttttctttccaaccatggtggcatgtgcctcttatccacatttcttgggagactgaagcaggaggatcacttcaggccaggagttcaagcctatagtaagatatgatcacacctgtgaatagccactgcattccagcctgggcaacatagcaagactctgtatcaaaaaaacaaaatagctcttcttgctcccattatctggggtaaatttatgttataatatgagaaaaggatacataagtgtttttctttttcttttcattttttcttttttttttttatttgagatggagtctcgcactgtcaccacattggagtgcaatggcgcgatcttggctcactgcaacctctgcctctcaggttcaagctattctcctgcctcagcctcctgagtagctgggattacaggtgtgtgccaccacacccagctaatttttgtatttttagtagagacagggtttcaccgtgttggccaggatggtctcgatctcttgaccttgtgatccacctgcctcagacttccacattgctgggattacaagcttgagccatcgcgcttgcctgtattttttttttttttatagaaaatagctggccctaacaggccaagggacaaacacaggtacgaaagaatgaaagtttggagctggaaaaaatgtccaagctctgatgggttttgtcacttggggtgaagggaatgtgagatggagcctgggaggggtgaggtctggaagtcactcacacccatcactcctttgtccccacaggtcctagcttactctgccaccactgcccggcaggaggaagttccccagcagacagtggccccacagcaacagaggcacagcttcaagggggaggagtgtccagcaggtgcactcttatttttaaaaatcagtttatttttaattgacagataaacattgtatgtatttatgatgtacaccatgatgttttgaaatatgtacgcattgtggaatggctaaatcaagctaattcacatacttaatcatgtattcgtggtaagaacacttaaaaatctgctcagcaattttcagctgtatggatacagagccctgggataagccctctttgccctttttatctgtgggttctgtagccttccttatctatgggttctgtatccatggttgcaacaaaccacagatcaaaaatatgcggaagaaataaaaatgataatacatcaataaaagcagataaaaagcaatgcagtatagcacttatttacatagcatgtctattgcattaggtattacaagtaatctagagatgatttaaagcatatgtgcgtgggttttatgcaatactatcccaatttatatcagggacttgagtatatgcagagtttgttccatggaatatattccctgtggatagaaggcaggactgtacaacacattgttttaataactgtagtcgccatgtcacacaatacatctcttgaatttattctccctgtctaactgaaattttgtatcctttgactaacatctccccatcccaccatccaactcaagccctggtaatcaccattctgctctccacctctatgagaccaactttttctgattccacatatgtgagatcatgaggtgtttgcctttctgtgcctggcttatttcacttagcatagtatcctccagcttcatccatgctgacacaaatgacagaactcccttctttttaaaggctgaatagtattccattgtatctatgtgtcacattttctttaacttttcatccatccatggacacgtaggttgattccatgtcttgaccattgtaaataatgctccaatgcatatgggagggaagatatctcttcaatatactgacgtcatttcctttggatgtatacccaatagtgggattgctagatcatatagttgttctattttttgttttttgaggaacctccatactgttttccataatggctgtactaatttccattcccaccaacagtgtaccagcattcctttttctccccatcatcatcaacacttgttaccttttgtctttttggtaatagccattcttacaggtgtgaagtgatatttggcacttgatggttagtgatgctgagcatttttttcatatactttttggccacttctatgtctccttttgagaagtgtctattcaggtcccacgcccatgtatccattttacttggattatttgattgtgtgctattgagatgtttgagttcctgtgtattttggattttaaccaaaatcttggatcttttgaatattgaccctcattctgtaggttgtctcttcactctgttcattgtttcctttgtcatgcagaacctttttagtgtaatgtaacctcatttgtctgtttttccttttgttgcctgtgcttttggggtcatagtcaagaaaccattgcccagaccaacatcatgaaaattttcccctatgtattcttgtggtagttttaccatttcagatcttatgttttaatctttagtccattttgaattaatttttacatatgatgtgagataaaggtcttatttcattcttctgcatgtcaatacctacttttctcaacaccatttattgaagagctgtcctttccccattttgtgttcttggtatctttctcacaatcaatcaactgtaaatgcattgatttatacctgggttcactattttgttccatcagtttatttaccattgttgtgccattaccattcagttttgattactatacttttgtaacacgttttaaaatcaggtagtacgatgcctccatctttgttcttttgtttgttttgcttaagatcactttggctatttgaggtcttttgtagttccatacaaatctgggcgtggtggtgcgtcgcctataatcccagctactcgggaggctgaggcagaaaaatcgcttgaaccagggagttggaggttgcagtgagccgagattgtgccactgcactccagccaggtgacagagcaagactctgtctcaaaaaaaaaaaaaaagacacatgaatatacataacagtcaggatgtcctgatgggaaccatgaagaatagttaagtgacaggagatagacaaggttggtggggcctctcggggatggtgatttgggctgatatttaaagttggacagggccagtcttgcagagagccaggaagagtgctcttgagaaggccctgaaggaatgagaaccccaggtttcgggggcttggggagactgagcgaagacagggggccactgtggtgagtggacagcaaacaggtcaggtggaccagcatgggcagatcacatgtacagtaggttggatgttattttgtgagtgacggcgtaaaaaaagtaaaatatctcaatgatgtgtattgattacatgttgaaatgtagtatttcagatattttaggttaaaactatattgttaaaattaatttggcctcattctttttactattttaatatggctctcatagaatttgaattttgcatagaatttgaattttgtattatatttctgtcagcagtgccagtcaaaggtatgtaatagatgctgaatggatgacaagaccaagcctggaagagtggatttctctgtctcaattccagtgagggccaaaaaagaagtttccccaccactgtcagcctctgggaattctgtggtgactcattcattggcttttctcttccttcccaggatctcatagatcagaacatactggagcctgtaacccgtgcacagagggtgtggattacaccaacgcttccaacaatgaaccttcttgcttcccatgtacagtttgtaaatcaggtacagaatgtgtggacctcttgtccagaggtggagcgtggggcaatgaggtgggagttgtagccgatatgagtcagggaaccaagttccagcccaacctggtcttcatcaccctgttctatgattatatatttgactgattaaaaaaatagaaagaaatcttttctataatgcatgccacctggctgggaaatcgtctaaactgtcagctgcaagagggtggggggatcattagagcatagagaaggcctggcccagtggacagggctaggtttcagtagtggcacgggtctgctccagggccaggctctctcccccaggctctgtgctcctggcaggtgctcggcctcactcagccttcaggttctcaggccccttcctcctccccagcaggcccaggctttggggaagtcccccaaggcctccgtctccttgcagagtctctcaggtgatgcccttgcacctcccttgctactgaccatgccatctaaacaatgcttttcccctaatctgatgtaataaataatgaattatgctcctttttatgactcctctgagtgctggtgacagctgaagggtgggtgtcctgtatgagccctgagtgtgctggtgcagaaactggcccttagaactccttggtgaacttggttgagctgagtgggagggggtgggtggtaaggaagatcgagggatacatcagggaaacacattcccaaaaccttatgctctgttgtcagatcaaaaacataaaagttcctgcaccatgaccagagacacagtgtgtcagtgtaaagaaggcaccttccggaatgaaaactccccagagatgtgccggaagtgtagcaggtgagacagcagtcaggggctcctgacagctttcaggaacccgagaagacctgagtcacctggtacccctatttctccgctgaccctatggagcctccagacccatggggtgtccctgagcctgtggggtctcttgggtctgcagtggccgctcctggtccatctgcctgtccccacccctaccccctgcagcagccccttcccagaccctccccagcacgagtccccttggccagaccaacttgttcactgggcacaagaagcaactttctggatcccttgatccttttcagcaaacctaggaaatgcgatttccttttgaaatgagaagaaaacacttgaatccagtctgggttgtatttgttgctataccaagctgttttaaaaaatgttctttttaatattttttatgcaggcaggacccataaagacaaaagtggtcacggccgacaaaagtcataagaaggctgtgggtggagctccttcaagttcccatgaaggcctgagccaatccagccggcctcacccctggccccaatccctcaataagtcctgtcttttccctatttgggctttaagggccaagagtaatttgttcttctctggccccctaatgtttgccgtgatagggaggaaccagcagacagttgggggtgagagatcacttgtactgtgggttgactggaggaaggggctcagcttgtggccacaagggctcgtgaccttcccctggagtgtggctcctcctaacgcaggcctcctctgcagcccagggaagctcagtgtgtgcccggcacagaaggctcctgtggccccagagcagggaggctgaggggctgaaatgcgcatgctcagacccttccccagcctcaacgagggaacttgggggaccccctccagacaggagcctgtccttcccctgacaccttctcagggacattggagagggagggtggctccccttttatcccacctggctagctttccctcaggagtcctcacctccctctctgtgtgtacccaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggcagggggcagtcggctcctcaactgggtgacaagggtgaggatgagaagtggtcacgggatttattcagccttggtcagagcagaacacagagattttccgtgtgttggtttttactctagttccccttctcatcccccttcctcagggtgtcccctaattgcaaggccccattcctgtccccagccccagggctccttgtccagtgtcccagcccccagcccagccctgtgccccactgtcctctgggagggaggtgctgcatgggcccctccccacctgctaaggagactcgttctcttccaagtggtgaaagggcccctgagcgtgtagacagagtgacttggtttctccagaaactggaagcctcatgggctgaggaactgcctcccacccacagcagagccctggcggacacaatcccttttcctcatggctgccctgactctctgaagtggcttggggttctgggctgactgtgggggacacatggccatcttgagcatcacacagaccggcgggtcctgctgcagtcctgtccttcctgtagtcttcactccacagcctcactccacagtgagtgaccctcactggacaccctcactccacagcctgcaacctgaggatggggtgtccgcctgagcacagcatcgggggcctggccccagcagcgggtcctggatgtgctgagattgggctgcctgggttgacctcattgggaggaggtggggacggcaggtccagctgcgtactggggaccctgctgcaagccctggatgtggactcctgagtcagttctttgccttcctgtggtctttttccggcactcacatcgcccaccaaggcctgggtgggtgagaacagtgcccacaaggagaccctgagtaacagagactcacagcccatccaggtctctgggcaggaaattgaaggaatcatcacattttacagaggaggagactgcagctcagagtgggggaagtgtgtgcaccaggccacaggcaagtctgtccagagcactggtaggaatgagggaaactaggaatgaccactttaaaaagttagatgagaagaatttcaaggccgggcgcggtggctcacgcctgtaatcccagcactttgggaggcggagatgggcggatcacgaggtcagaagattgagaccatcctggctaacacggtgaaaccccgtctctactaaaaatacaaaaaattagccgggcgcggtggcggacgcctgtagtcccagctactcgggaggctgaggcaggagaatggcgtgaacccgggaggcggagcttgcagtgagccgcgatcgcgccactgcactccagcctgggggacagagcgagactccatctcaaacaacacacacacacacaaaacaaccaaaaaaagaaagaaagaaagaatttcaaagttaagtcattggagtttgttggtaatatatttgtatggcttaggtcatgttacgcgcatcaccccctcaccccatgtctgctgttgggtctcagcactgggtggagggaggggcaatagtcctggtgaagaggaggggggagcggcaccagctggagtggggcctctgccgctgcctcttcctgctgtggtttctccggcttagactgcccctctcacctggcttgtctgtggggagatctttgttctctggctgcttttaagactttctccttaacagtggtttcagcaattcgattgaggcaaaaaggagctgcagaagccatgtctgtagcatttgtggcctccccttctgtataatagcagccatgttttggcctctgcagggctaaggtcctctgagcagctgcttctccacatctctgccatgcactcggcctcggagctcctggtgttcctcagcagagtccacagggctctttggggtcccctccctgtgctgtagcctggaatctgtgacctgaggcggtgagctgaggccaccactgggctcacctcatgggcttggagggaaagtcactcccccaggaagtaggtgatgagccctttactctgagaatgtctgcgcctggtggtggtgggaggacaaatgagccctgtgtcagtcctgctc

SEQ ID NO: 15061 - DNA, 17612 bp, Human
aagagacagagtcttgctatgttacccagtctgcagtacagtggcatgatcatagctcactgcagccttctgagctcataggattttcctgcctcagccttccaagtagctgaggctacaggtgtgggccaccatgccctgactaattttttttttttttttttttgagacagagtctcactgtgttgcccaggctagagtgcggtggcacatcatggctcattgcagcctcaaccttctgggctcaagcgatcttcccaccccagcctcccaaatagccaggactacaggaacatgccaccacacccagtgaggtttcaccatgttgcccaggctggtctcaaactcctgagctcaagtgatccgcccacctcggcctcccaaagtgcttgggattacaggcatgcgccacctgactactttttatatatttttagagatgaggtcttactatgttgcccaggctggtctcgaactcctggcctcaagctatcctcctgcctcagcctcccaagtagcaggtggagttcaagaccaacctgggcaacatagtgagacccccatctctactacaaaaaattaaaaaattagcaaggtgtagtggtatacgcctgtagttgcagctacttgggaggctgaggtaggagaatcacttgaatccaggaggtcaaggctgcagtgagcaaagattgtgccactgcactctagcctgggcagctgactgtccctaacaaacttgtgacttaggcaagccacataatgcctttggggcctagttctgcagggacagaatttatcagatccctgactaccaagatgctatgattctaattcttatgtgagcagatggagggagacagggattctgagaatcctaggcagtatgtactttaaggaactttctctgtggctttgaaactggttatataattagctccaggagattgaggtcctgaataatattttttcataggtaagtattattttgctagaatatatccagcaaattagaaggatggggaaaggtagaggagttcctagcttgaatttatatatagataagtaaataaactgcagcagtctgtcaataaagggggtaattcttgcatctgtaaaattggctactttgcagagagccacatctacttgggcttcctgccctctcccatcccaaatgcaccaagttcattctccctttttttcccagtgttaactccattttagagctactctgtgggtgggcatggtggctcacacctataatcccagcactttgggaggcctaggtgggcggatcacctgaggtcaggagttcgaggccagcctggccgacatggcgaaaccccgtctctactaaaaatagaaaaattagccaggcatggtggtgggcgcctgtaatcccagctcctcgggaggatgaggcgggagaattgcttgaatccaggaggcggaggttgcagtgggctgagatggtaccactgcactccagcctgggtggtagagcaagactccctctcaaaaaaaaaaaaataaaagaactactctgtgaataactcatgacctcccacctgaactccacatgtggatggtcacagatatatctccaaggccatactgttgagatttatggctagacaagattttgctagtaaatcttcccttcaatcatatcagagggaaagcagaccttgagatacgaaaagtggaaagagaatttctgttccctggacttaaggaaaagagaagcaagctttgtgaggagaagacagtggacaatggctgtccatttaactgtaggacaggagttggtgaagtcatatgtattgcagatggtggtggtgatgtaggaaaatagggaatttattaatactccactcccaatatggccataagtaaggaggaaataattaggggagagataatgctgaagtttccctcccaagtttgtggtgtgtctttgctcaagttttcttcctctcgcattacccatccctatgttgatatgcaggtacttagaagttttgattcaatgatcagcaccaactgcacggaggagctggagaacgctggcgtggaggtgctgaagttctcccaggtacagtgccaagcccaggcatgcacgcggcccccagtcaatcacactttctgcttgtggcttcgcccagttagtttaaaaacacaaacactatgtctaccccggtccatatattccacctctagggtactccctattatttccttcctcctaagaagctgtattttagccaggtgcggtggctcacacttgtaatcccagcactttgggaggctgaggtgggcggaacacttgaagtcaggacttcgagaacagcctggccaacatggtgaaaccctctctctattaaaaatacaaaaatcagctgggcgtggtggtgtgcacctgtaatcccagctactctggaggttgaggcaggagaattgcttgaacccagaaggtggaggttgcagtgagccgagattgtgccactgcactccagcctgggcgacaagagcgagactccgtctcaaaaaaaaaaaaaaaaaaaaaaaagtctgggtgtggtggctcacacctgttatcccagcactttgggaggtcgaggcaggcggatcacctgaggttgggagtttgagaccagcctgaccaacatggagaaactccatctctaccaaaaatacaaaattagctgggcgtggtggcgcatgcctgtaattccagctactcggggcaggagcatcacttgaactcaggaggtggaggttgtggtgagctgagattgtgccattgcattccagcctgggcaacaagagcgagagtccatctcaaaaaaaaaaaaaaaaaaaaaaaaagctgtattttacattacagccttgaagtcaagggtaaaatattagaaatctggcagttgaatttagatgaactttgattttttttttttctttttgagacagtgtctcactttgtcacccaggctggagtgcattggtgcaatctcagctcactgcagcctcaacctcctgggctcaagcaatccttccacctctgcccccaccaagtagctgggactacaggcacatgccaccacgcctggctaatttttttgtattttttgtaaagatagggttgagccatgttggccaggctggtcttgaactcctgagctgagactatctgcccaccttggcctcccaaagtgtaaggattacaggtgtgacccaccacacccggcccctgattttttaaatttggattttaaaactttgatttttgtgctcaggtgtcttattacacatccttaatatttttagatttatatttattttttaggaaatattatggaatctaatttttatcttttttttttttgagatagaatttctctctgttgctcaggctggagtgcagtggtgccatctcggctcactgcaacctctgcctcctagattcaagggattctcctgcctcagcctcctgagtagctgggattacagtcacgcaccaccatgcctggctaatttttgtattttcagtagagacggggtttcaccattttggccaggctggtctccaactcctgacctcaagtgatccgctcacctcagcctcccagggtgctgggattacaggagtgagctactgtgcccagcctatctttcttgggttttttggtttgtttgttttgttttgtttttgagacagggtcttgctctgtcacccaggctggagtgcagtggcacagtcacagctcactgcaacctccacctcccaggttcaagtgattctcctgcctcagctgggaatataggcacctgccaacaagcccaactaatttttgtattttgttttagtacagatgggtttcaccatgttggcaggctggtcttgaactcctggtctcaagcgatctgcccacctcaccctcccaaagtgctgggattacaggcatgagccaccatgcctggcctctatctttcatttttaaaattatttttcttgacacaaggtcttgctgtgttgcccaggctgtagtgcagttccatgatcattgctcactgcagtctccaactcctgggctcaagcaatcctcccacctagcttctacaggtgcatgccaccatgcctggctaattaaaaaaaaaatttttgtagacatggagtctcactatgttgcccaggctgttctcaaactcatgagctcaagtgatcctctagcctcggcctcccaaagtgttgagattacaggtgtgagccaccatgtccagcctagaatctaattttaaatcataccctttgaattttgtagttagaaagaattacaaagtgctttattcctcaagcaatcacttgaatttcaggcagtattttcctagagaattagccttttaaaaatgatcttcccttcccccacacagcctcaccttttcagtatagaccacatcaaataaaattgtgaatgtaaaaatgctcggctggtggaggaggctaccatcataaccaccttaggaccttcagtaaactatttattttctccactctccaaacccaagtcttactttccttcattccaattaagaatatacagagatcccaggcacagtggctcacacctgtaatcccagcacttgcaaggccaaggcaggaggagaatcagttgaggccatgagttagagaccagcctgggcaacataacaagatgccatctctatgaaaaatttaaaaattagccaggatgaggtagcacgtgcctgttgtcctagctacccaggaggctgaagtgggaggagagcttgaggtccaggaggctgatcttgccactgcactccagcctgggcaacagaagcaagaccctgtctcttaaagaaaaataaataaataaataaataaataaatatattattttatttatatgtaaatgtatatttatataaatagatttatatatgtatattttatttatatatttatattttatatatgtatattttatttatatgtatatttatatataatatacatatataaatatacgtattatataatatatgtatataaatatacatatatatacatttatatatataataaataaaaatatacatatatttaatacatatatttaataaaaacattaaatacatatatttaataaaaatataatttatatataatatacatatatttatatataaatatatttatatataatatgcatatgtttattttacatatataaatatatttatatataaatatacgtatatttattttatatatatatgtgtgtgtgtatatatatatatatacacacacacacgtatatacccagggagaggcactaattgtgcagttttgaaaagtttcctagtgatgctgccgtggcctactttcaaagcactatgcttaggtttaccacttaaaatgttattacatttttccagaagtacactttaaaatactttgtttttaaagtgaggcattacaatggtgtcatgagctgacattcccagccactgactggaagatttgggtcaacccagggaacaggcttggtttaagggagttcaagtgttggtggcctttgggtaaaagtttatgtctatctttgtatgtgggattcagtagggattttctttaatgttaaaaattctagtttcctctgtatttgctttccttcttcccctgtcctccctgagcctccacacatgtgtaacacattttatttgccaataggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggtaagctggcttggtctgcccgaaacatttgtgaatctactgggagtcttatggttttattttccccccagacacccaaaacttgggtggattccattggattcttttctctttttcccatgtattcagtttgtgatcaaatttcattgcttcttcctttgaaattaaaaaaaaaagttttctcttctcttctttccttttcctttcttttctgtttttgtttttttctttttgtttttgagaaaggtcttgctctgtcacccaggctggagttcagtggtgtgatcatagctcaccgcagtcttaacctcctaggctcaagtgatccacccacctcagcttctggagtagatggaactatgtgtgtgccacaatgcccagctaatttttttatttttattttttttagagatgaggtttcaccatgttgcccaggctggtctcctcggctcaagcgattcgcccatctcagcctcccagagtgctgggactataggcatgtcccagcatgtcccagaaaaaggccgccacgtctggcctttttcttttttgttttctttccttttttttttttttttttttgagacagggtcttgctttgtcacccaggctagtgtacagtggcatgatcatagctcactgcagtcttgaattcctggggtcaactgatccttctgcctcagcttcccaagtagctggagctacaggaatgtgccaccacacctggctaatttttaagttttctgtagagatggagtcttactatgttgcccaggctgctcttgaactcctggcctcaagtgatccttccacctcggcctcccaaagtgctcggattataaacatgagcctccatgcccagccggcctgccacctctaacctagtttcctattggcctccctcttacagacttcgtttttgctatgtgaatgtctctttcaagtcctatgctgatcttttagcatctgtagtaggtaatccagattgctgggtgggtaactgtcttgtacattgtacacagggatgggaacagatgtgaagctgtctctcttggctctacccgtgctgtctgtatttgtggacagttggcattcttacttgttcttttaaatgttgaagtaaaatctagaatgggagcttggggtttggttcccagagtttgacccaaatttgaaccttagttcttacaacataacagttgcatggctttgagcaagcagcttaatttctctgcttcaagtggttcatattcacaatgggaatgaaaaaagttcttgcctcattgggttatacagaagagtaaatgaaaaagtgcatgcaaagtaatttataactgagaccctagcttacattatgaacacaatgaatgttcacctgctattgataatgatgatgatttttctgatatgctatactactctattagtaataataggatattttatgtttgaggtgcatatatttattttgttctgggtttttttgtttgtttgtttgtttgtttgtttgttttgagacagagtcttgccgtgttgcccaggctggagtacagtgttgtgatctagctcactgcaacctctgcctcctgggttctagcgattcgcctacctcagcctcccgagtagctgggattccaggcgtgtaccaccacgcccgtcgaatttttgtatttttttaatagagacaggatttcaccatgttggccaggctggtctcgaactcctgacctcaggtgatccacccaccgtggcctctcaaagtgctgggattacaggcgtaagccactgcgcccagcctgaggcgtatatatttgatagagctgcttgagcagtgtataccttttgacttatgttctaatactaagttcctgttgtaatgtggattccttttctgtttctgtaaaaggtcatttttctgcatgttaacttataaaatattcagggagatgttttgattgtttgtaatcttattcaatgacatttagtaaaattaattgcctattttcatattaacaaaactagtcagccaggcgccgtggctcacacctgtaatcccagctctttgggaggctgaggcgggtggatcacctgaggtcaggagttcgagaccagcctgggcaacgtggtgaaatgccgtctctactaataatacaaaaattagccgggcatggtgacgcatgcctgtaatcccagctacttgggaggctgaggcaggagaatcgcttgaacccaggaggctgaggttgcagtgagccgagatcacgccattgcactccagccctggcaacaaaagcaaaactccgtctcaaaaaaaaaaaaccaaaaaaaaacaccaaaagaaaacaacaacaacaaaaaactggtcattcagcttttcacctttcaagagatattttgccattgtacagatgtaagcactgataggtccagttttcaactaaatttgctaactttttttgggggggttggacagggtcttgctctgtcacctaggctggagtacagtggtgccatcatggctcactgcatccttgcagcatcaaactcctgggctcaagccatccttctaccttagtctcccaagtagtaggaactacaggcgtggtccaccacacctggctaatttttaaaaaaaatttttgtagacacaaggtctcgctgtattacccaggctaattttgaactgggctcaagcgatccttccacctcagcttcccaaagtgctgggattacaggcatgagccattgcacccagcctatatttgctaaatttttgaagaatgaggcaaaaaaaaaaggttcagtctcatttgacattaagatatatttatataatgcaaattgagtgattactatgtgctaggtcttgtcaacatgttactaatctaatttaatcttgccaacaaccggcaaggtataaggaagccaggagcacagagatactagataatttactgggctgtaaactctatggtgtagggagaatgtctgtcttaccatggtattctcagtgatgaagtcaaagtctcatttgtaatagaagcttaaatatttgttgataaacaggtggttatacaaggtctcataaccggtaagttgcagagctaggatttgaattttggtctgtctgtaccaaaggttgtactcttttttttttttttttttttttttttttgaggcagagtctctttctgttgcccaggctggagtcagtggtgccatctcagcttactgcaatctccgccccctgggttcaagtgattctcctgcctcagcttcccaagtagctgggacttgccaagtaggtgggcatgcaccaccatgcctggcgaatttttagtatttttagtagagacagggtttcaccatgttggccaggctggtctcaaactcctgacctcaggtgatccgcccgccttggcctcccgaagtgctaggatttacaggcctgaaccactgcgcctggccagttgtactcttaagctctgtggctacttacttcctacttctgccatatctctacttctcatatatacttaggatttgcaaagccacatgataagcataacatgtcttcttaaagcaaaaatttgactacatataggaaaatatttttggttaagggaaacatcaatatgtgtttttgttttgttttgcttttacttttcttctgggagtctgaaaaaaacatcagtatgttttagagtagagtgcaaaagttgcttggatttttaaagacaaaatggtaagcttcatagaaatgtgcttttggccaggcatggtggctcacacctgtaaccccagtgctttgggagacctaggcgtgaggatcacttgaggccagaagtttgaggtcagcctgggaaacagcaagacctattctataaaaaaatgttaaaaaggctaggcgtggtggttcacgcctgtaatcccaacactctgggaggccgaggcaggtggatcacgaggtcaggagatcaagaccatcctggctaacatggtgaaaccccgtctctactaaaaatacaaaaaaattagctgggtgtggcggcgggcacctgtagtcccagctactcgggaggctgaggcaggagaatggcgtgaacctgggaggcagagcttgcagagagcctagatcgcgccagcctgggcgacagagcgagactccatctcaataaataaataaataaataaataaataaataaataaataaataaatgtatgttaaaaaattatccaggtgtgatggcacatgcctctagttctagctactcgggaggctaagcaggaggattgcttaagcccaggaggtcaagattgcagtgagccatgatcacaccactgcactccagcctgggtaacagagcgagaccctgtctctaaaaaaaaactaaataaacatagatatgcttttggtgactgcttgagtcagtgttcctcaggagcagtgcttccatgggacaagttgaaaagctggactccagagggattccaagtggcacacctgatagttgagtgatcctcttcatgtctgcctggccagttgaattgtacattgcaatgtcaaatcctgttaaaacatctcaaaagtggataaaatactaccttttatgttaagcaagatatgaaacttgccaacttttttttttctaatttctaacagaggcagggtctcactgtgttgcccaagctgatctcaaactcctgggcttaagggatcctccctcttcggcttctcaaagttctgggattacaggtgtgggcccactgtacccagcttgaaacttgccagctgtaaatgcctttcgtgttgcagctgagtctcatggtttcttggagattctggctgcagttcccatgtgaaatgaggaagggagatccagaggtttgatctaccttttttagtaggtgggccaagtggttacatgatatctctttgtaattttaggggattcaaaccgatgacaagggtcatatcatcgtagacgaattccagaataccaacgtcaaaggcatctatgcagttggggatgtatgtggaaaagctcttcttactccaggtaaggtctcttcccttcttggtgagggagggtctgcgtgttacatgatccatctggctcttcactgtcaaatctgcagtctgcttaagcaaagttaaaaggatgagtgtctttatattgtcaaaatggtacaatgtgttgaaatagatattggttggatacctgacattatctgaataaaagacttaaaatgcttagcacagactgaagttttcatgtagacaatatgatcacccgttgcggaactctcttaggagcagacttgtgcttggtggcagtggaaggaagtggcatttggaagaagtaatttagattggcatttttttttttttttggagacactctgttacccaggctggagtgcagtggcatgatcacgggctcactgcagtttcaaccttcctgggctcaggtgatcctcccacctcagactcccaagtagctaggatcacaggtgcattttttgtagagacagggttttaccatgttgtcttgaacccctgtgcttaagcagactgcctgcctcagcctcccagaatgttaggattacaggcatgagccaccacacatggcctagattgtcattcttgtatgactggtcttgatacaaccaagactgatttccttctctccggcatcccacacctcagcccgcttcctaagcaccattgcaagctctgtcccatctctatccattaatgatcacttgatctactttcagtctgtacctagaacctcatcagcgattccagcgtgtcccagggccttatatcaggatgaaaacctacaccagtcacacacccaaacccttttagctcctttagaaagttcttgctcttggctaggtgtggtggctcccatcactttcagaggctgaagttgggggatcgcttgagtctagtagtttgagaccaggctgggcaacatagtgagatgttgtctgtattaaaaaaataaagattcagctgggcacggtggctcacgcctgtaatctcagcactttgtgaggccgaggtgggcagatcacgaggtccagagatcgagaccttcctgaccaacatggtgaaaccccatctctgctaaaaatacaaaaattagctgggcgtggtggcacacgcctgtagtcccagctacttgggaggctgaggcaggagaattgcttcaacccgggaggcagaggttgcagcgagctgagatggcgccactgctctccagcctggcaacaagagcgagactctgtctaaaaaaaaaaaataataatataataataatgataataataataaagattctaggcacagtggctcatgcctgtaatcccagcactttagggttataaaatagaactaaagatgctgaaaactaatatagcttgttccataaatattgtattaaaaagctaatatcttcattaagtagattaactgccaggtaagtgagaacttgtgaatgtgtcttttgggagtggggccagacaggttgagcatcccttatctgaaatgcttgggaccagaagtgttttcagtttcagattttggaatatttgcatatatataatgagatattttgcagatgcgacccaagtcgaaacacggaattcatttgttttacatacaccttatacacatagttggaaggtaactttatacgatattttaaatgtgtgcatgaggcatacttttgtctgcgtttttgactgcaacccttcacatgaggtcaggtgtggaattttctgcttgtggcatcatggtgctccaacattttggattttggattttgaatttctggattagggatgctcaacctgtaatagaatgtataggattctcataagccaatcattttgagttgttcgctgaggcatgacatatcttcgctgtattaaactatctagatagtgtaatgaacaatggtgtgaaactgtcagaactagggcattaaggtagatggataaatggctagtggaacaatttagctatgttcaaacagacagtaagataaacactgattttaaaatatctccatagttgcaatagctgctggccgaaaacttgcccatcgactttttgaatataaggaagattccaaattagattataacaacatcccaactgtggtcttcagccacccccctattgggacagtgggactcacggaaggtaggtatttaaaaactgaaggtcatttgtggtttccttcctctttcccctgcccccaactttaaattaggtctctgtcagctgatgaaacctatctcagccccagattacattgctttttggttactctcttgtcacagttccagttttctcccctgctactactttgagtgtacagtatctttccttcacaccaccctatctctttgatcttttttttttagcttttttatttgaactaattttaaatttaaagaaaagctctaaaaataatacaaaggactcctctctaaccttaatatttttgcttttttattttttcactctacacacacacatgtctatctttcctaagaactggcccttacataaaccgagtatcattttctttttttttttctttttgagacaagctctcccactgtcacccaggctggagtgcagtggcacgatctctgctcactgcaacctccgcctctgggttcaagcaattcttctgcctcagcctcccgaatagctgggactaccaggcctgcaccaccaccatgcctggctaattttttgtagagatggggtttcactgtgttgcccaggctggtctcaatctcctgggctcaagcgatccacctgcctctgcctctcaaagtgcagggattacaggcatgagccactgtgcctggcctttcttttcatctagaggcagaattcctcagcccttcttttgtcttatatgacactgacatttattttgtagaatacttctcattttggcgtggtttgatatttcctcgtggtttgattgaggttatgtatttctggtcatctccctctttgatagttcagtgtaattgtttagttttctgatagatgctttttttaatgtgcattgtagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtaaggaaaaatccagcaaactaaatagtgccttgcaaaatggacagggatggcagtattttgcaggggtggaaaggagggagaccaagcagttgagccttctgattcaactggacaggcccactttgatctgtcttacctgcattttggggttcttcataatatttcatctagaaggaggttccactccttttaaaaaataaagacgatgccaggcgtggtggctcacacctgtaatcccagcacgctgggaggccgaggcaggcatatcacctgaggtcaggagtttgagactagcctgaccaacgtggtgaaaccctgtctctactaaaaacacaaaaatgagccaggcatggtggtgcgtgcctgtaatcccagctactcgggaggctgaggcaggagaatcacttgaacctgggaggcggaggttgcagtgagccaagatcatgctactgcactccagcctgggagacaaagcgagactccatctcaaagcaaaaaaaaaaaaaaaaaaaaaacaaaacaggagaggccagggccaggcgctgtggctcacgcctataatcctaacactttgggaggccaaggtaggcggattgcctgagctcaggagtttgagagtagcttgggcagcatggtgaaaccccatctctactaaaaatacaaaaattggccgggcatggtggtgccatgaacattcctcagtagcctatgatttctggatattgaatcatgaaggctcctacttagttatttcttcatgccagttatcattcattcagttgataaacattatttgtcattcttctcaagactaagaactgctatatagagaggaataatatgaagagctggccatcaccagaggctctttataagttcaattaagatcacaatatcagtcagacaccgtggctcacccctgtaatcccagcactttgggaggctgaggtgggtggatcacttgagcccaggagttcaagaccagcctggccaacatggtgaaaccctctctctgctaaaaatacaaaattagccaggcgtggtggtgcgcgcctgtaatcccagctactcgggaggctgaggcaggagaatcacttgaacccgggaggtggaggttgcagcgagccgagatcatgccattgcactccagcctgggcaacaagagtgaaactccgtctcaaaaaaaaaaaaaaagaagaaagaaaagaaaatgtttctcttcttttcccaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagcgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaatatatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaatttgttactgtgagctttaattggtacacaggaaattggtttattttctaaggatatttcacattggagaatcagttgcctgtgcttacgggggtgaaaagagagttctcgtataaaaataaagatcgaaggtataaaagaaacatttagcagattaatgattgagttggaagaaaagcctagaaatcacttaggtctttaacactttatttctattaggttttaccagctagttaaatttttccaggattttcattagtcatccagtgttactgaatacttttttttttttttttttgagacagggtctagctttgtcgccaggctggggtgcagtggtgtgatctcaggtcactgcagcctcccggggtcaagcagttctcctgcctcagcctcctgagtagctgggatcacaggcacgcgccaccacacccagctaatttttgtatttttagtagagatggggtttcaccatgttggccaggatggtcttgatctgttgacctcgtgatctgcccgccttggcctcccaaagtgctgggattacaggcgtgagccactgcactggacccactgaattctttactgtgtgttctgttaagcttttactgactgtc

SEQ ID NO: 15062 - DNA, 6671 bp, Human
tactgatttgacagtaaggagagatgacataagaatggtattcataagaatggttttaattgagtagttttgttagaatgttggagacaaaggatcagataataaagagttgggagtgtgagtggtgaaaaagtcgagggaaaaggaaaaacaactttttttttttttttttttttttttgagacagagtcttgccctgtcgccaggctggagtatagtgacgtgatcttggctcactgcaacctccgcctgccaggttcaaacgattctcctgcctcagcctcctgagtagctgggactacaggtgcacaccactgcacccagctaatttttgtatttttagtagagacggggtttcaccatgtttggccaggatggtctcgatctcttgagcttgtgatctgcccgcctcagcctcccagaatgctgggattactggcatgagccaccgtgcccagccgggaaagacaacttttaaaagagtggtatagtttattctataggaaaattggaccagttagagaaaaaataaataaattaccaaaatgttacggtttaaaagttgtagcagagttaaagtaacttcattttggagtagaaaagatatgagtgtgtttttagacaattgaagggactaaataggaaggaaaacaaggatgtcgagagtcccaagagagtcaggaaagatagtattaagatcctagaaggatcaggatttggagacttgagtgaagaacgagagtgaggataatgagagttttgagacaaaaggaatttgagaagttttacctagggaagcctcagttttctaggtaaagtagagcataaaatcacacgctaagaaatgggcagcagtgaaaatgcctgactgaagttgatgtagcgtacatttgtattgatagtaccatttggtgattttctcatttctttcaacacatatgtgttaagcatttactgtgtactaagcactatacaagatccttgggattctatctgtaaacaaacaaaactccctgtccttttggaggttacatatgactggggtaaggggagaaaaacaaataatattttaaaataaacatatgaggtaaatagagctacctgggtctgggaaccaagaaagcaaatgggaagattagccagacataactgcaattttatattgcatatcatattctgatttaagatagaaataattttatttttatacagctcattgtagaatctagcttgcttaaactaagacaagaagagtatgggtgtggtggagcctttgtgtacttagattgtagctatgaaagaaatctatatttacatttaagagggaattcattaatttaggacaactttataattatgttatatagttatttcagggcctttgacaagagaaaagatggtgaactgtcatataataacaaattaaatatttatttggttaagaaaaagaaaatttgcatcttatttccaaaaagatgatttttaactacatagaaatttgttatatttaaaagctttaaagatctatatagagttgaagatctctttttaataatgaataagttcattcttttggtaatcatttttttatattctcctctcatggccctttttaatttcaacaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggtaagttgattttcggaggtaaatacaaatagagctctgggtattttaaaaaaaagagagagagaaatggagaggttaagtggcttccctaaagttaaccaggtaacaagctgggacgtaacataagcataaatgttccaaagctaaagtccgcattctttctagctatctattttgaataaaagagagctgtggcagtgttgctacacactgaattatttcgtcttgtctagttctgttgattttgcattcctgatatattttctgtttctgttgcattaaactaaatggagaaaatggaacactggcctcttcattgagagtagaataatactatagattaaactgggaaacatttaaaaaattgctatgagcaatgtgtaagaaggtagtcactgtagtccttatgacataggaaatccctgaatttaaaaaattgatattaagtttcttcataaattggttacttggaaattggaatgcacttttattataacctcaaaaaacctattttagcagtgtttgaaatgcatttgcaataaaagataaattatattgcaatactagtaaacaataaaactataaaaccataaaagttgaaaaataatatggtttcatggtctcttttagatactgcttaggatattagaatttgatgacactcattttccttaaaaatggcctttctttttccttgatgaaagatatcactacttttccatttattaaatcatggttaatcttggctttgcgtgagtatatttgtacaaaagggaatgtgtaattgcacaaaattttgaaagaaaatgtgtggaagtggggtgtggtggggagagagattaattgaacttcctgatgtgaagttcaggaaaatggggcctgtgcctaatccctcagaaaagcagttggttggcagtagggaagagtgatgacatccattttctgttagttgcctgatctggctcactgtttgaaactttgggagtaactgtagaaaaagaggctttgggggttgatatagactgtaacaacaacaacaaaactaattaaaaagaagatagcttgaatgcagaattgtatgtattttcttgtgggtaattgagtgtagatattagacaaaatgcaatatataccattatttttagcagtatactttttaaggttagaggtctcaagtaggcatattttgtttagccttcacagtgttttttaaacatttaaattcattgccgatatttaaatattaggatatttattataaaaattcagactttagaccatttaaaattggaagaactaccaacattgagacctggttcctgcaaggcaacaatcacagctgagaagtcaccacttgtttagattggtgatacactgtcatttcctctgcccatctacctttccactctgacacttatttacattattcttttggctcttgtaggcatttgagtttgtggcctctccttaaagtttagattaattctcatttgtgtattcttcatttttgggaattcagcatgttatctctaagacagctactgttagctacacattgaaaaggggttgggtgggtatcttagactttctcatgtgtttctctgactggagagaagatagctcttgttcttcaaatatttaactaaaggatttgctgtgggtgtctgctgttggagccgtgggtgttaagagacttttgattatgcaggtttgaatcctggctctgttgttaactagatggatgatattggccaagttattaatagcttctttgagactcagttttcacatgtgtaaaaagggtttgttttgaagagtaaaggagataatctatgtaaataatttaccatggtgcctaggacttagtaagtgcttagattttagcttttagtttaatataaaaatactgatagagggctttcaaaatgtttactatatgtatcttttttttctcttttagccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttccagtgcttctccctcatctggttattcaagaaaacaaaacagtctctgagatatttagcttttcaaactgtaaatagatgctctagtgttatttatttttttaatcccacttgtattattttacctctagagcatcttgtattaggacatgttatatttatgccagtgggaaataagttatggccaagttttgcaaaaacaggaagcagtgagatacttgtttttttctcctcactaaatatcagtaattgtcaggaatggtattacctattttcatttcctcttttcagctttgttttgttgattgggacactaaaactgatgtatacctgaggaaaaaatagaatgtgctcatggttagggaaaattatattatttttaattttttaatttgttttttaaccaagtaggaatttgggtgtatggataagaggccaatctgcttctgtaggctatagaagaaaaccagttgtattttatggtcataatttgtccccctattattctggagatttaaatttaagtaaagtagccatcagtattttaattgaaaaatactaaagccacataactgagtaggatgtcgtatgatactttcaacaaattccctaatgctgcctaagcatatggatgttttaattctttgctgttataaatagatatctaatacgccagaattactgatggtaaaattgaagttgtgtaacttgtgaattttttttatcaatgttttaaatattatttaaatcttaaaatcatttaaagacttatgttgccactgggtggcagccatggcttctcccactaagcaacagaagtgaccaaatataattaagacaaattttcatctctattacatctgcttttaaaacattttagttcatattctattatttttctaactcagtactcctttgttgagggtaattattagtagttaagtttttaatggaaataaaaatcatgtatgcttatctttgctgtaaaatcaaatgaatataaattgaggaaaactttaaattgttgtaggatgactagtagtaaacatcatcttaatttttaacatatatttgatgatgctttccttttctctgtatgtttctgggtttttccccagtcttccttatgaaaaaaatgtatgtttgtaaaaagagaacaattaatgctttgcatcacagacataaactattcatagtaaactgcactgagctgatattaatagagcagacttttgagaaagtaggagtgtagtagcactggaaacagaatgcaaatttctgttccataattaggtttattgtagctatagcgctcccagataacccatgtgtgctagtaatatctattgtgtgctcttactatggtataaaaacctcgctggaagctacttattttgtacttaaatattttaccaatttttaaaaagtcttaatccaatgcttataccagtgactgtttttataatacttgaagtaactttaagaactgaaacaaccctggaaaactc

SEQ ID NO: 15063 - DNA, 49313 bp, Human
tgtcgcccaggctggagtgtagtggctggatcatagctcactgcagcctcaaactcctgggctcaagccatcctccttcttcagcctccacctccagctaatttttaaaaatattttgtagagacaagggctcactttgtttcccaggctggtcttgaacttctggcttcaagtgatcctcccgcttcggccacccaaagtgctgggattacaggcgtgagctgtaatttagttgtttatttactcatttgttcaacaaatacttattgaatatttgctctttggccagtcaagggatttcatgagtgtctactatgtgaataacactgtgttggccactagtctgtcacctactggtggattagaaaaatagcgcgaggaccattttttcttttcttttctttttttttttgagacggagtcttgctctgttgccaggctggagtgcagtggcacaatctcggctcactgcaacctccgcctcccgggttcaagcgattcctctgccgcagcctccccagtagctgggattacaggcaagcgccaccatgcctggctaatttttttgtattttagtagagacggggtttcaccttgttggcaaggatagtctcgatctcctgacctcgtgatccacccgcctcggcctcccaaagtgctgggattacaggcataagccaccgcacccggccaactcttttcttaaattagccagggaggcgtgggtgggttgggtgaggagttgggtggggggatctcattcagtattcaaacttctacaagtttcggggttgaggtgggtgatggtaagggaacaggccctgccactacctttcatagtgacttccatttgtgtaatatttttggtccactgagagctattattttatttgattcttatgaccatcttgtgaaggagtatcaacagataccccgttttgattttatcagatgcatgatttgtcctacatcaaacttcataaatgatggacagaatggaggaatccttcagaccaagtgctgcctacttcccaccccaatggtggcctcagcctgggctcacatcacacgccccaaggagccttggaaaaaataaaggctcttggctccttcctgggacagcgtgattcctcatgtctgagcaggcccatgaacttgtatttttcagacgttccctaggacccgtgtccatctggattagggaaccactacattataccacttcgcgggaagactcagggggaagcattttagccactttcctgtgttccacagtactggagggtgttctgagtgggctgtgattaatttccaaaccaaccacacgtctcccctcaactcccactgcttactctttgcttcctagacattcactgcaggctggagacttctggaagccaacagcatcgctgtagaatttacagggtccagttcccggtggaccacaaaacctaaattatgtggctggggaaagctgaaatccaagggaagggtttgaggaggggctgaccttataataaaaccggcttgtatttactaagtgttaactatgcgctaggccctcgttgacgcctcaactctatgtgaaaagcactattatcccccatttacagatgggaaaacagagatttagagcgcgaaaatcatttccccaaggcgcacagactccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgcctcgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttacagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctggccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttgggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgagatcgtgccactgcactctagcttgggtgacagagcaacactctgtctcagaaagaataaaaagatttggccatgaattcgtcagctagttttccttacataatttttggacaaggagatctgacattcataggtttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggtaaggtgctggctgggggcagcctggactcctgggccttgggaacaggatgggctgggagggaggtgatatggttgcaggtgatgtggtcaacagggaaggctccttcccaagtggagcaaagaactcccttcctgtaggagaaactctcaagatacctgggttggttctggtctggttataaacataactgacttcatcagaggttggggtcatgaaggctggtgacatccatttacctgagatgacatgtttgtggggggtaatttatgcttttctctttctgaggaaagaatatctgatgaggaccctagtgtcacactttaacataggtgatgtataaaatgcagctggtggtgcaatggggagagaatgaccttagaatttgcgtgtagaacttgggtcagactacaggggatgttgtaggaggtgagagcttgctaaagacctctgacttccagaaaattgtttcaaggccacatcttcgccaggcatagtgggtcacacatgtaacctcagcactctgggaggctaaggcaagaggatcacttgaggccaggagttcaagatcagcctaggcaatatagcgagaccccatctctacaaaaaaaaaggaaattaactgggtgtgatggtgcacgctgctagtcccagctacttgctactcaggaggctgagacaggaagattgcatgatcctaagagttgaggctgcagtgaattatgattgcactactgcgctccagcctgggtgaaaaaaaggcacatcttctataagggtcagcagtcatggcttcacgcctgcattttcctatccttaactgtgtctcacaggttctgtttgggggcctgccaagcgatttgctttggataggtactgtttgaggggttttgaagtgattgagacccaggaagcataaaggggcatggagacctatggcgtgttggaaattcagagccatcatcggtaacaggaaggacttaccccaccattcttgggatctgtgtgagctgtggaaaggcctcttgggagattataggtacagaataccggtggctttcgcgggactttgaaaactaatgtatgagcatttctgctgccagaggatagtgtggttcgtgactcagtggctggtcacacagagaaggttgacacacagtgggtgaaaggttggaggtgcgcgtgatggggtggctgtgtgcaaaaggctgccactcagctggtcagggactcgtttgaatgatgagtgatgggtgagaatatgtgtcctctggatggagttggggatgaacagggaaagttgtgtgagactttatagaaggtgcagtggctagagcaggcatattcatgttgctgtcagtaacagaaccgaaggcaaggtctgagctggagcacggtggggacccaaagtgggagagactgtgtctgcccacagggagtttatggtcaggagggatgggcaagtacagggataagtaacacaagacagactgtgtttaaaccacccagtgaagttacaaccagaggtggtgggaatgcagaggaagaggggagcagagagcacctgagatgggcttgagttcagaaggggaaaaatgaagggccctccaggttgaacagcatgagtgttcagagacagcatgtatatggtttatggagaacggtttgcctggtgagtaggtagctctgggaaacaacacttggaaaaattggattgagttagcatatggaaggcttaatgccctgctaagaaaactatacttagggccgggcacggtggctcacgcctgtaatcccagcactttgggaggctgaggcgggtggatcacaaggtcaggagttcgagaccatcctgcctaacacggtgaaaccccatctctattaaaaatacaaaaaaattagccgggcgtagtggcaggcgcctgtagtcccagctactccagctccagtctccagctgaggcaggagaatggcgtgaacccgggaggcagagcatgcagtgagctgagatcgcgccactgcactccagcctgggcaacagagtgagactccgtctcaaaaaagaaaaagaaaactatacttaggccaggcgtggattatgctggtaatctcaacattttgggaagccgaggcaggaggattgcttgagccaagaagtttgagaccagcctgggcaacatgatgagaccctgtgtctacaaaaaatagaaaaattagccaggtgtggtggcacatgcttgtagtcccaactattagggaggctgaggtgggaggatcacttgaacctgggaggtagaggttgcagtgagccatgatcacaccgcttcacttcagcctgggtgacagagtgaaactctgtctaaaaaaaaaaaaaaaaaaaaagcaagaaaagaaaactagacttaaatgggtagatgctgggaaacttgaaaagtttttagcaagtagtgacactatcagctttcagaaagttaatttggcagctcagtgtggatggctgggaggaaagagtgaggtgcacctgtgtttgcatcctgctctgccacttgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgtcaactgtgggcaactggagactgagatgagagtgtaaagggagtgagtcagagtgggaggtttgaggggagtttagatttgaatccgccaattgtagacagcgataaaggagtggaagagtagcaaggagctagttgaggtttgagaatgtgaatttataatggagcctaaagtactttcttttttttgcagcccaagaagggagaagtggatctcgggcctggctgcttgtgagccagcccgacgggatgagtataaggaactttagggccagggtgggggtgctagtagaggagggggcttcacggaagctgctggggcagggtggaggctggaacctgggggctgaagatcttgatgaggacaaagtaccggccctgtgaacagaagaaagggagtaagagaggtggatggggctcttaggagccatgtacccaggaagactgacattaaatgaccattttttaaaaatcaacttaattttcaaaggcacattggctcccacctataatcccagtactgtgggaggcagaggcaggaggatcacttgagcccaggagtttaagatcagctgggtttgtttgtttgtttgttggttggttttaagagacagagtttcactctgttgcccaggctggaatgcagtggcatgatcttggcttactgcaacctctgcctcccaggttcaagcgattctcctgcctcagcctcctaagtagctggaattacaggtgctcaccactatgcctggctaatttttatatttttagtagagatgggtttcaccaggttggccttgaactcctgacctcaagtgatctgcccacctcggcttcccaaagtgctgggactataggtgtgagccaccacacctggccaaaccaacttaatttaggtataacagtttgggctattgtaataagactgctgtgaaccttcatgtgcaagcctgggtgggcacacattttccttggactgccctggttttgattttggctccacaccttactgactattggctcttggggaagttcctctttgtgcccttttataaaatatattgataatgaatgtgtgctcataaggtcattgtgaatatcaaataagcatgtctgcagagctcataggacattgcctggtccgtaggccatgagcagtcaatggccgttgtgggtccctttccctgggcctccaggggagacggcacatggcgaggagcatgttgtttcatgggacacagcaacggaaagcccctgcacttggagaacaagccccaggtctctgtttggtggagtaagcccccgtctcagtgtgagtgtggtgctttcacatagcctgtctctcatgagctttgtgacagaacagagaactgctgtgcccaggacattctaaggggagatctggcttcatgctttgtaagctgtaaggaaccttgtaagtgtaaagtatattgcatagtcttgggcctgctgattattaaataataatgctgatattttttaattaattaattaatttatttgagacggagtctcactctgtcgcgaggctggagtgcagtggcgtgatcttggctcactgcaacctccacctcctgggttcaagcgattcttctgcctcagcctcccaagtagctgggattacaggcgcgtgccaccacgcccagctagtttttttgtatatttagtagagacggggtttcaccatgttggccaggatggtctcggtctcctgacctcatgatctgcccacctcggcctcccaaagtgctgggattacaggtgttagccaccatgcctggccaatgctgctgttgtcctaaaaaaaaaatcatagggcgagcacagtggctcacacctgtaatcccagcactataggaggccgatgcaggaggattgcacgagcccgggagttccagaccagcctgggcaacatagcaagaccccatctctaaaaattttaaaaattagctgggtaacgtggcacacatcggcagtcctagctattcaggaggctgagatgggagaattgcttgagagttgcttgagcccaggagttgaggctacagtgagctataatcaagccactgcactccagcctgggtgtcagaaggagaccctgtctttaaaaaaaagaagaaacacattataatctatgtattaagggctttgtccaaaaggtgagagcaaaccacctaaaaccctgttcacactgagttttccccatttaaaaggccttgctgtgattttaagtgtgtgtgtgtgtgtgtgtgtgtgtgtgtgtgtgtgtgtgtgtgtctgtgtgtctgtgtgtctgtcgggagcccctccccactgagcgcagtaccaacgcccctcagtctgcaagtgctcctgagggattggggagggcctggagtttctggctgtccttggaaagttgatttaataagggttccaggaaaaccagcctccctcccctctccctctccttcccctcctttggtttgggatcttacagagcctcagcttgtttcagatcaggctttgagagtggtgagggagttgtttggaaagactgaagccggtttcagatgataagccccaacattctgagcttgcagagggtgcatttgtctgtcttttgcaataagtcaagtcttggtgggcaaagccagtgagtgagtacaacactgcttgcaaggccactgctggtagttggggtgggggtcctgcccccttttcagcagtactgtgggttaaacaccccagtgctcagaaaacctgcagctcagaagtgatttaatgggctgagttttacagctcctcccacccacccagatttgaaggagtctggtggcttgttagaggggggagaggttgcacttaatggaaaaaccacacatttccattctggcctcaagccccctggatgccctgtgtgcaccacaaagcggggctttgtctctgtgttttgcagaaacctgcacctatgggggagaggctgtgcgtggtgccagagccattgcctagcctcagatcatagggcccttgcaggtcctccatccctgggcgtctccagctgcctttggcccaaaggggtgtgcgtttcagcctggctgcagggagagtctcaaataggtactacaggtttggtagtgggacaccctctgttccactatcagacctgtagtctagcatctacactggactgtggtcctgtgtcccaaggctgccttgggacacaggcaagaccctcccctactcccaccccatctccagcatgatttcttatgatgaaaagaacttgtttgcttctcattcaacctggatggtaagaggagtttcttcatcccctgccagaaggcgaatggaattccatggagcaaaaggtgatgtcagatgaccctcttgagaacaagggtggaggatttaggcctctagaaatctgcaaggtgctaagctcataacaggtttccccagaggatcagctctgtcccacttcccctggagaagtggctccagtgcctggaaggggtgtttgcaagtgttcagagctggacagggaggacccagccctcggcctgtgagagaatgtgaggacgctcacgtggccctcttgaccaagctggggcaagcgcagcaaagccactccgaggctgtgttcttggctccggcttctgcattgctacaccattagcttcactgattttccactctggctctgccaggcccgctccctgaagtcagggaggaggaatttctcagggaagaacaaatggctgtccagagatcttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagctggccctattttcacaatgcctcgttcctccggggccactgggggctccagctcaccctgtagacaccacctttgcctctttcttccttccctgaggcttggaaatgagacaactgtttccctgttgaccggggaagtccagctgctctcattctcctgggctcctgaacggggcggcccaggccttcctcctgggcctggctctttcaccaacttgcaggcaggcaatcccttctccccacccaccatactccccagccccactgcaccctaaataattaagctgaaagctaactgccctacctggatctgaagggcctgggctaaatcccaaactgtttcctcctaggagaagcctgctggagtctgggccacttctgaccttggggtttgctctgacttacagctggtggcagccaagtagcagggccaattgccctaacccctcctccccggtagtgggcctgttgcctcttagcattgccagtgtggcaccaagagacattgaacttctaccctcagagttccctcccttctcctgtttcttggctcacaacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccaggtgctagcgattcttctgcctcaccctcccgagaagctgggattacaggcacccaccaccatgcccagctaatttttgtattttttgtagagacaggttttcgccatgttggccagtctggtcttgagctcctgacttcaagtgatccacccgcctcagcctcccaaagtgctgggattacaggcgtgagccaccacacctggcctctttttaactttcattctaacacttactttactctgcctcacattatgtggagtttttaatagatgtctgtttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctcaaaaaaaaaaaaaaaaaaattggtgttttgttagataatctgggttcatctttcaaaattcagaaaatacagacctgtaaagaggaaaaggaagactcctataattccatcattcaaaagcaatcactgttaactgaatttattgttttagacttttttcttgcatttatgtaaacctgacttttcagaattaggatttatactgtatacgatgttttgtgactgatatcagcatttagagccatacagagaatgtttttcattatgcttaagaactacataatgttccattgtgtgggtgtacaaagttgatccagttctctacatttgggcatttaggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaaggtcaggagtttgagaccagccttggtaacatggcaaaacccttctctactaaaaatacaaaaattagccggtcatgatggcggccacctgtagtcccagctactcaggaggctgaggcaggagaatagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaattacctgggcgtggtggtgggcgcctgtaatcccagctactcgggaggctaaggtaggaggatcacctaggcctggtgtggtgggtcacacctgtaatcctagcacttttgggggccaaggtgggctgattgcctgagctcaggagttcgagaccagcctgggcaacacggtgaaaccccgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaaaaaaaaaaaaaaaaggtgggagagggctgagtcagtttgccttggaggcatgggggaggagaaggatgtgaacagggaagtgatctaagagcttccctaggaaggaaggacacccttttcctggaatgctctcctgctctgccacagctttcagtcaattatcactgcctttagaatgcttatcagcactccagcccttcagaagtgtccttctcctcctctggtgtcaaactccagagtttacttttggaattaaggtttattttccttaggttttaggaagtagcttttgaaccttagaagagtcagtttcctttactaactactgaatgaagttaggcattcaaaacttgggtagtcatgatttgaagtgtcacttgcggccaggcacagtggctcacctgtaatcccagcattttgggaggttgaggcgggcagatcacctgaagtcaggagttcaagcccagcctggccaacatagtgtctctactaaaaatattaaaaaaaaaaaaaaataaccgggcgtgatggcaggcgcctgtaatcccagctactctggaggctgagacaggagaagcacttgaatccaggaggcggaggttgcagtgagccaagattgcaccattgcactccagcctgggcaacagagtgagactccgttccccaaaaaatgaaatgtcaatttcattgagactgtatgaatgcctgacatgcacttgaaagtgatgtttattttataattttagcccttcttcactaccccaaactcccagtgcatttaaaaaatttattggcctagccattctcatggggtaatatatcatgaccatcaaaagatgacactaaagtgaatcctccatgtatagctgggctttctgccagccttagattctggagaagcaccccaggccagggagaacgggtgaagaggagaagcatttattgaaggtgctggtagccggagccctgagaccaacacagaatcgttttttctgaaggacaactcaaggacagttgagggctcttcacttccctcacatcagagggagctttgtgctcacgatgggcacggaaagggatgccagtaagcgatgcccctctatcatctcacaagacccaggtgaaacaggacattggttagggctgggacagggtcagtcagccttctcattttacagtggaggaagctgaggcttgagaggggaggtgacttgcctgaggtcacacagtaagtgatcagctgtcatctgagtgatttcttcaggtactctctctggctggacccagccagtgacaactacctgtggctcaagctgagtttgggactaaatggttttacaaggacctcaaagtatactctctctcttctagtaggacatggggaatactgactttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctctacaaaaaaaaaaaaaaaatttagccacgcgtggtggcaagtgcctatactcccagctgcttggggggctgaggtggggggatcacttgagccagggaggtggaggctgcagtgagctgaaatcatggcactgttctttagcctgggctacagaatgagaccctgtctcaaagaaaaaaaaaaaaaaacccgaaccatgtttttaatttcttaaaactgagagtactaaatgctcaacgttcatgttgtgtgcataaaagtgagactgaaggatgaatgtgtggggtatggatagatgggatgtgaatgaagcagtctctgggtccaagctctcctggaaattcgtggaacagaccagtggtcccagatttttagatttcataggccagtaaaatttccctccagatttttggaaccaacaaaggatcatcaacttttttgccaagtaagaacgtttttaataaactaatgctgcctgctaccattaccacctgattcttttttttttttttttttttttttttgagacagtttcattcttgttgcccaggctggggtgcaatggtgcgatctcagctcactgcaacctccacctcctgagttcacgcagttctcctgcctcagcctcctgagtaggtgggattacaggcattcgccaccacacctggctcattttgtatttttagtagacacggggtttctccatgttggtcaggctggtctcgaactcctgacctcatgtgatccgcccacctcagcttcccaaagtgctgggtttacaggcgtgagccaccgagcccagcgccatctaattcttttgttgtggtaaaatatatgtaacataaaattaaccattttaactatttttatttttttaagttaaattgattatgtaatgtttttgagacagggtcacactttgtcacccaggctggagtgcagtgttgctatctcagctcactgcagcctcgacctcccgggctcaagagatcctcccacctcagcctcccaagtagctgggaccacaggtgcacgctaccatgcctggctaattttgtttttcttttttttttttttttgtagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcgggtacggtatgatgttttgatccacgcacacattatgtaacgaccaaatcatggtaattgctgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctttcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatctacctttgctcttcttggatgagtgaatgaacttccctctttccagagcaatgctttcttcctgtttagataggagggagagaagcaaagtgtattgggaataggttgagcgaaagagtgtagtaagagttttctgtacagctctgtccttaatgtatcagtaaacaatagggtgagaacttttgctggggagagaggaaggagggaaatttcttttcagacaactcttgggtgcattcctttgttaatcacttaattacagcccttctcccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagccccgctgcgctgttctgtgctccttttaagttgctttcaaagccaccccgagttcctcccccacccacaattgccccctcatttatctctggggagtttataccaagactgtaaacattcctggaccaccagtttcccccatgttgctgaggagtttagcctttctctcctaattttcttaactcagaaatcaaaaagatggaatagggatgatagaaattgctaccctgagacatcatgctcatggaggatgcctggattttgttgggggccagttatccaagccctaagccctttggagtgtagaacgtagagtaggtaatacaaatacctactgtcagcccagcaccccagcaacatgagtaagtgcaagacacaggcatgaacattttcagctctagggaaaggcacattcatgttggggagaggtggagaatgcagtttggccagtctcagaagagtgagttttaaggcctaggaaagtgatggagatgattgcttgttggagagagagaaggagaaaggcatttaggggaagaaaaggaaaatgaaaggagcagtgaggatattggctccactggggaggtggaactggggtagtggccgaaccaggggtgggagaggacgtggttgagaggctccagaccagctggggctgtcatggagtgttgggggtctggagcagtcaggacttgaaagccgggacccttgtgagccctgtgcagtcctgaggatgtggcccaagggggagggcggaccagctcttttgcctcgtgttcttaatcttctcagtgggtcatcaggggtcatcagctgtaagctgtaatcaacggtgaggggctcgagaagagaaggtgtcaggtgactgctggggattgagctgaggacaggagaggcagggtgctgtctcctgtggcccaggcagagcggcacagacctggagtgggccacccctcatcaccccatgtgctgcgacagtgctggctggactgaaccctggaagagtacctggacacagtggaggggccaggacccagcagatgcagcctctagagcttgtccctgttttgtgactttgggagccatttttccatgtttaaatgggaaggaacacaagtcacctggtcacaaggaagcaggccctatgaaatattaagtgcaatgccaaaacagggcattgttactggtcttgagtctgccacaatcacaatgaacacctcccccattttctcacctgccacatttggacagccgagcctgctggactcgcaggggcaggagagtgcattttataattaaaagcactcaactgtaaggtaatgattgatatgagctatgggcttgaggaaatgagggaaggaggggaggataaggccaaagcaaccaacttcagaatctcacgggaggaggtaggatgcagggggtgccattagacagaatcaaagggctgaaccagaagggcttcctcacctggggaagtcaagacactgtgaagattgaggctgccttgcacagcggtaaagctggactctggatgtatgatgtatgtggattctggagaaccaggctacctgtgtttgaatcccagctctgccacttaacaacctagctgggccatcttggactaatcccaaatctttctgtgccccagtttccccctctgaagataataattcctttttttttttttttttgagacggagtctgggtctgtcacccaggctggagtgcagtggtgtgatttcggttcactgcaacctctgcctcctaggttcaagtgattctcctgcctcagcctcctcagtagctgggattacaggcgtgcatcaccacgcctggctaattttttgtatttttagtagaaatagggtttcaccatgttggccaggctggtctcaaactcctgatctcaggtgatccacccacttcggcctcccaaagtgctaggattacaggcattagccactgcactgggcccgaagataataattctaactcttaaatacttcacaagattctaagttaacacatgctgagaactatgctggtatgtagtaagcctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgccctgcattcatagtctctgcagagaggtgtgttccctgggatatctttggtggctctgttctatccctcaacttacaaattgaaatcattatttgttactgttttctcccatgaaccttctgttcctggccagctgtacagcctggcctcatctcccactgcccctcagaccagggtacagccatgcctgtaagcacttcattctcttctgttccccccagacatttcacttctcatctaaatcctctcttttcccttccccgtcattttgtccaacctctgctctcactgctgatacttttctttatgtttcatgacgtcagagcctgtgctagacctgcctgtacttggtcctgacattctccatttgtctcatgttgcagtataaaatcttaatccatattaaggtgctgtgcaaatctgagcacccctgttagggcaagacatatgccttctgggcctttgtttcacccatttctccttgcacagtgacaagggctcccagagtcacctaatggtagctatgttgatgaaagttccctgactcctccttggatttttgagaactggggtctcatcttgtcataagaatagcaaggtttgtatgggtttgggtctctgatggttcccatgactggtggaagacacagatttagaatcaagaattgggaggccgaggtgggtggatcacttaagttcaggagttcaagaccagcctggccaacatggcaaaactccatctctactaaaaatacaaaattagccgggcgtggtggcgcttgtctatagtcccagctactcgggactgaggcacgagaatcacttgaacctgggaggcggaagttgcagtgagccaagatcccagaactgccttctaaatgactgtgggagatttttgtccagtcctgctagaagcaaaatgctgtacctgttggcttgttggaagtacaagcctgcagtatttggggggaaagtaggaagggaagagggattcagtagggcctcattatcattaatcgtgttcctgaacttgaaagcaccatgggaaaatcccctcccacccctgcctctgtcctttctagctgcttccttgaggattatcaaaaagtgtgggtctccggtgggctcctaattccttcttaggggatagagacaccttagagaagcagggtaggtttgatgtatgaatccttgtcactcgcactaaaaggagcactggttgcagcctgcacaaattcccaaggtccacccgccagctgctttgacccaggaacctgcgtggtaatgagatcagcagcctgagttctcgaacgatgttcaaggcaaaccctaaccctgaccttcccactcctgttgatgagaacggtgactccattctattggcatcaaagcataaggccccttttttttcacaatgcactttttttgttgttgttgagacagtgtctctgttgcccaggctggagtgcagtggcaagattatagctcctgcagccttgagttcctgggctcaagggatcctccctcctctgcctcccaagtgcctggggactacaggcatgcaccactatgcctggctaatttttttatttttcgcagagacagggtctcactatgttgccagggctggttttgaactcctggcctcaagcagtcctcccaccttggcctcccaaagggctgggattacaggcatgagccactgcacccagtccgcaatgcactgttaacacatggcacctagagcctgtaatagtgaacagccagtctttttcagcctcaggctaggtcaccagggaatccagataccagatgccctccagcctccattccccacctcatctctcaggaaacagatgcacaaagcaagtgttttggtgctgcttccctcacagcatccccatgtgcattttgaggacaacctttgtatctgattccaattaatcaggttctccaggagttggaatgttggtttcaagtgactgaacaataaagtggctttcttcatctttcttggccagtccaataaaagtgtcaggtagcttttctcttgctaatggacacctaacgacaccctggcctgttggtcttgaccagagaaaggccagctcagggcagctggagctgaagaggcaaggacctttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggttgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgacttgattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttataaaaaaaaaaaaaaaaagcagcagcaatatgggttgagcgcagcggctcacacctgtaatcccaacactttgggaggtcaaggtgggtgggttgcttgagtccaggagttcaagaccagcctgggcaacatttgaaattttaacttattttttaaaaaagaaagaaacattatacccaatatctgtcaattgatgactgcaatgtggtatgtctacacaattgaatattattaggtcattaaaaggaacaaagtgctgattctatgctataacatggaggaagtttgaacacatgctaagtgaaagaagccagtcacaaaagatcacatattgtatgattccattgatatgaaatatctagaatagccaaatccatagacagaaagcagattagtggttgcttagactggggataggggatggaggagtgactactatgggtcaggcattttttgaggggcgagggatggtaaaaatgttctaaagtgagattgtggtgaatgattgcacaactctgaatatacaaaaaccattaaatggatgaatattacagcatgtgaattacctgtctgctgtttaaataaaatagaaacaatacaaaatggaatgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttaaggtctggagttcaaggacagcctggctaacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaaaaaaaaaaaaaaaatttatcccgagatggttccggtaaagggataggacagagcatacctgagccacgtttggaagggaaccggggtctaaacttgcatcaggaggaaagcgagctggttcttgaggcttttacagatcacgtatagtggagttttgtttgcacgttctggttgggacgggcaggaagttacggatccaagctggtatcagctagagcgggtctcaccagggccagtgttcctttgctgcattctcttggggggaaataaatgcctgggggttctctttgctacatttttgtctttgggagctgcttttttctctgggatcggctgcaataggccttgtgatgccagagggtaagaattcaagtttactcttgaccaatgggttgcacagatcacaagctgcaaaatatttaatcaccgaggtcatttgagggaaatgagatttgcatcaatagaagtgtctgctctgttcccttaagagttgagtctaaactgcttttctccttaccttcgtttggcaaaaccacagaccattaaaaatggaaagaataactttttctaaggcccacaaaagcttatttttaatcagttgtgtggtctactcacctttgtggtgttccccttgaccggactcacaaaaataaacgtgtgcaagcctagtggtttctgagcccttttaaagcagtacccctgtttctgacaactcttatttaagataaagcccatgggtcaatgcaggactgggtctgcaaccttggcccccccaagagaaaccactgtcagtccctgtcagttgctgatcatgatgcgcgggacacccattttcatttttaaggtttctagcggaagcctgttgagcacttgaggaagaccgtgtttcaaataagggggagtgaaagagaaaagggagagtagaaaggaaggcagtgaagagccagagtgactgcacgtgtggtatttattgagcaagcatttcttgagcaactcctgggcgccaggcatcgtagtaggtgctggggatttaaaggtaccgatgacacatcaccgcactcaggttcagaaagaggactgcccttcagtgtgacaggtgccaggagggggagggcacctaacccagactgggagtcagcaccgccctggaggagaagtcaccagctaggctgagacagaagagtgagtagtgagagctggacagaaaaaaatcaggggccctgtggccactggggcagccgtgagccacagcaggggctgagggagaacatgctgtttcagagccttatgcatcggggagcggcagtcgctccactgagtctcttagggtgaacaaatggtgagaaaagtcctctccaaggctgtgggcgggatgtgggtggtaggtgagaggtggaagatgccaggagtacatttgaacatcctaaaaggaaatagaaagttcatttcccctcgtgagtgcagaggggtgtgctcaggagatgggtaacagcccaggatggtgaactcaggtgtgtccgggccacgggccttcttgaacgcgtgcgggaagaggcactggtcaggggagggacaggtgctcttggtggtatcagatcttgtgaggtgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgtgatccgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtacgtgtgtgtgcatgcgaaagttagagtaatgggaacaggggaggccgagttaggaagtcctgattacatgcttttcatttttttaagtaatactttccacctatacaggttattcattaaaatttttaaatacaaaaaaatgcaaataaagtttaaacatttcttcagtcttctttctgtaatatggtttttacatagttgatcacatcatgtatgtaatttccttgccttgtcatttgttaacatgagtcttttcctgatatatttcaagcatgaatatttgaaacataatttttcatgactgtataagattccattattttaaaatcccataatttggctgggcatggtggctcacgcctaaaatcctatcactttgggaggccgaggtgggcggattgcctgagctcaggagttcgagaccagcctgggcaacatggcgaaacctcctctgtactaaaaatacaaaaaattagccatgtgtggtggcaggctcctgtaatcccagctactggggaggctgaagcaggagattgcttgaacccaggagacagaggttgcagtgagctgagatcacgtcatttcactctagcctgggtgacagagtgagactctgtctccaaaaaacaacagaaaaagtcctataatttaatgaactattttgtgatattaggtattttctggtttttcaccataataaataatgttgcagtgaatctctgtcagcatttttttaagcgtgcttccttaggacagattgttacaagtgaaattactaacttaaagggtgtaagcattttttttttttttttagacggagtctcactctgtcacccaggctggagtgcagtggtgccatcttggctcactgcaagctccacctcccaggttcatgccattctcctgcctcagcctcccgagtacctgggatgtgcagccaccattcccagctaatttttgtatttttagtagagacggggtttccccatgttggccaggctggtcttgaactcatgacctcaagtgatctgtccgcctgggcctcccaaagagctgggattacaggcttgagccaccgcacccagccagaaatattttaaattaattcaccatgcactcactacatgcaagacaccatgctttaaatgctgcaagatagcgttcctgcccataaaaattttgcagtctgataggaggcaaatgtccatgagcagctaccgtaaaaagtagactgtgatcagtgctttggtaggcagagaggaaagggtgagcacagttctgaccagagactggactggaggagatggtttttgaaatgagctgtcaaggacagtgggggctggattcttagtgtaataggagaggtgcacagttgggaacattcttggtgtatttgggagtgtttgcagaaggcacatctgtccggatcacgaatgatcttgaacgtcacagtggagacttctggagtctttacaccccatctgccagcttgcagagtgtgaacgggctggtaggggggcaatccacgccttgtcctagccaaccctgcagcctggggccctgtgccaccaggctctgatatggagggcaggtgccacggggtgccgacattgtcatggggcctgcattttcctctggaccctcaatgtatccctttggcatttcccctcaggtccgttatgccacctggagcatcataatggactctgtggtgccctctgacaagggcaactacacctgcattgtggagaatgagtacggcagcatcaaccacacataccagctggatgtcgtgggtaagagggcagaggcagcaggaggaatgagtttagtgggaagagccaggcttggagaacacagccggggtgtccaggtttcttaggggcagagtcaggatagcgattggcacttcttggctttgtcaccttgagcaggtcacttctcccttttgagcctcacttttcttatctgtaaaatagagttaagatcagacagtaacacggtcaaagctggttgtcactgtgaaattgaaggtgctgttcagagtctgtcctgaaggaggcgttgttggagaggtgttaaatgtagcgtaataggagctgtcgcttaatgctagcaagatgccaggctccttaaatacctgccctgtaatgctcatggcacacctgcaaggtgggcagtattagtctagccctgcacaggagcacaggcgcataggctcagagaggtcagacaccttgctaatgcagaactgcacacctgtgccaacttcagggcatcacaggagactctgggaagaacattgagcctcttggagctattaccgcaaccttttccttctaggagttctgaaactcactccctagagatcattgggtacagaatctctcagccagtgttcttcttgattatgatgatatggtctaagaaggagattgtggccaggagcagtggcttatgagctccaggtggcatgatgggattactcacgcctgtgatcccatcactttaggaggccaaggctggaggattgcttgaggccaggagtgtgagaccagcctgggcaacacagtgagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgcctttaaaaaaaaaaaaggtaaaaaggagattctgatccaagaggttggggtaagatctgagattccgcgtttctaacaagctcctaggggatgctggtagcactgctcgtggaccacactttgaatagcaggagtcaaagtgactctggttttttaaggaggagcaggttgtgctgaggtctgggggtgcaactgaattagaaggttctccattaaagcatgagcgacttactgtgactgtaaatatgatgactgccttggggaggaggatcctgatggcttagggcctgaagagagggtgtccctttccccagctctgttttgagaggcttgggctcagcagaagtgctgggaggtttacaacccatcactgggaaagccaagtggggcgcaggtgagcccacccctctttagccatggcaaggtccccatgacaagtgcctcctctcccatcttccacagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtggctcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgttaaaaaaaaaaaaaaaaaaaaaaactaaaagggaaaggtaataaatctcacttaacatctcccttcgctccctgggcctgcctgaaagttacacgggagcaacgtgcgtggccacatctcagctttgcccaactgactggtgtgtcgttggtttgttccagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggatgggaccctgtgctggggatttgatgtaggccccaagctgctggggcaggcggggaagccagtactggactgtccttgccaccctactgtatttctagtgcccagagccatggaaaaatacccggcctgggaggctggtttggtttggtattgtgttggtgtctgtgggttccctctctgccttctgtgtgttccttggctttgtgtggatccatgtgaggactcacggggacacggttttgctgtgttacaaatggtacttcagactgaagttgtgagtgagtggtgattaagagaaggggccataggccaggcacagtggctcacgcctgtcatcccagcactttgggaggctgaggtgggaggatcgcttgaagccaggagtttgagaccagcctgggcaacatagcaagaccccatctctacaaattaaataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaagg

SEQ ID NO: 15064 - DNA, 49313 bp, Human; identical to SEQ ID NO: 15063

SEQ ID NO: 15065 - DNA, 49313 bp, Human; identical to SEQ ID NO: 15063

SEQ ID NO: 15066 - DNA, 49313 bp, Human; identical to SEQ ID NO: 15063

SEQ ID NO: 15067 - DNA, 49313 bp, Human; identical to SEQ ID NO: 15063

SEQ ID NO: 15068 - DNA, 49313 bp, Human; identical to SEQ ID NO: 15063

SEQ ID NO: 15069 - DNA, 49313 bp, Human; identical to SEQ ID NO: 15063

SEQ ID NO: 15070 - DNA, 49313 bp, Human; identical to SEQ ID NO: 15063

SEQ ID NO: 15071 - DNA, 46447 bp, Human
tgtcgcccaggctggagtgtagtggctggatcatagctcactgcagcctcaaactcctgggctcaagccatcctccttcttcagcctccacctccagctaatttttaaaaatattttgtagagacaagggctcactttgtttcccaggctggtcttgaacttctggcttcaagtgatcctcccgcttcggccacccaaagtgctgggattacaggcgtgagctgtaatttagttgtttatttactcatttgttcaacaaatacttattgaatatttgctctttggccagtcaagggatttcatgagtgtctactatgtgaataacactgtgttggccactagtctgtcacctactggtggattagaaaaatagcgcgaggaccattttttcttttcttttctttttttttttgagacggagtcttgctctgttgccaggctggagtgcagtggcacaatctcggctcactgcaacctccgcctcccgggttcaagcgattcctctgccgcagcctccccagtagctgggattacaggcaagcgccaccatgcctggctaatttttttgtattttagtagagacggggtttcaccttgttggcaaggatagtctcgatctcctgacctcgtgatccacccgcctcggcctcccaaagtgctgggattacaggcataagccaccgcacccggccaactcttttcttaaattagccagggaggcgtgggtgggttgggtgaggagttgggtggggggatctcattcagtattcaaacttctacaagtttcggggttgaggtgggtgatggtaagggaacaggccctgccactacctttcatagtgacttccatttgtgtaatatttttggtccactgagagctattattttatttgattcttatgaccatcttgtgaaggagtatcaacagataccccgttttgattttatcagatgcatgatttgtcctacatcaaacttcataaatgatggacagaatggaggaatccttcagaccaagtgctgcctacttcccaccccaatggtggcctcagcctgggctcacatcacacgccccaaggagccttggaaaaaataaaggctcttggctccttcctgggacagcgtgattcctcatgtctgagcaggcccatgaacttgtatttttcagacgttccctaggacccgtgtccatctggattagggaaccactacattataccacttcgcgggaagactcagggggaagcattttagccactttcctgtgttccacagtactggagggtgttctgagtgggctgtgattaatttccaaaccaaccacacgtctcccctcaactcccactgcttactctttgcttcctagacattcactgcaggctggagacttctggaagccaacagcatcgctgtagaatttacagggtccagttcccggtggaccacaaaacctaaattatgtggctggggaaagctgaaatccaagggaagggtttgaggaggggctgaccttataataaaaccggcttgtatttactaagtgttaactatgcgctaggccctcgttgacgcctcaactctatgtgaaaagcactattatcccccatttacagatgggaaaacagagatttagagcgcgaaaatcatttccccaaggcgcacagactccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgcctcgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttacagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctggccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttgggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgagatcgtgccactgcactctagcttgggtgacagagcaacactctgtctcagaaagaataaaaagatttggccatgaattcgtcagctagttttccttacataatttttggacaaggagatctgacattcataggtttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggtaaggtgctggctgggggcagcctggactcctgggccttgggaacaggatgggctgggagggaggtgatatggttgcaggtgatgtggtcaacagggaaggctccttcccaagtggagcaaagaactcccttcctgtaggagaaactctcaagatacctgggttggttctggtctggttataaacataactgacttcatcagaggttggggtcatgaaggctggtgacatccatttacctgagatgacatgtttgtggggggtaatttatgcttttctctttctgaggaaagaatatctgatgaggaccctagtgtcacactttaacataggtgatgtataaaatgcagctggtggtgcaatggggagagaatgaccttagaatttgcgtgtagaacttgggtcagactacaggggatgttgtaggaggtgagagcttgctaaagacctctgacttccagaaaattgtttcaaggccacatcttcgccaggcatagtgggtcacacatgtaacctcagcactctgggaggctaaggcaagaggatcacttgaggccaggagttcaagatcagcctaggcaatatagcgagaccccatctctacaaaaaaaaaggaaattaactgggtgtgatggtgcacgctgctagtcccagctacttgctactcaggaggctgagacaggaagattgcatgatcctaagagttgaggctgcagtgaattatgattgcactactgcgctccagcctgggtgaaaaaaaggcacatcttctataagggtcagcagtcatggcttcacgcctgcattttcctatccttaactgtgtctcacaggttctgtttgggggcctgccaagcgatttgctttggataggtactgtttgaggggttttgaagtgattgagacccaggaagcataaaggggcatggagacctatggcgtgttggaaattcagagccatcatcggtaacaggaaggacttaccccaccattcttgggatctgtgtgagctgtggaaaggcctcttgggagattataggtacagaataccggtggctttcgcgggactttgaaaactaatgtatgagcatttctgctgccagaggatagtgtggttcgtgactcagtggctggtcacacagagaaggttgacacacagtgggtgaaaggttggaggtgcgcgtgatggggtggctgtgtgcaaaaggctgccactcagctggtcagggactcgtttgaatgatgagtgatgggtgagaatatgtgtcctctggatggagttggggatgaacagggaaagttgtgtgagactttatagaaggtgcagtggctagagcaggcatattcatgttgctgtcagtaacagaaccgaaggcaaggtctgagctggagcacggtggggacccaaagtgggagagactgtgtctgcccacagggagtttatggtcaggagggatgggcaagtacagggataagtaacacaagacagactgtgtttaaaccacccagtgaagttacaaccagaggtggtgggaatgcagaggaagaggggagcagagagcacctgagatgggcttgagttcagaaggggaaaaatgaagggccctccaggttgaacagcatgagtgttcagagacagcatgtatatggtttatggagaacggtttgcctggtgagtaggtagctctgggaaacaacacttggaaaaattggattgagttagcatatggaaggcttaatgccctgctaagaaaactatacttagggccgggcacggtggctcacgcctgtaatcccagcactttgggaggctgaggcgggtggatcacaaggtcaggagttcgagaccatcctgcctaacacggtgaaaccccatctctattaaaaatacaaaaaaattagccgggcgtagtggcaggcgcctgtagtcccagctactccagctccagtctccagctgaggcaggagaatggcgtgaacccgggaggcagagcatgcagtgagctgagatcgcgccactgcactccagcctgggcaacagagtgagactccgtctcaaaaaagaaaaagaaaactatacttaggccaggcgtggattatgctggtaatctcaacattttgggaagccgaggcaggaggattgcttgagccaagaagtttgagaccagcctgggcaacatgatgagaccctgtgtctacaaaaaatagaaaaattagccaggtgtggtggcacatgcttgtagtcccaactattagggaggctgaggtgggaggatcacttgaacctgggaggtagaggttgcagtgagccatgatcacaccgcttcacttcagcctgggtgacagagtgaaactctgtctaaaaaaaaaaaaaaaaaaaaagcaagaaaagaaaactagacttaaatgggtagatgctgggaaacttgaaaagtttttagcaagtagtgacactatcagctttcagaaagttaatttggcagctcagtgtggatggctgggaggaaagagtgaggtgcacctgtgtttgcatcctgctctgccacttgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgtcaactgtgggcaactggagactgagatgagagtgtaaagggagtgagtcagagtgggaggtttgaggggagtttagatttgaatccgccaattgtagacagcgataaaggagtggaagagtagcaaggagctagttgaggtttgagaatgtgaatttataatggagcctaaagtactttcttttttttgcagcccaagaagggagaagtggatctcgggcctggctgcttgtgagccagcccgacgggatgagtataaggaactttagggccagggtgggggtgctagtagaggagggggcttcacggaagctgctggggcagggtggaggctggaacctgggggctgaagatcttgatgaggacaaagtaccggccctgtgaacagaagaaagggagtaagagaggtggatggggctcttaggagccatgtacccaggaagactgacattaaatgaccattttttaaaaatcaacttaattttcaaaggcacattggctcccacctataatcccagtactgtgggaggcagaggcaggaggatcacttgagcccaggagtttaagatcagctgggtttgtttgtttgtttgttggttggttttaagagacagagtttcactctgttgcccaggctggaatgcagtggcatgatcttggcttactgcaacctctgcctcccaggttcaagcgattctcctgcctcagcctcctaagtagctggaattacaggtgctcaccactatgcctggctaatttttatatttttagtagagatgggtttcaccaggttggccttgaactcctgacctcaagtgatctgcccacctcggcttcccaaagtgctgggactataggtgtgagccaccacacctggccaaaccaacttaatttaggtataacagtttgggctattgtaataagactgctgtgaaccttcatgtgcaagcctgggtgggcacacattttccttggactgccctggttttgattttggctccacaccttactgactattggctcttggggaagttcctctttgtgcccttttataaaatatattgataatgaatgtgtgctcataaggtcattgtgaatatcaaataagcatgtctgcagagctcataggacattgcctggtccgtaggccatgagcagtcaatggccgttgtgggtccctttccctgggcctccaggggagacggcacatggcgaggagcatgttgtttcatgggacacagcaacggaaagcccctgcacttggagaacaagccccaggtctctgtttggtggagtaagcccccgtctcagtgtgagtgtggtgctttcacatagcctgtctctcatgagctttgtgacagaacagagaactgctgtgcccaggacattctaaggggagatctggcttcatgctttgtaagctgtaaggaaccttgtaagtgtaaagtatattgcatagtcttgggcctgctgattattaaataataatgctgatattttttaattaattaattaatttatttgagacggagtctcactctgtcgcgaggctggagtgcagtggcgtgatcttggctcactgcaacctccacctcctgggttcaagcgattcttctgcctcagcctcccaagtagctgggattacaggcgcgtgccaccacgcccagctagtttttttgtatatttagtagagacggggtttcaccatgttggccaggatggtctcggtctcctgacctcatgatctgcccacctcggcctcccaaagtgctgggattacaggtgttagccaccatgcctggccaatgctgctgttgtcctaaaaaaaaaatcatagggcgagcacagtggctcacacctgtaatcccagcactataggaggccgatgcaggaggattgcacgagcccgggagttccagaccagcctgggcaacatagcaagaccccatctctaaaaattttaaaaattagctgggtaacgtggcacacatcggcagtcctagctattcaggaggctgagatgggagaattgcttgagagttgcttgagcccaggagttgaggctacagtgagctataatcaagccactgcactccagcctgggtgtcagaaggagaccctgtctttaaaaaaaagaagaaacacattataatctatgtattaagggctttgtccaaaaggtgagagcaaaccacctaaaaccctgttcacactgagttttccccatttaaaaggccttgctgtgattttaagtgtgtgtgtgtgtgtgtgtgtgtgtgtgtgtgtgtgtgtgtgtgtctgtgtgtctgtgtgtctgtcgggagcccctccccactgagcgcagtaccaacgcccctcagtctgcaagtgctcctgagggattggggagggcctggagtttctggctgtccttggaaagttgatttaataagggttccaggaaaaccagcctccctcccctctccctctccttcccctcctttggtttgggatcttacagagcctcagcttgtttcagatcaggctttgagagtggtgagggagttgtttggaaagactgaagccggtttcagatgataagccccaacattctgagcttgcagagggtgcatttgtctgtcttttgcaataagtcaagtcttggtgggcaaagccagtgagtgagtacaacactgcttgcaaggccactgctggtagttggggtgggggtcctgcccccttttcagcagtactgtgggttaaacaccccagtgctcagaaaacctgcagctcagaagtgatttaatgggctgagttttacagctcctcccacccacccagatttgaaggagtctggtggcttgttagaggggggagaggttgcacttaatggaaaaaccacacatttccattctggcctcaagccccctggatgccctgtgtgcaccacaaagcggggctttgtctctgtgttttgcagaaacctgcacctatgggggagaggctgtgcgtggtgccagagccattgcctagcctcagatcatagggcccttgcaggtcctccatccctgggcgtctccagctgcctttggcccaaaggggtgtgcgtttcagcctggctgcagggagagtctcaaataggtactacaggtttggtagtgggacaccctctgttccactatcagacctgtagtctagcatctacactggactgtggtcctgtgtcccaaggctgccttgggacacaggcaagaccctcccctactcccaccccatctccagcatgatttcttatgatgaaaagaacttgtttgcttctcattcaacctggatggtaagaggagtttcttcatcccctgccagaaggcgaatggaattccatggagcaaaaggtgatgtcagatgaccctcttgagaacaagggtggaggatttaggcctctagaaatctgcaaggtgctaagctcataacaggtttccccagaggatcagctctgtcccacttcccctggagaagtggctccagtgcctggaaggggtgtttgcaagtgttcagagctggacagggaggacccagccctcggcctgtgagagaatgtgaggacgctcacgtggccctcttgaccaagctggggcaagcgcagcaaagccactccgaggctgtgttcttggctccggcttctgcattgctacaccattagcttcactgattttccactctggctctgccaggcccgctccctgaagtcagggaggaggaatttctcagggaagaacaaatggctgtccagagatcttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagctggccctattttcacaatgcctcgttcctccggggccactgggggctccagctcaccctgtagacaccacctttgcctctttcttccttccctgaggcttggaaatgagacaactgtttccctgttgaccggggaagtccagctgctctcattctcctgggctcctgaacggggcggcccaggccttcctcctgggcctggctctttcaccaacttgcaggcaggcaatcccttctccccacccaccatactccccagccccactgcaccctaaataattaagctgaaagctaactgccctacctggatctgaagggcctgggctaaatcccaaactgtttcctcctaggagaagcctgctggagtctgggccacttctgaccttggggtttgctctgacttacagctggtggcagccaagtagcagggccaattgccctaacccctcctccccggtagtgggcctgttgcctcttagcattgccagtgtggcaccaagagacattgaacttctaccctcagagttccctcccttctcctgtttcttggctcacaacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccaggtgctagcgattcttctgcctcaccctcccgagaagctgggattacaggcacccaccaccatgcccagctaatttttgtattttttgtagagacaggttttcgccatgttggccagtctggtcttgagctcctgacttcaagtgatccacccgcctcagcctcccaaagtgctgggattacaggcgtgagccaccacacctggcctctttttaactttcattctaacacttactttactctgcctcacattatgtggagtttttaatagatgtctgtttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctcaaaaaaaaaaaaaaaaaaattggtgttttgttagataatctgggttcatctttcaaaattcagaaaatacagacctgtaaagaggaaaaggaagactcctataattccatcattcaaaagcaatcactgttaactgaatttattgttttagacttttttcttgcatttatgtaaacctgacttttcagaattaggatttatactgtatacgatgttttgtgactgatatcagcatttagagccatacagagaatgtttttcattatgcttaagaactacataatgttccattgtgtgggtgtacaaagttgatccagttctctacatttgggcatttaggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaaggtcaggagtttgagaccagccttggtaacatggcaaaacccttctctactaaaaatacaaaaattagccggtcatgatggcggccacctgtagtcccagctactcaggaggctgaggcaggagaatagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaattacctgggcgtggtggtgggcgcctgtaatcccagctactcgggaggctaaggtaggaggatcacctaggcctggtgtggtgggtcacacctgtaatcctagcacttttgggggccaaggtgggctgattgcctgagctcaggagttcgagaccagcctgggcaacacggtgaaaccccgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaaaaaaaaaaaaaaaaggtgggagagggctgagtcagtttgccttggaggcatgggggaggagaaggatgtgaacagggaagtgatctaagagcttccctaggaaggaaggacacccttttcctggaatgctctcctgctctgccacagctttcagtcaattatcactgcctttagaatgcttatcagcactccagcccttcagaagtgtccttctcctcctctggtgtcaaactccagagtttacttttggaattaaggtttattttccttaggttttaggaagtagcttttgaaccttagaagagtcagtttcctttactaactactgaatgaagttaggcattcaaaacttgggtagtcatgatttgaagtgtcacttgcggccaggcacagtggctcacctgtaatcccagcattttgggaggttgaggcgggcagatcacctgaagtcaggagttcaagcccagcctggccaacatagtgtctctactaaaaatattaaaaaaaaaaaaaaataaccgggcgtgatggcaggcgcctgtaatcccagctactctggaggctgagacaggagaagcacttgaatccaggaggcggaggttgcagtgagccaagattgcaccattgcactccagcctgggcaacagagtgagactccgttccccaaaaaatgaaatgtcaatttcattgagactgtatgaatgcctgacatgcacttgaaagtgatgtttattttataattttagcccttcttcactaccccaaactcccagtgcatttaaaaaatttattggcctagccattctcatggggtaatatatcatgaccatcaaaagatgacactaaagtgaatcctccatgtatagctgggctttctgccagccttagattctggagaagcaccccaggccagggagaacgggtgaagaggagaagcatttattgaaggtgctggtagccggagccctgagaccaacacagaatcgttttttctgaaggacaactcaaggacagttgagggctcttcacttccctcacatcagagggagctttgtgctcacgatgggcacggaaagggatgccagtaagcgatgcccctctatcatctcacaagacccaggtgaaacaggacattggttagggctgggacagggtcagtcagccttctcattttacagtggaggaagctgaggcttgagaggggaggtgacttgcctgaggtcacacagtaagtgatcagctgtcatctgagtgatttcttcaggtactctctctggctggacccagccagtgacaactacctgtggctcaagctgagtttgggactaaatggttttacaaggacctcaaagtatactctctctcttctagtaggacatggggaatactgactttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctctacaaaaaaaaaaaaaaaatttagccacgcgtggtggcaagtgcctatactcccagctgcttggggggctgaggtggggggatcacttgagccagggaggtggaggctgcagtgagctgaaatcatggcactgttctttagcctgggctacagaatgagaccctgtctcaaagaaaaaaaaaaaaaaacccgaaccatgtttttaatttcttaaaactgagagtactaaatgctcaacgttcatgttgtgtgcataaaagtgagactgaaggatgaatgtgtggggtatggatagatgggatgtgaatgaagcagtctctgggtccaagctctcctggaaattcgtggaacagaccagtggtcccagatttttagatttcataggccagtaaaatttccctccagatttttggaaccaacaaaggatcatcaacttttttgccaagtaagaacgtttttaataaactaatgctgcctgctaccattaccacctgattcttttttttttttttttttttttttttgagacagtttcattcttgttgcccaggctggggtgcaatggtgcgatctcagctcactgcaacctccacctcctgagttcacgcagttctcctgcctcagcctcctgagtaggtgggattacaggcattcgccaccacacctggctcattttgtatttttagtagacacggggtttctccatgttggtcaggctggtctcgaactcctgacctcatgtgatccgcccacctcagcttcccaaagtgctgggtttacaggcgtgagccaccgagcccagcgccatctaattcttttgttgtggtaaaatatatgtaacataaaattaaccattttaactatttttatttttttaagttaaattgattatgtaatgtttttgagacagggtcacactttgtcacccaggctggagtgcagtgttgctatctcagctcactgcagcctcgacctcccgggctcaagagatcctcccacctcagcctcccaagtagctgggaccacaggtgcacgctaccatgcctggctaattttgtttttcttttttttttttttttgtagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcgggtacggtatgatgttttgatccacgcacacattatgtaacgaccaaatcatggtaattgctgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctttcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatctacctttgctcttcttggatgagtgaatgaacttccctctttccagagcaatgctttcttcctgtttagataggagggagagaagcaaagtgtattgggaataggttgagcgaaagagtgtagtaagagttttctgtacagctctgtccttaatgtatcagtaaacaatagggtgagaacttttgctggggagagaggaaggagggaaatttcttttcagacaactcttgggtgcattcctttgttaatcacttaattacagcccttctcccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagccccgctgcgctgttctgtgctccttttaagttgctttcaaagccaccccgagttcctcccccacccacaattgccccctcatttatctctggggagtttataccaagactgtaaacattcctggaccaccagtttcccccatgttgctgaggagtttagcctttctctcctaattttcttaactcagaaatcaaaaagatggaatagggatgatagaaattgctaccctgagacatcatgctcatggaggatgcctggattttgttgggggccagttatccaagccctaagccctttggagtgtagaacgtagagtaggtaatacaaatacctactgtcagcccagcaccccagcaacatgagtaagtgcaagacacaggcatgaacattttcagctctagggaaaggcacattcatgttggggagaggtggagaatgcagtttggccagtctcagaagagtgagttttaaggcctaggaaagtgatggagatgattgcttgttggagagagagaaggagaaaggcatttaggggaagaaaaggaaaatgaaaggagcagtgaggatattggctccactggggaggtggaactggggtagtggccgaaccaggggtgggagaggacgtggttgagaggctccagaccagctggggctgtcatggagtgttgggggtctggagcagtcaggacttgaaagccgggacccttgtgagccctgtgcagtcctgaggatgtggcccaagggggagggcggaccagctcttttgcctcgtgttcttaatcttctcagtgggtcatcaggggtcatcagctgtaagctgtaatcaacggtgaggggctcgagaagagaaggtgtcaggtgactgctggggattgagctgaggacaggagaggcagggtgctgtctcctgtggcccaggcagagcggcacagacctggagtgggccacccctcatcaccccatgtgctgcgacagtgctggctggactgaaccctggaagagtacctggacacagtggaggggccaggacccagcagatgcagcctctagagcttgtccctgttttgtgactttgggagccatttttccatgtttaaatgggaaggaacacaagtcacctggtcacaaggaagcaggccctatgaaatattaagtgcaatgccaaaacagggcattgttactggtcttgagtctgccacaatcacaatgaacacctcccccattttctcacctgccacatttggacagccgagcctgctggactcgcaggggcaggagagtgcattttataattaaaagcactcaactgtaaggtaatgattgatatgagctatgggcttgaggaaatgagggaaggaggggaggataaggccaaagcaaccaacttcagaatctcacgggaggaggtaggatgcagggggtgccattagacagaatcaaagggctgaaccagaagggcttcctcacctggggaagtcaagacactgtgaagattgaggctgccttgcacagcggtaaagctggactctggatgtatgatgtatgtggattctggagaaccaggctacctgtgtttgaatcccagctctgccacttaacaacctagctgggccatcttggactaatcccaaatctttctgtgccccagtttccccctctgaagataataattcctttttttttttttttttgagacggagtctgggtctgtcacccaggctggagtgcagtggtgtgatttcggttcactgcaacctctgcctcctaggttcaagtgattctcctgcctcagcctcctcagtagctgggattacaggcgtgcatcaccacgcctggctaattttttgtatttttagtagaaatagggtttcaccatgttggccaggctggtctcaaactcctgatctcaggtgatccacccacttcggcctcccaaagtgctaggattacaggcattagccactgcactgggcccgaagataataattctaactcttaaatacttcacaagattctaagttaacacatgctgagaactatgctggtatgtagtaagcctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgccctgcattcatagtctctgcagagaggtgtgttccctgggatatctttggtggctctgttctatccctcaacttacaaattgaaatcattatttgttactgttttctcccatgaaccttctgttcctggccagctgtacagcctggcctcatctcccactgcccctcagaccagggtacagccatgcctgtaagcacttcattctcttctgttccccccagacatttcacttctcatctaaatcctctcttttcccttccccgtcattttgtccaacctctgctctcactgctgatacttttctttatgtttcatgacgtcagagcctgtgctagacctgcctgtacttggtcctgacattctccatttgtctcatgttgcagtataaaatcttaatccatattaaggtgctgtgcaaatctgagcacccctgttagggcaagacatatgccttctgggcctttgtttcacccatttctccttgcacagtgacaagggctcccagagtcacctaatggtagctatgttgatgaaagttccctgactcctccttggatttttgagaactggggtctcatcttgtcataagaatagcaaggtttgtatgggtttgggtctctgatggttcccatgactggtggaagacacagatttagaatcaagaattgggaggccgaggtgggtggatcacttaagttcaggagttcaagaccagcctggccaacatggcaaaactccatctctactaaaaatacaaaattagccgggcgtggtggcgcttgtctatagtcccagctactcgggactgaggcacgagaatcacttgaacctgggaggcggaagttgcagtgagccaagatcccagaactgccttctaaatgactgtgggagatttttgtccagtcctgctagaagcaaaatgctgtacctgttggcttgttggaagtacaagcctgcagtatttggggggaaagtaggaagggaagagggattcagtagggcctcattatcattaatcgtgttcctgaacttgaaagcaccatgggaaaatcccctcccacccctgcctctgtcctttctagctgcttccttgaggattatcaaaaagtgtgggtctccggtgggctcctaattccttcttaggggatagagacaccttagagaagcagggtaggtttgatgtatgaatccttgtcactcgcactaaaaggagcactggttgcagcctgcacaaattcccaaggtccacccgccagctgctttgacccaggaacctgcgtggtaatgagatcagcagcctgagttctcgaacgatgttcaaggcaaaccctaaccctgaccttcccactcctgttgatgagaacggtgactccattctattggcatcaaagcataaggccccttttttttcacaatgcactttttttgttgttgttgagacagtgtctctgttgcccaggctggagtgcagtggcaagattatagctcctgcagccttgagttcctgggctcaagggatcctccctcctctgcctcccaagtgcctggggactacaggcatgcaccactatgcctggctaatttttttatttttcgcagagacagggtctcactatgttgccagggctggttttgaactcctggcctcaagcagtcctcccaccttggcctcccaaagggctgggattacaggcatgagccactgcacccagtccgcaatgcactgttaacacatggcacctagagcctgtaatagtgaacagccagtctttttcagcctcaggctaggtcaccagggaatccagataccagatgccctccagcctccattccccacctcatctctcaggaaacagatgcacaaagcaagtgttttggtgctgcttccctcacagcatccccatgtgcattttgaggacaacctttgtatctgattccaattaatcaggttctccaggagttggaatgttggtttcaagtgactgaacaataaagtggctttcttcatctttcttggccagtccaataaaagtgtcaggtagcttttctcttgctaatggacacctaacgacaccctggcctgttggtcttgaccagagaaaggccagctcagggcagctggagctgaagaggcaaggacctttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggttgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgacttgattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttataaaaaaaaaaaaaaaaagcagcagcaatatgggttgagcgcagcggctcacacctgtaatcccaacactttgggaggtcaaggtgggtgggttgcttgagtccaggagttcaagaccagcctgggcaacatttgaaattttaacttattttttaaaaaagaaagaaacattatacccaatatctgtcaattgatgactgcaatgtggtatgtctacacaattgaatattattaggtcattaaaaggaacaaagtgctgattctatgctataacatggaggaagtttgaacacatgctaagtgaaagaagccagtcacaaaagatcacatattgtatgattccattgatatgaaatatctagaatagccaaatccatagacagaaagcagattagtggttgcttagactggggataggggatggaggagtgactactatgggtcaggcattttttgaggggcgagggatggtaaaaatgttctaaagtgagattgtggtgaatgattgcacaactctgaatatacaaaaaccattaaatggatgaatattacagcatgtgaattacctgtctgctgtttaaataaaatagaaacaatacaaaatggaatgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttaaggtctggagttcaaggacagcctggctaacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaaaaaaaaaaaaaaaatttatcccgagatggttccggtaaagggataggacagagcatacctgagccacgtttggaagggaaccggggtctaaacttgcatcaggaggaaagcgagctggttcttgaggcttttacagatcacgtatagtggagttttgtttgcacgttctggttgggacgggcaggaagttacggatccaagctggtatcagctagagcgggtctcaccagggccagtgttcctttgctgcattctcttggggggaaataaatgcctgggggttctctttgctacatttttgtctttgggagctgcttttttctctgggatcggctgcaataggccttgtgatgccagagggtaagaattcaagtttactcttgaccaatgggttgcacagatcacaagctgcaaaatatttaatcaccgaggtcatttgagggaaatgagatttgcatcaatagaagtgtctgctctgttcccttaagagttgagtctaaactgcttttctccttaccttcgtttggcaaaaccacagaccattaaaaatggaaagaataactttttctaaggcccacaaaagcttatttttaatcagttgtgtggtctactcacctttgtggtgttccccttgaccggactcacaaaaataaacgtgtgcaagcctagtggtttctgagcccttttaaagcagtacccctgtttctgacaactcttatttaagataaagcccatgggtcaatgcaggactgggtctgcaaccttggcccccccaagagaaaccactgtcagtccctgtcagttgctgatcatgatgcgcgggacacccattttcatttttaaggtttctagcggaagcctgttgagcacttgaggaagaccgtgtttcaaataagggggagtgaaagagaaaagggagagtagaaaggaaggcagtgaagagccagagtgactgcacgtgtggtatttattgagcaagcatttcttgagcaactcctgggcgccaggcatcgtagtaggtgctggggatttaaaggtaccgatgacacatcaccgcactcaggttcagaaagaggactgcccttcagtgtgacaggtgccaggagggggagggcacctaacccagactgggagtcagcaccgccctggaggagaagtcaccagctaggctgagacagaagagtgagtagtgagagctggacagaaaaaaatcaggggccctgtggccactggggcagccgtgagccacagcaggggctgagggagaacatgctgtttcagagccttatgcatcggggagcggcagtcgctccactgagtctcttagggtgaacaaatggtgagaaaagtcctctccaaggctgtgggcgggatgtgggtggtaggtgagaggtggaagatgccaggagtacatttgaacatcctaaaaggaaatagaaagttcatttcccctcgtgagtgcagaggggtgtgctcaggagatgggtaacagcccaggatggtgaactcaggtgtgtccgggccacgggccttcttgaacgcgtgcgggaagaggcactggtcaggggagggacaggtgctcttggtggtatcagatcttgtgaggtgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgtgatccgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtacgtgtgtgtgcatgcgaaagttagagtaatgggaacaggggaggccgagttaggaagtcctgattacatgcttttcatttttttaagtaatactttccacctatacaggttattcattaaaatttttaaatacaaaaaaatgcaaataaagtttaaacatttcttcagtcttctttctgtaatatggtttttacatagttgatcacatcatgtatgtaatttccttgccttgtcatttgttaacatgagtcttttcctgatatatttcaagcatgaatatttgaaacataatttttcatgactgtataagattccattattttaaaatcccataatttggctgggcatggtggctcacgcctaaaatcctatcactttgggaggccgaggtgggcggattgcctgagctcaggagttcgagaccagcctgggcaacatggcgaaacctcctctgtactaaaaatacaaaaaattagccatgtgtggtggcaggctcctgtaatcccagctactggggaggctgaagcaggagattgcttgaacccaggagacagaggttgcagtgagctgagatcacgtcatttcactctagcctgggtgacagagtgagactctgtctccaaaaaacaacagaaaaagtcctataatttaatgaactattttgtgatattaggtattttctggtttttcaccataataaataatgttgcagtgaatctctgtcagcatttttttaagcgtgcttccttaggacagattgttacaagtgaaattactaacttaaagggtgtaagcattttttttttttttttagacggagtctcactctgtcacccaggctggagtgcagtggtgccatcttggctcactgcaagctccacctcccaggttcatgccattctcctgcctcagcctcccgagtacctgggatgtgcagccaccattcccagctaatttttgtatttttagtagagacggggtttccccatgttggccaggctggtcttgaactcatgacctcaagtgatctgtccgcctgggcctcccaaagagctgggattacaggcttgagccaccgcacccagccagaaatattttaaattaattcaccatgcactcactacatgcaagacaccatgctttaaatgctgcaagatagcgttcctgcccataaaaattttgcagtctgataggaggcaaatgtccatgagcagctaccgtaaaaagtagactgtgatcagtgctttggtaggcagagaggaaagggtgagcacagttctgaccagagactggactggaggagatggtttttgaaatgagctgtcaaggacagtgggggctggattcttagtgtaataggagaggtgcacagttgggaacattcttggtgtatttgggagtgtttgcagaaggcacatctgtccggatcacgaatgatcttgaacgtcacagtggagacttctggagtctttacaccccatctgccagcttgcagagtgtgaacgggctggtaggggggcaatccacgccttgtcctagccaaccctgcagcctggggccctgtgccaccaggctctgatatggagggcaggtgccacggggtgccgacattgtcatggggcctgcattttcctctggaccctcaatgtatccctttggcatttcccctcaggtccgttatgccacctggagcatcataatggactctgtggtgccctctgacaagggcaactacacctgcattgtggagaatgagtacggcagcatcaaccacacataccagctggatgtcgtgggtaagagggcagaggcagcaggaggaatgagtttagtgggaagagccaggcttggagaacacagccggggtgtccaggtttcttaggggcagagtcaggatagcgattggcacttcttggctttgtcaccttgagcaggtcacttctcccttttgagcctcacttttcttatctgtaaaatagagttaagatcagacagtaacacggtcaaagctggttgtcactgtgaaattgaaggtgctgttcagagtctgtcctgaaggaggcgttgttggagaggtgttaaatgtagcgtaataggagctgtcgcttaatgctagcaagatgccaggctccttaaatacctgccctgtaatgctcatggcacacctgcaaggtgggcagtattagtctagccctgcacaggagcacaggcgcataggctcagagaggtcagacaccttgctaatgcagaactgcacacctgtgccaacttcagggcatcacaggagactctgggaagaacattgagcctcttggagctattaccgcaaccttttccttctaggagttctgaaactcactccctagagatcattgggtacagaatctctcagccagtgttcttcttgattatgatgatatggtctaagaaggagattgtggccaggagcagtggcttatgagctccaggtggcatgatgggattactcacgcctgtgatcccatcactttaggaggccaaggctggaggattgcttgaggccaggagtgtgagaccagcctgggcaacacagtgagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgcctttaaaaaaaaaaaaggtaaaaaggagattctgatccaagaggttggggtaagatctgagattccgcgtttctaacaagctcctaggggatgctggtagcactgctcgtggaccacactttgaatagcaggagtcaaagtgactctggttttttaaggaggagcaggttgtgctgaggtctgggggtgcaactgaattagaaggttctccattaaagcatgagcgacttactgtgactgtaaatatgatgactgccttggggaggaggatcctgatggcttagggcctgaagagagggtgtccctttccccagctctgttttgagaggcttgggctcagcagaagtgctgggaggtttacaacccatcactgggaaagccaagtggggcgcaggtgagcccacccctctttagccatggcaaggtccccatgacaagtgcctcctctcccatcttccacagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccaga

SEQ ID NO: 15072 - DNA, 46447 bp, Human; identical to SEQ ID NO: 15071

SEQ ID NO: 15073 - DNA, 46447 bp, Human; identical to SEQ ID NO: 15071

SEQ ID NO: 15074 - DNA, 46447 bp, Human; identical to SEQ ID NO: 15071

SEQ ID NO: 15075 - DNA, 46447 bp, Human; identical to SEQ ID NO: 15071

SEQ ID NO: 15076 - DNA, 46447 bp, Human; identical to SEQ ID NO: 15071

SEQ ID NO: 15077 - DNA, 46447 bp, Human; identical to SEQ ID NO: 15071

SEQ ID NO: 15078 - DNA, 114426 bp, Human
ttatggctctttttcatgttttccccacagcctctcataactagtgataagtttttccacaggtatcactgttcccccttgctggaaccctctctttctccccagtgaactctaagattttacttttttatttctcaattgtatctctaaccttctaaggctttgataaaagtatatcttatgagcatacactgttattaagtcataatttttggccatagaaattccctgagtacagatccctcgactgcccaagctaaggtctgtagtttctccatgaaaacgattcacccaggtcactttgggttctgagaggctggaacttatttctataaacctaatactaaaatgaaatatttttgtctgttttcactattgcttagcatctgagcgctgagcattaggcagttttagttactcaaagtatctaaggaaagatgttttctggctgatgcttaatgttttcttaacgcccaagaaatgggactccagcggctctaaaaatggcatttaagatgagaatcaggccgggtgcagtggctcatgcctataatcctagcactttgggaggctgaggtggtagggtcacttgagcccagttcaagatcacagtgagctgtcacggtgccactgcattccagcctgagtgaaggagtgagaccctgtctcttcaaacaaaacaaaaagacgagaatcacagtgttgcttggtagtgtagaaaaagcgtttatcaacactgtaggcccctgtcaagcttacatttggagtgaggagtaaggaagggaagggacttatgcaggtctttccatgcggccttgatttagtccacggagtccaaagcccattctgaggcagggtctctaggttcttggtttacacctgcaggccgatccacagactagagggcagcttgttagactttggaaacacttagattaggggggagatggaaactcaatcccaaagggacagtaaaatgagcctaaggtctggcgggacgatagctcttagcgtgtaaggaacaacagaaaaacaaaatagtgtttctgtgggtgtgctgggtgaggaggggaaacagccggaagaggggatccgagaagaactaaaggagcccacgaagcatgcagctcctcggaggagccggggatgatcactgcccatatcctcccgccacagcgcaagccgcccgggcggtcccggccggcagagggcagcaactgggcgggcgacgcctggcaagggccgccccgcgctgacccgctcgcagggatcctcattctgagcgcgaggcgagggggactcgcacccactgccacctctccctgaccctctggccaccatgcacctcggcccggctgaggggagtcggggggtcgggggagagggcgtagctgccgagagcctggcgcccctgcccggaggaggagaacggaggacgccctcccgggtctccggaaaggaagggggacggggttcggtgggtcctgggacggggatgggagggaacgtgggcgagctgggagccgccctccgcagcctggactttcctggcctttctctactccgaagcagcaccgggccgctccggtccccgccagcccctgccagctccgcttccgggggccacgaccctcgctcgacttcggccgctgtgcgcctcccgccgactctgacccagggacccggagaccaagtccggctggccgaggcccgcgggccgcggcgcaagttccgctcccaccgtcgaggactgtggaggcggcgtgggctggtctccgcggccggggggcgggagcgccgggcggacttgaccgtgggcgccaagcgtcccggccgcgcggcgcgggctttatgtaaatggaggctgcgccgggcgtcctaggtaggatggaccagccccccgcgcctcggccctcacgtccaataagaagagccccagcttgacacctgcctatatacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaaggtaagcggccgcccagcgcccgtcgtccacggagactttctagaaccttcttcggtttccccgatctcttcagcgggtgagggctgcgggacggggccggggtcgtcggggccagcctgtcatcccggcgcagcagagggaccccctgcctgtcttcgggactggggcgtttgaagccccgccgtggtctgaggacgccttggggacttaacccaacccgaagcgcagcgttgaggggcagccgtcaacggctcctgccccggactctgaggctggtttctgtccgattctcccggtcccgactgccgcggggaaggcgtcggaaccgcttagtatcctcagatggaggccggggttccccgtcagcttggccacgcagcctggccgtcgcctctcggtcctccgccttccgggcccctcggctgttggtcccaatcaggtcctccacagcccggagggtgctgaggggctttcccgtaaggaattgtcaagacaccagcgctctggccggtttgacaaatttcacggaaacctgactgataagtacagtaactccaacgtcagcgtttcatgtgaattttgtaggcagcggcagtttccctgggaaacttaaaaagttttaatatttgttagcatgttcggttttgaactgaagaacttacttttttttttttataacgaacgttgacatcttgggtttgctaagcaggatttttgttgttgcatcgcctaaaaaagaatatgcgtctgctacctaatataaaatgaatttactttccacaaattcgacatagaaaaaaaatgatcgattacaaacgtaggggtattgtaatgttacaacattttgagggaggtggtgagagagagatgggattcaaaaccacgtttcttggagttcattttgtagttctctggtttgattttctagtcctttcggtacatttctacactcaacttctcccaattaacgcaaacgcatagacgcacatgcatatggttaaaggttgattaaagatgtattccatcgtgcttttttacaagataaattttgtagagaagtaaattgtttgcatctggcttagtggttgaatgagatatacaagaaacaacatcagaatattgagattttacttgcattgagttttaggttacaaatcagggcgatttgtgttttgaatgtcgatttagatggatttaatgtacctgctagcttttttagatggtgtgacaaatttttcaaagccgttttaatgagaggtcgttaatggttataaccttttaggcattgtttgcataacaatagtgccaatgtgtggcacttgtctgggtttaggaacgagcagggaaagcatgcagcttagaagttttattttatgagggtctctaacctcttcaggctctttttaaaggtcttaaaatggaagatctacacaggagaaaagacctaaccctcagatttgggaaggtttgattttagtcttatttttgatgggatttttctaacagcctctgaaagaaattttaggtatgcaataggtacgtttttcagaatttaatttggaagctcttccagttctcttactccctaactaccccctctctcttttctctcttgttctcccccagtaggaaagacaactgatttatagctaattggagcctttaatgtggagtcttttagctcggggaacttttatccagtatccactttcccacttaatacaaagaaaaacaatcagaaatgaaataatggattgtaacttgattctttaatttgtggggaggaggtaccttatttttgccttgacaaacaaccctcataaacactgagtaacactaatctaaaggcgagctctttccacaaaaacttgtaaaatcaggtatctgtgagcattcccagcagttttcctcctcagctctttagtgagacttctaaattttctaagacaagcatagtggacaagcagtattttttttttaaacgtgaagagcagaagctgctcttttggtatcccagggtaatgatttttttacttaaaggaaaaataagattaatagtgagttttttaaaaacaaacatgaccagaagtgagggaaattatattagcaatttcaaacagaagagtgaacaagatagaatggacagtcctttagcatagtgataccatattcgataggggattttaaaagggtaatggctacaaaagtattacgcgttagggcgtgttaaatatcacatttgaaagaaacacaatatttgcatcagaaaatgatactgtaagacaatatgttactgttttttgtcttgctaaacatacatctttagtgaaggatatgactttctgtatgatttttcagtgtgatattgggacccacatagagtcattacttaaaataaatgaccagactatgagaatttcaagtaatgtgcacttagaaaactttgtacttgtgatcttgtatttttctgtatttttgctccaacttcctcctcctcctagaagtatttcacatttttaataaagggaatgggggagatgaccagaattaaaagttactgcctttgcctgctagaggtccagtggaaatgctccagaattaaagttcattccctaaggatgttgaaagggctaaactcatggttgtgtatggacttttaggcagttacattccattttttaaaatacgcttaccactctgaaattctagtatccatattataccaatgatcaatggcaataccatttttggaacatgtctatttgtatttccctaatacagcaagctggatcccaagttttaaaagtgatcccttatgaaggaatgtgctttttaaaactagatggtgttagtcaaggaggagtgaaaactaacatgaagtattgaggggaccaatttggtaccaagagaatgcgctctcctttgcttgtatcctaagaagactgcattctgattgccttgagcgatgtgtttatgaatttaaaattttctgagttgtctattttattagtctgacttttataattttgtataactgatattataggaatacacacattacaaagtcaaggctcagcactttactgaccgcccctgactgcaggggatatctcttaacagattcccaggtctttggaaacttgtcctctgtattccacttcgaccttctttcttggctctatcttctcttctggctgtaccggtctctcctttccttcctccctcccccagatcgttgtgctgtctttctcttggtcactttttcagtgagagtttatgcccataactaacagtaacaaagagttatgttttttttttctgcatctgatattatatggggctgaaacacagggaggaagagggtatttataacataatgacctgctaaaatagaagaggcaaaaaggcaatcaacttaaaactcagagctaatgtgcatcgtgagtctagatttgtctttttatttattcatctaaacttctgttttctggggtctatttcaattaaattcaaaaggcatttgagtggccatgttcctaacaggggtgcttttcactgtgttagactggaaacatctgccttctgggagattagggtcttattaaaaagtttgtgtgccaaaaattggttgttagtacagcagtagttcagttgatcaatgtaataataatgatgatgataattataatgccacttacatttttatagggcctaatggtctgcctagcactttcatatatatcttgtttgatccttgcaaaaccttttgaaggagagagagtagaaataaatagaataattcataagaaagacattggccttgactttaaagaaattgatagttttcatcaccatacactttttctaacggtctgtggcacgttgttttttcatcgttttgttccgttttttttttttttttgttttttttttttttgagggaaggagtttaaatctttatattttgtgttgcttctctcgcaaccatggagaaaatatgaactagtctacccctcttaagaaggagctatcttttgtgacttttgattctaatactttaaatggctatttttgatttttctatgagatttttttttttaatctggggcaagattcttgcctgtgccaggaataatttcttaaaagataggtgtggatctagatccttccaaacctttacttaacattgtctgttttggtcataaattgtcagtcaaactacatgttaatagaggacttcaggttttttttttaaatactttttcataactatgcagctttttggtgtttgtatcatctccatttaacacagggaagctggacaatttcatcacaggacttgaattagataattctcctggggtcctgccctgatcccttccactacatgggcctgtgttaccatgtggaattatcatttgctgagggactcctcgttctttatttctataaaatgatgaatgatagtttttgtatttcagagtagaggattctctgaggagactgttttgtgaggtctgacttcctcatagccaggcttaagaaaggcaaatcatgcatagttagttctctgttgcatcaatgaagcacaatgatttaaccatgacaaaatcagtaaatatcccaagtcccatcacccagagttatcagttctgagtctttcttagttggacaataaaatacaaatactgattggagtttttgtctcttgagttatcttagtgacagtatcaggggtcagcaaactgtggactgtctgcctggttttataaataaagttttattgtaacacaactgcactcattcagttatatactgtctgcggcagctttctgactataatggcagagccacagaaaccatatagcccacattttagaaaaaacttgcatgcccttccttcatttggaaaaagagagactctgagttaaaataagcctttgatcaaatcctggtcagaaaggtacttatcagctacatggacagttacatttatttgacacatagtgcctgatatgatgccaggtcctagggatgcaacagcacaaaaaaaaaaaaaaaaaaaaaaagatatgtgtggcatcttaaagagtttcttcactgactttcaatttctacatttgtcatcattgagataatagtatctactttatggggttaaaaggactaaatgaaaagtgtgttaaagtaagtggcatataatgatagccaaaattctattgcatttttgcaaagtgatgactatatatatatttagagatctaaattaatggaaaccaattttaaggaagatcagaattatgtgatcaactggccaggcgcagtggctcacacctgtaatcccagcactttgggaggctgaggcgggtggatcacctgaagccaggagtttgacaccaacctggccaatcatggtgaaaccccatctctactaaaaatatgaaattagctgtgtggtggtacacgcctgtaatcccagcttcttggaaggctgaggcaggagaatcacttgaacccaggaggcagaggttgcaataagctcagatcataccattgcactccagcctgggcgacaagagtgaaacttcatctcaaaaaaattatatgatcaacaaagttttataaaaccggtctgttttatgtattcttttaattatttttattacatttattatgtgcattactcataagagttcaatattctgggtagctatggaatcctccttatatatttacactgcgtttttaccaaatgggattcctgggagggttttccaccaaggtcttgtctttactaaaaaagttactaaagcattttctctgacagtattttaataataaaattagatatcttgacatttgtgccaaaatatagcatgaatatgcttcaatatgcccgattagctgagcctaaactccaggttgcaaatagacgtttctggtattttaagtagttaggataaaaatacaagatattgatacataaatgtgggaagtatgcagcatacaaggacattctcagaaggtagataccttttgacagtgggaaggtatcttactttatataatttaaaaacgaagaaacttttactagtcctgactgtccaagataacatatggaattttgagagcattttccaggagcagtcaccttccagaaagtaaaagcaccaggccgtggctattttgaaagccctcctagcatttctttaatttctttattgactgtgacaggtaatttcaaagccattcatttccccccaaacagcaaatctaattcacgtagaggtgattgctgtaatgtcacctgggttaatttttaattgcctttaattgtatctttgagatctatttcatttaaccttttaaatatatgagattatgcacattgggaattacttatcactggtatttctctactgtctgcctttaagattgagttatgtttaaattgttttccttcaaaatcttagagcttatttacagcaggtttatttacaacaagtctctgttggatcacatgatgaaaacacttccaggctttgaaaattccagttggaataataattgggtgatttcaccacctagacttctgctgggctctaaacaacacttccctggggctaaacgtggggattaattgacctctgtagaatgtggttaaaaattagtatgtctgcgtgtgaactttctaatttttattatagaaggaagcctttcttttactccagttcagctctgttacctccagaagtagttacctgctctgtttcccttcctcatcactgtctgacctttggagagccaaagtagtatttctttatcactacaactctggaaagagaaaagcttttgtttaggtcaaactggaaacacctgtttcttatctagaagaatttagcatatcatgaatctgaaaactctttccaatcttgattatacatttttcaaaatattaaaaagttatattttaatatattttattttacattattttcatccatctattcattggactttgaatttcaagtccagtgactcttaggtttttttttttttttttaatatcatttctagtgattccttaaagattaaacagtcagaaagtggtataggttgtgtgactctttcccacaagaagaatggaattacctcccagtaaatgaatctggcgaaatattgtgagtttaggaaacccactaattatttagcaagcccacgagatatgcaaaaataacctacttccccttttccccacctgtcactcctaacactcatataccagatttccagactgagatgtgtgtgatagtggcacgatttcaggtgggaaggaggaggggaaggctttgcctgggaaggtgaaattatgaaatgcctgtatgaatttatggagaacaactgaaagtcttatttctctaggtgtgaaaattggacttgctggcagaatcctttttgggagaagatgaagaatcagtgtgagactgtttggttaaaatccccaataaaactgaaactggtgaattctgcctcatctatgttttacagtttgataatataattgtattatttaattttattataaaatttaattttaatttttattatctcagggtcatttttatttttggctgtagccagagctactcttgtgcctccctgaatttatgtattcatttgtgtatttaacatttattaaggccttttgtgtataaagcattgtgagtcactctggcagagaaagatatataggtgtggcccctgctctgaagaggcggtagaggattcccatttgggtgtggagtggggtcatgcacacagtagctattgttcatgatagaagatgctaaatgtttgagatgaatgaggattcagaagatagagatgtttccagctcagcagaagaacagcacactattgccagacatatttgacagaaaatgaattgctttaatcatacagaaaagtaaagcagtaatataacaaatgtgtgtacctgtacctagatttgttagttcttaatgttttgcagtatttgcttctaattttttaaaaggaataaattgaagcccccatttctttctttctcttcctttgccagaggcatttatcttcactataggtatatgtatccataaataatacatgctattgttttgcgtggtaacatcttttatataaatgttttatatatatgtaccatatatatatatatatccttctgtaatttgattagcttgttaaacatatgttcagtattcatccatgttgttggatgtacttataattagttcattgtaattgttgcagagtattccattctttgaatatatcctaatttttagtttctgctcttgacatttatgatgcatccagcattttgttattgcagtaatgctgcattggacattcctgatcatgtctcctcatatacctggtgagagagcatctaggatgtatacctaaaagtgatattgctggctcatggagtatatgtatctacaacttaattagggattgccaaatttctgtccaacatagttatactagtttccaccaccagtatattcccagtatgtacacctccagtatatcccaccagcagtgtgtcagagttcccattagtctacattttcacctatacttcagattctcatacttattaaattttgctaacctggtaagtgtgaaatggcatctcattgctactttgatttgtgtttccttgatttcttgtgagattgagcatcgtttcatgttggccgtttggttttcctcctttggctaatttatcatttgctcatttttctatgttgtgtatttactgatttgttatcagtttttataaatgtattcaggattataatttttatcagttatttactatgcaaacattttctttcctcttgtaactttccctcttctttttcttgtgtaactgtcatacagttttaaatgcaaaggaagaaggatttttcctttagagtcctgtttcagaaatgcattcctattgcagatttttcaaggcattctttttgtagtcttcagaaagtttatttttgctttttgcatttctgtctttacctcctagaattggtcattgcttatgcatggggacaataataaagacaaatgatgtagcattggaaagtcaaacaatattgatgtttaaataatttttaaaaattgtattccttgaagtcttggaatcagattaggaagtctagaatgtgtggtcttctctataatgggaaaataggagaaactactttgattgatggttttaatacacactagtttccctaaactaagaacagtgctgtgttccacaaacttacctctaggcggccactgtataaaactctagggtaacatgattattataacttattcatgtcaagacttaatttccctacctttcttacattatctggaacagaataagtacttaaatattagctgtggttgtactcttgctcatgtgcgctcgcgctgtgtctctcacacacatacaacactcatttttgaagggtcaagataaattgatgaattatttactctgtgctgctgatagatttggagaaaacatggataggtagcaaataatttaaaaagaatttctaaaagaccttttttttgaataactctacattattcaagaataatatacttcatcctgttagtgaagagaatttaaattattcctaagcaccaggtctgaaaataacattacttcttattttgttaacattttaacttaagttctaaacccaaagctgttgtatatatttacctttgtgtttgaatttcatcagtgatttggttcatacatgtgtatctctaattttaaagaaaatattgtggaagtgtgaaattctccaaccttaaaactaaaactaccccttctgtgtatatacttacatataacacctgacaattttggctacacacttattttttgataatgaatgtatattctctgagcattcatattacttatttgcacttctcagtggtacaatttttgcatggtattatatttttctgtgtaactccctacttctaaactgtactagattataaactcttatttatcatggtgtttctgaagtacctagctcaatgtctaacaatgtagaaacttcaagaatgttttcttaatgaatacttgttatattttaatagctacggcttttattattaatactacaatattcagagtacttttcacatatgattacattaaattcttggggcaacactacgatgtggatattgtattaatatcttcattttataagtgagaaaatcaagcatattaaagttagttttttcaggctcaacagcaatagtgggtggcaattccaggactcaatactcctccttccctactcgtaacaataaggacaaacataataaccactacaaagacaatacaatttggactattaacctaaagccttgctgaatgtttcataggaaaccccaagcccagttcctcaactacaaatcccatatttcattcagatcctaagtctaattccactcagtattgtccgcagctatcataagcaacaattccaaccagacaaaaatgggagtatgaatttaaaaaaaggagagaattgatacaatttgacactttaggtatacatcacctgggaatatgtgattttttaggttatgataaagaacgatgtttttcaatcctcattggttgtgtagtcacacactgcccttaataacacctgtttatttgatctgttttgtttgcattcaaaaagtgttttctttttttatggctgttaagattgacttgggagggaggatgtgtgaggctattgaggataatatattttacattctttctaatgctttctgtgccccagtgggccatcattttgtgtaactgggctataatttctgtgagagagatgcttgccagaaagagttgggtgggtatgttccatcttgtctcttatgagcaatcatcttactaaggcttaattactatcagatccctctgttacctgtaatctcagtggggaggcagaatagaggaattcatgcagtactcaaactttgagtttcagcaacacaaaggggtggcatttggggtgcacaattaatgtttcattataaatgattgaaaaatcctctctaaagaaactgctgaaaggttgtgtcctttaagccagatcttgcaatctccagatttctctgacttcacttttagagagaacagatcttttttacttaccaaacttatgccttttctttccttttttattcctccccttttgtgcttctcttctgcttcccttggtgtttctcttaggacaggcacttgataactcttatttctcgtttagactcatttacctgtttgcatgaaatggttagttatgcctgggaacctttgtagttggctctcccagctgttggcctaaatggtcctttgggagaccagaagcaatgaacctggaataaccacatttgacttctgggagccctcctgagaatttagtaattacttaatggattgaattggcgacatatactattccagataacagcctgggttgcattaaattaaccttcacaaatgggtatttattggtgtactcttaaaagactacacgtgttggctgtaattgctcttccatgtttctccatgctgataggtatttgtactgagtgaaaaatttctgagattaaagcctgggtggtagttgtagctatttagtgatgtgtgtcattgtgttcagcacattgagcataaatcctgtcttgtaaacagcagggagactaatgaggtttgcccacattctggtatcattaccaggaattccaacagagaaaaagagagggcgtagaaaagaagtacacaaaacagtgatttttggaactcctgatgatctgatttaaggagaaagatgattgctcagcatttagtataggcatgtatgcataaataggggtacataaagtacacttagccaaaaaacaaaccaaacattttgctttcactgaatgcttgcaaagtcactaacttattgctacggagatgagggccttatttgtgagtgtctgtaattgtgagtggtgtaaaggggacaactgttgaaataatgcagctgttaaaatgatagcatgctttttgcttttttggaacactttataatttcagtgaactaaaattccacaccaattttagttttacaatttttggagtatttctgctgtcattttcagtgataggcacacatgacttcagaacacaaaaatctcttagaagaagcattttaaatgtggcattttaggtttatttcgaactttattattactgttaagtactgtgtgttttataatgtcactccaagggatccaattactgtttaatttgtagactcatttttttcttggacttaaatttttatgagagccggtatcatggctgccttgacacagagtgtggtccatacatcttcgtgtttgatgaatgaataaatgaatacatcctagacaataaattgtctgatttcatttgcagagtcattaatagttaaaatgccaggactagaaagtgaattccaaggtaaagtgttttgaaacaaatttctttcatgtgcttcctttaaagaaggtatacacacatccactttggaaaactcttctgcttcattgccacgcatttaccccttcctctgaaatagaaacctttcagagtaccttgcagagcagtgaacaaggcactggacagggcattagaagacccgtgttctgaccccagctctgtcacttatgtatgttcatttaacagtttcttggatatgcaggcattgaataaatacttattgaattagcgaatgaacaaaataacttgatcatttattatctattctataatgggacctggaaatatgaaaatgctttgtgatactgggtacgccacttaaatttcctggtaacaggaagcagaggttgcactgagccgagattgcgccactgcactgcagcctgggcgacagagcaagactccctctcaaaaaataaaaaaaataaaaaataaatcctggtaacagctttgttacttacaaaatgagagaccagaatgagatgcttattaattaatccacctactttttaaaagtgttggattagaaaagctataagatttctttaccccaccctgactaattagaactctactttcctgggcccagaacttgggattatgggcatctgaaagacaatactgaactgcttgcatatttagttgtggtctttttagggccgaaaatttgcactcaaacagttttgttgaaaatactgtctcaacaatgtactcatggttaccaaagagtagtccacagaaatccctgttaatgattctcgttatataaatgagtggctagcagtgtcataaagatccagcggaaatcaaaatgtttcatatttgctaaggacttaccatattagaaattagagcagtgactcccaagagacttcctcctttgagtcttggtgaaaattgattttaatactttgtaatagtagtaggcagaaaatatttgttgtcatttctcctccagaccatttgagcagctttcctgccaagctaagctcatgaaaaccatggagggtgaggaagcgtggtggcaagggaacttgtcagaagcttacagcttttcacttgagtctaatagagacttagcactttgcaggtcagtgccactgctatttgtctctgacctaagagatctggagttcttcacatcaaaaccacatcttgctgagcagagatcaaacgtaggaaggtaagaattctgccagtgatttatcatgccagggagagtgatcaggccatatggggccactgcaaatgaagttgacattctggcagtttctcatataggcctctcatgtagttatggctagtttttcttgtagaggaattccgggtcaagtggcagctttcagtggtatttcttagcagaactgacctccaacatgaggtttatttcaaaatgtagtcctagcaagagttttctaatgttgtgtttaaatggcaaatagggatcttgaccaaatttgagcttttcatttgtctcctttcctctttttttcttttctgggaagttgcctatctaaaaaaataaataaataaaaagagaaaattaagtttaagatgtacaaaaatttctcaaaatgttagatgtgattttaaaatgaactctataaattatgcacaattaggcttattagtttatcatcacagtttaagtcagggtcctttaggaatgacttactgcaaataatattataatccagttcctggggtaagaggaagcatcacatttaaggaataatttaattctttaaatacgattatttgctaagatctgagtcaagtgcaaaccttttcatttgacagaaaaaaattcaataattcttctttaactacttatatcaacagatatgtaaaaatgattgtgctacataaaattcagcattttgtttaccgtcacaagcaaatgtttagtctcctgtggagaaatcactcatttattggttcaaagccttcttcaaccttaggatatgcattgaggtgttcgagcccttccttgcatagatgtttgctttgcagcataaatgaaagatgatattcacatttaaacatagtggtttgagacattaacttctaattcaactgaagatgctagttgctacttttggttttactttttttgtgatgagaaaaatttccttagttgaaataggctttagtgactagaactaggtcttaacctgtgtatcaaattcacttgatttgttgaattatcactttatctgtttataaactggaaattaatattccggttgatgaagtactttgcctgtgcagggagcaagtctaagtgcaataatgaaatggaatttgtcttagttttcacttaccattcttggaacacatacaacatccatgaaaacatggtgggattgtcagataaaataaatgatttttagtgaaatttgaagattaagtaaataatgaattagttttttagtatcagtataccctatgatttcccatacttaaactgaaattttatttactgtttttctgaaattcatatttaattatacttttatttgctaaaacgggcagctctaaactgttagagaaatcattggtgatttttatctgtgaccagttaataaacatcattttaatgtaaaattaactggcattaaaagcaaaaaccaaggaattctttaaaactggtacactggaataatgaagagcacagtagaaagactttttttttttaaccctagcaatactattgaataaatagggcaactaagcccattgtaaaaacagcttaatctcctaaatgaattgctccaaccttctaattcaaaatcatacaaacaaaaacattgagataagctgggtgctttttcaaatggggacccccgtggctttgaaaataaacacttcagcccccttccccctcaagacccacactcacacccactagcctttctgaagtcttccatttgcaaatgaacaggctgaattctgagaaagacagaagactaattgaacctagggaagataggcagaggaacatttgtttccaaacagaagacaaaaagaaatcatgttacattctcagttttcaagacaggggggtacataaaagccatttctcttgagttttcttctctcaaagtacatttcccacaccgctgttcagaccctctccaggccaggtagccttaccatgtttgaaccagcctgcattagcctgtctctatggcagtgtcagaagtgggtagtgatcagacatttggggagaccagttaatgtgttggatggccttcaccatctttacctctttccccaccctatctgtctctgctggtttagcaaagtggtcttagtagcaacagagagtaagtgaacgaatactcagacagaacaaggagtgactagctttttaagagtactcataaattgccttgaattgattgcttatattcagaatcagaatgaataaaaagtctcagtgcatactatgttaggcttttcagtaatccaatatcttatttaatccttacaaccactcaataaatggtttttattatcttattgtacaaatgagaaaattgagccacagaaagtttaaatgacacatctaagtcacaccatctagcaatctttgtacacgtaggaatatgacccataaagaaatcatgcgagaggaatagaggcacaactggatcttaggacaccttcatcaaatttctgtggttaaagaagatttggtatattcctaacatggaatactcttcagcagtgaaaagaaccaaaccacaagatacattcaacaacatggataaattgtaaaatacgctgagtgaaagaacagaaaagggtacttactatgtgattccattcatatgaaattctagaaaaggcaaaataatctatagtgccagaaagcagatcagtggttgtttggaatgtgagggtcagggtgggtaagagggagggattacaaagggaaacaaggaaatttgtggggtggggtggggaatggatatattcattatcttgactgtggggatgggtgtacatatgctaaaactcatcagatacatacagcttattattataccttaacagagtattaagattttaaacatttaaaaaatagagtccaagaagacctccatgagactcagctcaggtgttagtcatacctgtcatttgattaagggagactgggaaaattggacattttagatctgttgtgggagtatcctgctgtaacccatggaatcctgagtcaaatggaacactaggtctgcatcataggtcaccgtaattcccctggaccctttaatctgaatgacccaaaataacactgaatatctcaagcagcatcattctgggaaaggggcagatcccccatccatacttcccttctcaattcatttggatccggccttgtccatcaaaggctgaccaaactgtcctctggggaacacgactagtgaccttttgtctctgtagtctcatctgtgtcctttcactttcagaagcagaccttgaggttagatggatatgtgagaagctaggtggatcttggctacctaactgttaatgtcctaagttatttccatttacagcattaacacagtttgtgtaatcattgaacatcagtacaatgtgttgggcatacaacacttaatttaaaatacccagctgcttactctggcacaatcactttctattagtattttaaagctgttttaaaatgttacctttagttttacattttttttgaccttgtactgtctgaatacttgagcagtctagttagcagccttttctagtgaagacttttcctttttcctgactttcagcttaggactcagcataagtggggttcagggcctgcaatattgggtccattatttaaaactgttaattgatttaaaattataattgataaattagtccttctcaaagcaagctttctaaaaccatgctttttgctagtaaaatattacacttactgaacaaagcccatgtccctataatatcaaaacattgactttaaagtgaaaaatgcaatcaatcatctaggtgttttttctatacaatgccatttgggtgtttttttcactttttagccagatgttttggcgtgaagcaaagcgaatgaataatggaagtcaacagaaccactcttgttctaactatataaccatttcaggaagaagttttttccccctctctaaatgatctgagcacttgccttattgttttactctgtataggtagactcttaattagaagtaaaaaaagttggggctaatttttttcaaagttaaaaatattacctttgattataatgtttaaaggacaccagccttacagagtgccatactgagatgatcatcaatacagttttttataggtaaatgatagcgctgccatttttttggttgttcttaaatctctttaaagtagaaacagtgggacaatcatgtaaaaggagataactaccattaagtcctcaaactacttccttatattgtttaactaaactttttcatataaatcaatctggatattgatttgctgtctggtactctcttatgaggaatgaaaacagtttaatggcaagttgagtaaaatttaactctccaaggtacaatctactgcagagtttaatacaaatcatttgaagcatttactattaaaaaaacaaaacgttttattactgaaataaaacatggcagctttatgtcaaagattcactgaggataggaaattatttacacctaactcctatcaatacctgctgctttgagaattcctcaggctttagattccccaattagaaaatccatggcagcctgcctatatagttatggccattttgctgtgggctgacaagtgcgataagcctagtttgtcctctcttgttttcctgttgcaaaagtggccaagcaaggcaggctgtatggctagtaagtttcactgttttgaatctttatccagctaactgttgagatgtatacagcaacttaaagcaacttttagaagaatccgatgctgttgacagccaatcttaattccttatcccagccccactactttttctagaaacatgatttactatatcctttgagcacctactgcattttaagtgctgttaagatgtgggggaaaccaaatgaagccagcagacctttcttcaagaacttagggaagagagaaactcccattttaaccagctatacttcaggcacatttcacattttatctcactaattgtgcaatagctctgtaaggcagacaggtcttatttctgtttttacggaggaggaaacaaagctcagagagtttaatagcttgctcaggatttacacaagtggcaaaaggcagactggcattaaaatggagatctttcaactctacctcccccattctaggttgttctatgaggaagatgaaggaatacatacaagattaatcacctcaatctttaacgaatttcttgatttttctttactttgttttacatacatagatatgacccttgtaacattcaaccatcaagcatgaataaattaagcaactctacacctgtcttgggggaacagacttgcttgttaccttgctatcctgatgctctcttttgaaaagtaaaattgtataaaccagcgtagtcacttttaattggctttcaaaaagccaaactttatgatctttactgttttaacacaggaatacaaccatctgcaccattcacatgtcagactaccttccttggagaccgtgagatatctattcctttgtggtttgggaagggacatttcttattggcagaaagcctttgttgcagggagtattgtccttattagagttcttaaaagcattctactaggaaggtgaaattgctgagataagaaaatatatgacatttcctgccatggtgcccagaatctaagacgctttgaaatattgacaaaaggaaattgtacttaacagatttttttcaaatgcatgtgtggagtgtctctaataaagtaccattatgaatttttattttaattcccttaggtggaagaagaaattgtgggccaaacagcagtgaccatattcttttttaattatactttaagttctagggtacacgtgcagaacatgcatttttgttacataggtatacacgtaccatacttagccccccatcccctgacaggtccgggtgtgtggtgttccccatcctgtgtccacgtgttctcattgttcagttcctgcttatgagtgagaatatgcggtgtttggttttctgttcttgtgttagtttgctgagattgatggtttccagcttcatccatgtccctgcaaaggacatgaactcatccttttttatggctgcatagtattccatggtgtatatgtttcacattttctttatccagtctatcattgatggacatttgggttggttccaagtctttgctattgtgaatagtgccgcaataaacatacgtgtgcgtgtgtctttatagtagcatgatttataatcctttgggtatatacccagtaatgggatcactgggtgaaacggtatttctagttctagatccttgaggagtcgacacactgtctcccacagtggttgaactaatttacactccaaccaacagtgtaaaagtgctcctgtttctccacctcctctccagcatctattgtttcctgactttttaatgattgccgttctaactggtgtgagatagtatctctctgtggctttgatttgcatttctctaatgaccaatgatgagcattttttcatatgtttgttggctgcataaatgtcttctttcgagaagtctctgttcatatgctttgcccactttttaatggggttgtttgtttttttcttgtagatttgttgaagttgtttgtagattctggatattagccctttgagcagtgaccattttataaagactttggcatttgatatgcttttctttttcagtctgggataccgagattctacagagaagggaacatatgaaaaaggactcactttgttgccatgaaattgtaaccagctcctaaatcagttagcttggccattcccttttccctctgctcatccaaaaccggccctcctctgggaagtaattatgataaggattggttttgaggtcctcttcctgaatcctcaaatttagtcctgttggttggaagagcacaaagctattccttaatatgcctaggaaaataattttctatttgaggattgtaatagtctggttgttgactgtcctctggcagaagtttctgcttctgcacctgggaagactgcagacagtgtcccaggacctcatctctaagtagtgtttcattaggaatataaatcaacagtttccctaacatattttgctttcgggaaagaaaatgaaaaattattttactggcacctgtgttgattgtgctgaagtaaaaggactcaaacagaattccttgtgctgaacagtgtctaagaagcatcatgatacaggaatagaaaaccacacactggatgttctcactcataaatgggagttgaacaatgagaacccgtggacacagggaggggaacatcacacactggggcatgtcggtgggtgggggcaggagagggagagcattaggacaaatacctaatgtgcacagggtttaaaacctagatgacaggttgataggtgcagcaaaccaccatggcacatgtatacctaggtaacaaacgcacacattctatacatgtatcccagaacttaaataaaaaagaagcatcatgatagagatgcagcaaagatcactcggatctggtcagccatcaagtcctcttttcaaatagacatcagcaaaaattaagtttagaaaaagcactgaggtgggaatcaggatatggggggttcgttctttattctgccacaaatccggggtatgtggccttggtcaagccattggacttcttttgacaagtttatttatctaacacttggatttgcagagattatatctaagaccctgtacagctctgtgaatctgtctcttcctaaccaaaggagcctctactatgtttagaccgagaaaaagattctcattcattagagcattttaaaatagtgctttaataggacttggctgttaaagtatgatcttggtgtactgaataatttcacaacaggaaacaaaaaccgttttttggcagggagggagggtttccagctgttcttggtgatgacttggcataggtttaaaaatgtctgttgtaggactcttttccacctgaatctcaccgtttcaaatgatgtctttgtagtatattcattgtgtgttaaaatattagacataattggaaaagaaggcagtcacatttgagaacacagagggcatactctgcagcagtcatggagattctgttattcaaatggctatgaaatgttaacatacactctttagagaaggaacaaatcaaacctatgttatcacagaacttctgatacactttcttattgagcgcccactggtggccacatgtgttctatatccactaacccagatgtacagaatattagaactcaagggttgtaagggatggcaatagatttaataacaaatgacatcttccattagattgatagtagctttctgaagtgccgtattgaaaagtattcagaaaagtctagctggaaagtgtcatgattcattattaatgtttgtcaagagcctggaaacaagatttgtatcataagtgccatggttagccttccttcagtcaccaggtctggtaccctcatagacaaagaaattgagggctagagaagctgagtgacttgccacatacttagcatgaaaccaggactaaaacacaagcaacttcacctcttccttttcctcctcctcctgtgctgtagaagaaaataagacttttataagggtatccccttataaataagcccctaatgcacagtcagtttaaataacaaactataaaatgacatcattgatagtggccaggtgagaagactgcaattcaatttggcctttcagacttcaagtcactcaggagaactccagtgttatgatccagtgccccagagaaaagcagttccttgtgaaccaccttcatttgcaagggctttagcaggataccagtggcactggtattttagtaaatacgtccatagtcttggtgaccacagtgtctttatctagaatcatgttctggatgaaaactatttgtcttaacttcaattcagacaagaaaaatgtaggaagcctacaatataaatgagatggtattcactgtagattgagagacagcttttctgggacatgagatgaaagtgattctaggatttcaagaaacttgactcctggaatccaaaacatacattgttttgcttttagctggaagaaacaatgtacgtttttaattcatacttgcttcttatgtaatatcaatacttaggaaacatttattgggcatctactattttactgttccttatgtagatgttggttatacaaaagtaaagatgacgtagtggcatagtatttgttcttaaggagcaagcaatacagtggagggtttaggtaaagtattacaggacagtatgataggtaggtatatgtcagaggacctgcagttagctctgtatgaagggatttaggaaggctttatcaagaggtcgtatatgaactcagttttgaaagatgactaagattttactgtcctgtcaattaaagaaggcaggaaacagtatgttcaaatatcctgactcacaaaagttcatgtcatgtttagaaattggtagttttaatataggatttgagagggggttgggacttctacagtctgaatgtttgtgtctcgccaaaaatcatatgttcaaatcctaatacagtagtccctccaccccattcatggttttgctttccacagtcaggtgagtacagtatggtaagatattttgagagacatcacgtttacataacttactacgatatggtgttggagttcacttcattactagttgttaatctcttactgttcctatttacaaactaaacttgatcctaggtatgtatgtataggagaaaaacatagtatgtattactataccagtagtttgttactgtctgcggtttcaggcatccactgggagttttggaacatatcccccatggataaaggaggactcctatacaaaggtgatagtattaggagatgagaactttgggaattgattaggtcatgagggcagagccctcatgagtgggattagtgtccttgtaaaagaggcctgagagagctagcttgtccattctaccatgtgaggaaatggcaagaatgcaccatctatgaaccaaaaagtgggccctcaccagacactgaatctgccagtgccttgatctagaaattcccggcttccaggactatgagaaataagtttctgttgtttgtaagccacaaagttgatggtattttgttatagaagcttgaatgaactaagcgagggagagacttagatccacagattttaagttatcatgctcctcattttatggcgcatgtaacacactggtctgtgcaaattctctggtttcccccacaggttttcactccaatctatatttagatatggacatattattgatggaaaacacagtgttattttttctctatatgttttatttacataaatggtggtgttgtataaatgttatgcaggcatagatacttggtgatgagtgtccagagatgagactggagagattgtttgggatcagattataaaggaatctaaccctttggaaagaaacacatttgattaatttattttgaaatggtacagatggccacttgaaggtcatgcggcatgaaggaagttgctccagggcaccaccctgtttcacatactagtatctaggactgaggttaaggtgctagactatttagattttgaaccctcctctactgtgttcctaactggggggaagttcattttagtttttgtgcctgactttcctaatctataaacaggacaaacatgactgcctacttcatatggtggatgtgaagattaaatgagttaatatgtgtaaaaagtgtctagagcctgtaaatagtaagcacgcaaatgttaacatttattattattctcttgctcaatttggttttcaattctgactttatagtaagtttcttatttatattatttctactacctttggcctaatagaatatagatctttaatttaaagttacatcttagcagaggagacggggaacagccatagatgttgagaggaaaggttcaagttttttgccctgtcaattatttgtggtgtgaacttggatttacatcataaactttagcttattcctttagacaggaaataatgcctacatcgtagatttgttatctagatgaaatgaaatggtgaaagttcacagtacatagtgggcccctcataacgttcgttgtatctgaattacttactgaatgtgtgttatccatgtactttgggttagaggaaattccgctccctagattatctgtctgcaggttgttttatgattcatggtatagttggacctgagtaaacgtgttctattagcacagctcttgagaaagaatgtacttatcaaacaattctgcctcttcagctgtggattcagagagccagtgctttctttgatgaaggccacttcgtcagaatatgcagagaggtgttctgttggcttctgtcaggcaggtgtggttgctttggctggaattctttaagacacacaaattgcctctctgatattttatacaattagaatataaaatatattatctttggagcatattcatagtaggtattcaataagtgcttgtgaatgttgttcccaaattttattattagaaccgtgactgttgatttcccccaccacagtactgaacacttatttcaagggcagggggctgattatcatttacttttttatatcttccaatgcctagcacagtgcctaccatataataggtgactaagaaatgattgcaaataaaggaagaattaatgacttctagggagctaggacaaacatgccaacttcctctccttttgcatgtgactcccctccctttttgttctcttcttttctcttttcagctcctcccttcctcttaataatcaatgttgtgagtcacttaactagccctaactcacctttttagaagacaatatttctttcctctcttcacaaaaatgaaaggtgacatgtctctattataaagaaatggcctcagcaacttctggaaaaactctagtggttaatcagttactttttatttaaatatatatgcttaatgctgaattacattgtaaaactcccaagctgatttatggtctcagcctgccttaattaacatcgattccagggggatagtaaatgggaatggccttcacaattgaggttgaacaatgaactctctgggtgttgtccaatttgtaacatgatttacatggaagcaagcccttcctttcccggggttatccctttttcatctggtgtttaggacgggttatatataatccatagataggaacatttgctgtcaaatacttttgctgatttagagctaggccacagaatggtcactattaataaagaaggagaaaaaaaaaactaatctgagactttgcagggattccaggttcttgctatgtgtcatcgcttgtccagtctgtggcggttttatgaagtggccataatgaaagtcagattaaatgcacaggatatatacatttaatcaacagccattggagtctgtggtgctggaagagttataagagccccatgaatgcaaacttattgcaaaagaattcaaggggtgggggaatgaatgtctgctgaatggtactacctgacacaggacaccaaaaaactttccagagtgaatgatttaagtgtaaggtttggcttgtaaagctgccagctgcttggtttcaaaacttgaaacgtttccaaaacattggatgaggcactttatatgtgcactagagtaaatactctggttttactgccaatttaaatgtgctcagtttacagtaatgagcttgtataggcattaccttgtttatagaaagtggaacaggaagaaatgaacattaaccattaccagtagcaattcccattgccttctaccacaatattgatggcaagtttaatttcttccaatttgggactgtgtcacaactgacattggtgtgtatttggctttaatgtcatgttgcttcagcagaggaacacatgctgtgattcagcttgcctctgtcaaggctgatcagaccagttagttgtttcttactgtttttcctaaaacagatgtcaagagacagatatgggaattctgggacagtagaataggtaggtaccctgattacacgtaactgggtctgttttagccaagtctgttttctacaaatggatcactcatgggagccatttattttcccttaaaaattatttgggtgtgtttttatgctgtacatgaaagcagtggcctctgtctcttgggatgactggcacagaaatatccttatccctgggataaggctatttgactccttggatcatctcctagagataggaagatacttagactgaaagacataatttacttggcctggagaagaaagaaaatacagaaatttaaggagactccagcaaatacaatgcctagaatagagaagacactgagtaaatactgttgaaagagataagaaaggaagggaaggaagtagggagggaggggaagagggtgttagtaggaagagaccagggaaacccatagcttaagagacatatcccatgatttcagagatgtagatttcaagaggcaggaagatagagaaaaaaagaaggggaaggccccacgggggaaaactgagtttaacagatgttagcaaacttggacagagacacattaatctcaagggagatagattacgatgtgtgttactaaaaaaaacacaaagtgtgtctttttgagttcaactgatatcaaagtcctttttatacattgtctaggtggatcaaagactgctggttgccagggacctcttatctttatttctgctttaatttgcatggcttcttagaaccttttggcttaagtacacatatagggatgatgctacccaaggaattgcacacttccagacagtacaatttcttctgaattatgtgggatactagctaaatgcagaaattgaccaaaaccaaaagcataatctaggtctgcaaatagaattatgatgcacaagaatgtgaatatcacatttatttcttcatgtcatgggctgtccatgttttcaggctggtcttgctttaatggtttttctaacaatactttcatgatgaaaaaaaataaagctagttattcaacattgaatagtttaagtattgaatgcctaaattttgaagtttcatgggagatgagttccacttctttctcttagccctgtcagtatttattttccttggcttttaaaagtctcttcttcctgtttcctctacagtatttttcactccattttttaactgtccttcctaaatgtgtggttaatttataacataccttaaaaattctttctcttttctcataattctttttttctcttttctgaggtcttctttctatgactctgtctactacctatatgagttttctgatttatttactctcattctttgtgatttgggggccttgctgcttaaatacatattctacttactttgaggacagtgctgtggtagaggctgttgttaagaatccaaggggcaccttcatcatttgagcttttggtagaaggggagaaaagctaaatgtccatttctttcttctttgttacacttcttaaatcggggtatcagataatcttctgagaggagctaaagttaaagaagggctgatcaggccggctgaataattctactgaggatagagtttctttcttgtacttccccattccctactccaggtcatacttcctaattatttcttatttccccaaagtgttattctaacatgtcagccacacagatttctcttttctctgaagcaaactccttcactgcttatctatactatccatcttggcactaaatcacagtgtcttacgttatttaacttaccttagagtaatcttgtcattgaagcattattataagctccagagtacacgtcttctgtggattttcagtcgtacttacaatttcatgctcagaagaggcctttagtatatattttgcagtgtcttctgtgaagtcaaatttctgctcaggtattcttttccttcttagttccaactggtgctgttcatgttatatcaacctgtttgacgggaggatgtgggagggagttgcgcaggtcccttaatgttaaaaagtggttgcatttcaactaagagccataactcttctttagacatttctttagactattattttttaaatttatgtattttaaaaggttaatagttgctgccaaaagttgctgcccagtgtctttctgtcattatgcatctagatcttggataaatatgtgtatgaacatgaatatgtgtttgtgtgtatatgtgtgtgcataattaaattttattttccagtgatttgttgatagtgtattgattatatattgatcttgtatcctgggactttgtgctaaatttgtacttctagcaatttttgtagattttttaaggaatttctacatagacaataatgtcatctaaaaatatactattacttcttttattttaaaactttggcctcctatttatttcatattataatagcaaatgttattacactattaaatagaagtagtaagagctatccttgcatacattattttttaatgtattgattaattaaaagaacagtgatctggaaattgatagggagctaaaggaaaatgcaaaagctgggtttactctagaggtgaatgccaataccagttctgggactagtaaaataaatctatgtccagcatcagcaaaatgcacatttttctcaagctctcacaaagcattcagcaagatagaccacattctggggtataaatcacactttaacaagtttaaaaaagtagaaattatgcaaaaaagatattctcagattacagtggaattaaactaaaacagaaagatagctggaaaaaccaaaaatatttggaaattaaagaacacacttctgaataacacatgagttaaagagtaagtctcaagagaaattaagaaatattttgaactaaatgaaaatacaacttaaaaaatttgtgggatgctgctaaagcagtatttagatagaaatgtatcacactgaatgcatatatttaaaaataagaaatagtctaagcttttttaggaaactagaaaaagaagagtaatgtaaacagaaacaaaaaaataacaaaaattatagcacagatcgattaaattgaaaatgaaaacaataaagacaataaaactgtagactggttctttgaaaaaaattaataaaattgctaaacatgtagcctggctaactaaaagaaaaagagaagacacaaattactaatatcagaaatgaaagagggactattgctactactgccacggacagtagaagaataatacagaaatattatacacaactctttgcccacaaatttgataatttaggtgaaatgggccaattcattgaaagatgcattctaccaaaactcaaagagaaatatgtatgaataggcctgtatctgttcaagaaattgaatcaataattaataacctttcaaaaaagaaagcactaagtccagatggtttcactggtgacttctaccaaacaaacataccaattatctacagtctcttccagaaagttgaagcagagggagcactaactcattttatgaggccatcgttaccctaatatcaaaaccagataaagagattacgagaatggaatactacaaactattacctctcatgaacatagatgcaaaaatccacaacaaaatattagcaaattgagtccaccaatgtataaaaagaattatacaccataaccaagcaggatttatttcaggcatacaaggctgatttggcattcaaaattcaattaatgtagtctgtcttatcaatgggctgacaaagaaaaaatcaggagatcatgtctgtacatgcagaaagagtatttgacaaaattcagcacccattcatcatataaagaaggaagactctcaaaaattatgaatagaggagaatctcctcaacctgatgaaaaacatctacataaaacctatagctaacataatatttaatggtgagaaactagatgctttcccactatgactgggatcaagacaggctaccccctcttgctgctgctattcaagattatactagaagttctagttaatgcagtaagaaaagaaaatgtatacagactgggaaggaaaaatgtcttttttcacagataacataattttctatgtagaaaatccttaagaatcaatccccctccaaaaaagaaaaaaacatctagaactgacgggattactataaatttgcaggattctatgttaatctacaaaagtcatttgatttcttatatactggtgatgaacatttggaatttgaaattaaaaacacggtatcatttacattaccactgaaatgcttaggaataaatataataaaatatgtacatttataagggaaaccacaaaacttcgatgaaagaaatcaaaggagatgtaaataaatggagagatacactatcgataggaagcctcaattattaagatgtcatttcttcccaagttaatatgtagattcaatgcaatcccaatcaaaatcctagtaagttattttgtagatattaacaaactaattataaagtttatatggaaaggcaaaagacctagaatagccaacacaatattgaaggaaaagaacaaaagaggaggactgatactatccaatttgaagagttactgtaaagctacagtaattaagatagtatggtactggcaaaaaaaaaatacagaaaaataagtgaaatagagaagagaaccaagaaatacattcacacaaatgtagtcaactgatccctgataaaggagcaaaagcacatagtggagaaaggattgtcttttcaacaaatcatgctggaaaaactagatattcacatgtaaaaaaaaaaaaaaaaagagtcctaacactgaacttacaacttccacaaaaattaactcacaatttaatattgagttaattgagaaatcatttttttggtataaaataatttatgacaaacttctggagaagagtgattagatttagtgttgtaaggtcattgtattgttttgggggaggtttaagatattgattaattttaaaggtgaagttgttaaatatgcatgataaaataccatgaataaacaaaaaaatacagtgtgcaacttccaaaccaatagaaggcagtaactgcattataaaatgagcaacaataacaacatactttaatcaactagaactaagaggcaagaaaggagaaaatagaaggtaaaataaagcatgtcaaatagaaagcatcaagtcctgatataacagaatatataacactaaatataatcccaatacatacaaatgcattttttatttgcacatatttatgggggtaaatgagatgttgtgttacatgaatataatgtggtaatcaagtctggatattaaaggtgtccatcacttaagtacagtacatttttgttaagtatagtcatccgaagctactatcaaacaatgaatttattccttctatcttactataggtatcctttaacctacctctcttcatcctctcccttcacccccactcacctgtcccagtgtctctgatctattttacattaccgctatgtgttcatattttttagatcccacatatgagaacatgcaatatttgtcttcttatgcctggcttattttacttgtaatgacttccagtcccatctacgttgctgcaaatgacatgattcatttcttttctatggctaaataatattccgttgggtacgcacgtgtgtgtgtgtgtgtgtgtgtgtgttgaggggcactttggttgattctgtatctttgctattgtgaatagtgctacaataaatatgctagtgcaggtatccctttgatatattgatttcttttgctttggatagataaccaatagtgggattgcttgatcaaatggtagttctattttcagttttttgagaaatccacatacactgttttccatagtggttgtattagtttacattcccaccagccatatacaagactttccttttctccacatccttgctggcatttgttatttttgtcttttttaaaattatactttaagttttagggtacatgtgcacaacgtgcaggtttgttacatatgtatacatgtgccatgttggtgtgctgcacccattaactactcatttaacattaggtatatctcctaatgctatccctacccccttcccccaccccacaccaggccccggtgtgtgatgttccccttcctgtgtccatgtgttctcattgttcaattcccacctatgagtgagaacatgtggtgtttggtttttcgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgttttataatcctttgggtatatacccagtaatggggtggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatcatcgccattctaactggtgtgagatggtatctcattgtggttttgatttggatttctctgatgaccggtggtgatgagcattttttcaggtgtctgttggctgcataaatgtcttcttttgagaagtgtctgttcattctttgcccactttttgttggggttgtttttttcttgtaaatttaagttctttgtagattctggatattagccctgtgtcagatgggtagattgaaaaaattttctcccattctgtaggttgcctgttcactctgatgatagtttcttttgctgtgcagaagctctttagtctaattaaatcccatttgtctatgttggcttttgttgccattgctttggtgttttagtcatgaagtcttttcccatgcctatgtcctgaatggtattgcctaggttttcttctagggttttgacggttttaggtctaacatttaagtctttaatccatcttgagttaatttttgtacaaggtgtaaggaagggatccagtgtcagctttctgcatgtgactagccagttttcccagcactgtttattaaatagggaatcctttcaccatttcttgtttttgtcaggtttgtcaaagatcagatggttgtagatgtgtggtgttatttctgaggcctctgttgtgttccattggtctgtgtatctgtgctggtactagtaccaggctgttttggttactgtagccttgaagtcaggtagcatgatgcctctagctttgttctttttgcttaggatcgtagtggctttgcgggctcttttttggttccatatgaactttagttttttccagttctttgaagaaagtcattggtagcttgatggggatggcattgaatctataaattaccttgggcagtatggccatttttacaatattgattcttcctatccatgagcatggaatgttcttccgtctgtttgtctcctcttttattttgttgagcagtggtttgtagttctccttgaagaggtccttcacatcccttgtaaattggattcctaggtattttattttttttctagcaattatgaatggaagttcactaatgatttggctctctgtccgttattggtgtataggaatgtttgtgatttttgcacattgattttgtatcctgagactatgctgaagttgcctattaaggagattttgggctgacacaatggggttttcgaaatatacaatcatgtcacctgcaaaccgggacaatttgacttcctcttttcctaattagataccctttatttctttctcttctctgattgccctgaccagaacttccaatactatgctgaagaggagtggtgagggagggcatccttgtcttgtgccagttttcaaagggaatgcttctagtttttgcccattcagtatgatattggctgtgagtttgtcataaatagctcttattattttgagatacattctatcaatacctagtttattgagagtttttaacatgaagagctgttgaattttgttgaaggccttttctgcatctattgagataatcatgtggtttttgtccttggttctgtttatgcgatggattatatttatcagtttgcatatgttgaaccagccttgcatcccagggatgaagccaacttgattgtgttggataagctttttgatgtgctgctggatttggtttgccagtattttattgaggattttcatagcagtgtccatcagggatattggtctaaaattgtctttttttgttgtgtctctgccagactttggtatcaggatgatgctggcctcataaaatgagttagggaggattccctctttttctattgattggaatagtttcagaaggaatggtaccagatcgtctttgctgtttgtacctctgttagaattgcactgtgattccatctggtcctggactttttggttggtaggctattattgcctcaatttcagaactgattattggtctattcagagattcagcttcttcctggtttattcttgggagggtgtatgtgtccaggaatttatccatttcttctagattttctagtttatttgcatagaggtgtttatagtattctctgatggtagtttgtatttctgtggaatcggtggtgatattccctttatcatttttatttgatttttctctcttttttattagtcttgctagcagtatatctgttttgttgatcttttcaaaaaaccagctcctggattcatcgattttttttttttaggggatttttatgtctctatctccttcagttctgctctcatcttagttatttcttgccttctgctagcttttgaatttgtttgctgttgcttctctagttcttttaattgtgatgttagggggttgagtttagatctttcctgctttctcttgtgggcatttactgctataaatttccctctacacactgctttaaatgtgtcccagagattctggtacgttgtgtctttgttctcattggtttcaaagaacatctttatttctgccttcatttcgttatttacccagtagtcattcaggagcaggttgttcagtttccatgtagttatgcggttttgagtgagtttcttaccctgagttctaatttgattgcactgtggtctgagagacagtttgttgtgatttctgttcttttacatttgctgaggagtgttttacttcaaattatgtggtcagttttagagtaagtgcgatgtggtgctgagaagaatgtatattgtgttgatttggggtagagagtcttaatagacttggtccacttggttcagtgctgagttcaagtcctggatatccttgttaaccttctttcttgtagatgtatctaatattgacagtggggtgttaaagtctcccattattattgtgtgggagtctaagtctctttgtaggtctctaaggacttgcttcatgagtctgggtgctcctgtattgggtgcatatgtgtttaggatagttagctcttcttgttgaattgatccctataccattatgtaatggccttttttgtctcttttgatctttgttggtttaaagtctgtttcatcagactgggattgcaacccctgcttttgtttttgctttccatttgcttggtagatattcctccatccctttattttgagcctgtgtgtgtctctgcagttgagatcagtatcttgaatacagcatacttatgggtcttgactctatccaatttagcagtctgtgtcttttaattagggcatttagcccatttacatttaaggttaatattgttatgtgtgaatttgatcctgtcattatgatgttagttggttattttgcccgttaattgatgcagtttcttcatagcatggatggtctttacaattttgcatgttttttgcagtggctggtaccagttgttcctttccatgtttagtgcttctttcaggagctcttgtaaggcaggactggtggtgacaaaatctctcagcatttgcttgtttgtgaaggattttatttctccttcacttatgaagcttagtttggctggatgggaaattctgggttgaaaattcttttctttaagaatgttgaatattggcccccactctcttctggcttttagagcttctgccaagggatctgctgttagtctgatgggcttccatttgtgggtaaccttacctttctctctggctgcccttaacattttttccttcatttcaaccttggtgaatctggcgatttatgtgtcttggggttgctcttcttgaggaatatctttgtggtggtctctgtatttcctaaatttgaatgctggcctgccttgctaggttggggaagttctcctggataatgtcctgaagagtgttttctaacttggttccattgtccccgtcactttcaggtacaccaatcaaacatagagttggtcttttcacatagtcccatatttcttggaggctttgtttctttcttttcactcttttttctctaatcttattttctcgctttatttcattaatttgatcttcaatcactgatagcctttcttctacttgattgaatcagctattgaagcttgtatgtgcattacgaagttctggtgccatggttttcagctccatcaggtcatttaaggtcttctctacactgtttattctagttagccattcatctaacctttttcaaggtttttagatttcttgtgatgggttagaacatgctcctttagctcagagaagtttgttattaccgaccttctgaagcctacttctgtcaactcatcaaactcattcacagtgcagttttgttccattgctggtgaggagctgtgatcctttggaaaagaagaggtgctctggtttttagaattttcaccttttctgctcaggtttctcttctccccatctttgtggttttatctacctttggtctttgatattggtgacctacaaatggggttttggtgtggatgtcgtttttgttgatgttgatgctattcctttctgtttgttagttttccttctaacagtcaggcccctcagctgcaggtctgttggagtttgctgtaggtccactgtttgcctgggtatcaccagcagagactgcagaagagcaaataatgcagaacagcaaatattgctgcctaatccttcctctggaagcttcatctcagaggggcacctgcctgtatgaggtgtctttaggcccctactgggagggtctcccagtcagcctacagtgggtgtcagggacccacttgaggaggcagtttgtccattctcatagctcaaacaccgtgctgggaaaaccactgctgtcttcagagctgtccctgtcttcagggacgtttaagtctgcagaagttgtctgctgccttttgttcagctatgccctgcccacagaggtggagtctagagaggcagtagggcttgctgagctgtagtgggctccacccagttcaatcttctggccactttgtttacctgctactcaagcctcagcaatggcagacacccctcctccgaccaggctgcagccttggaggtcaatctcagactgctgcactagcagtgagcaaggctccgtgggcatgggacccgccgaacctggcatgggagggaatacgttggtctgctgcttgctaagactgtgggaatagcacagtatttgggcaagagtgtactgttcctccacgtacaatctgtcatggcttcccttggctaggaaagggaaatcccctgaccccttgtgcttcctgggtgaggtgatgtcccaccctgcgttggctcaccctctgtgggctgcacccactgtcgaaccagtcccagtgaaatgaaccgggtaccttagttggaaatgcagaaatcacctgtcttctgtgttcaccttgctgggagctgcagaccagagctcttactatttggccatcttggaagcataccgataggagtgggatgttgattttatcaaatgctttttctgcatctattgagatgattatatggttttggtccttcattctgtagattttcagtgtatcatgtttgctgatttgtgtatgttgaaccatccttgcattcctggtaaaaatcctactttatcatagtgtgttatcttttcaatgtgctgttgatttaggtttgttagtattttgttgaagatttttgtgtctatttcatcagggatattggcttgtagttttcttattttgttgttgtatccttgtctgattttggtattagggtgatgctagccttatagaatgatttagagagaattcccttgatatggtttggatgtatgtcccctccaaatctcatgtggcaatgtgatccccaatgttggaggtggagcctggtgggaggtgtttgtttcatgggactggatctgtcagtagtggcttggtgcactctctgaggtaatgagtgagttcttgctctgtgagttcacatgagagctagttgtttaaagaagtctggcatttcctcttttctctcttgctctctctgtcaccatgtaacacacctgcttccccttcacattctgccgtgattgtaagcttcctgtggcctcactaagagcagatgctggcaccctacttctcatatggcctgcagaatcataagccaagataaattctttttaaattatctatcctcaggtattcctttacggcaatacaaaacagactaacacattcctcctgtttgatttttttgaatagtttcaggaggattgatgttagttattctttgtatgtttggtagaatttggctggattcttgtcttgggcttttctttattgagaaccttgttattactgattcaatattgctgcttgttattgagctgttcaggttttctgtttcttcctgattcaatcttggtagcttatatgtttccaggaatgtatccatctcccctaggtttttcagtttgtcaatgtgtagttcttcagagattactgtggtatccattgtaatgtctctgttttcaattttcaattctgattttgtttgattcttctcctttttaggttagtctaggtagcagtttatcgattttgtttatctcttcaaagaaccagctttttgttttgttgatcctgttgtattctttttagtctctgtttcatttagttacatctgatctttattatttattttcttctgctaatttggggtttggtttcttcgcgtttttctagtttctcaaggtacattgataaagattattaatttataatctttctactttttttagatgtaggcattaattgctataaaatttcctcttagcactgcttttgttattcccaagagttttggtatgttgtttctcttttcatttgtttcaagaagtttttaaatttctatttttatttgttgacacagtggtcattcaggagcatgttgtttaatttccatgtatttgtatcgtttccagagttgttcttggcattgatttctagttttattcctttgttgtctgaggagatacttgatatgattttttaaaaattgctgagatttattttgtggtccaacatatggtctgttctggagaatattccatgtgctgatgaaaaggatgtatagtctgcagtagttggatagaatgttaggtctatttggtgtaaagtctagtttaaatccagtgctttttggttgattttctgcctagatgatctgtctagtgctgacagtgagggtgttgaagtcccccactattgtattgtagtctgtctatttagatctagtaatatttgctctatgaatctgggtgctccagtgtttgatacatatatatttagattttatattctcttgttgaattgattccctcatattatataatgaacttcttggcttaaaatctgtttttatctgatataaatacagctactcctgctcacatttggtttccatgtgagtggaatatcttttttcactttttttcatctcttaactttcagtctacatttgtctttactggtaaagtgagtttcttctaggcagtataaaattggatcattttttaaaaatccattcagccattatatctcttttctggttgttttatatattctttgcctctttttttttcttattgtttacactgtagtttggattcctgtagtggtaccatttgagtcttttcctcctttgtgtgattactttacaaatgagttttatacttccatatttcagagttaatattttgagcattttttttgagatggaattttgcttttgttgcccaggctggagtgcaatggtgcaatctcagctcactgcaacctccacctcccaggttcaagcgattctcctgcctcagccttcccagtagctgagattacaggcatgtgccaccacgcctggctaattttgtattttcagtggagaggaggtttctccatgatttggtcaggctggtcttgagctcccaacctcaggtgctccacccacctcggcctcccaaaatgctgggattacaagcatgcaccaccctgcccagccctattttgagcatttcttgtagggtcagtcctagtggtaatgaattccttcagtctttgcttatctgggaatcagtctatttcgccctcatttgtgaaggataattttgctagagataatattctgggttggcagttcctttttttttttttttttttttcccagcactttgaatataccatctcattctcttctggcctgtaaggtttctgctgagaaatctgctgttagtttgatggggtttcctttataggtgactagatgcttttctgttgctgttgttaggattttctctttatcattgacttcagacagtctgataacaatatgctatgtagaaaaccttttcatattgtatctgcctgagaatcattaagcatcctgtatctgcatgtgttaaatattgctaggcttggcaagttttcatctttgtttcttgtttcttgattatactaataatttgtaaatttggtcactttaaaattgtcccaagtgtcacaaaggctttgcttatattctttaaattctctgttctttgttttgttttactggattatttcaaaagacctgtcttgaagattagaaattattttgcctggttctaagattttaaatgcatttttttcccttcaatgaattattctgttccagatttctatttgtttctttaaaaaaaaatttatctctttggtaagtttctcatttatttcctgaattatttttctgattttttatgttcagaattcacttgtatctcactaagattcttgaaagtcaatattttgaattctttatctgggattttgaaattttctgattaagatctgttgatggagtatggtgttcctttggaggtgtcatatttcttcgctttttcatgttgtccttatgttgatatctgcacatctggtataacagttggttcttcctatttttgaatttactttcataggggaggaatttttcctgaaggtgtatatatggtgttggttggatggggcattttggctttgattctgggtggatgcagtggtgtagtctctatatgatttctttggcagtaaacaacatcagtgatatctgtgatttccttggtaagttatagtgtggttattagcagaggctgtggtgaagttgtgctgaggactgggatgccaggtaggccagtctttaggccctagtggttgcagtggtgggttgagtgtgcctgtctttgtgcctcagtgtggaataccctggcacctgtgttggagcaggctgattcttggccttgaggtggctttccccccggaggtagtggcagcagtggaccaggtggttggatgtgttctcaggtctctaggcagcttgtatggcatggcaatggcagtagcagtagtaggatgatcctctgcatcctgagtagtgtgcatggatattgggagtggctgtgatgtgctggacaggcaagtctccaggcccgaggttgcacttgcaggtagatttcagcttatgtggtagtggctgggaagttaggcccaacctcagtaccctgtacggaatgttcaggtacccaaggtggtagattgggttgggcaatctccaggacctcaatctatgtgctctgtctcgggaatggggaacaaagtgaggccagatgggcttttgttcagcccccacagtggtgagaggaggcactagctgtgatgggcaggggcagggcaattcttaggccctaggcagagtgcttgagtgaggggcagtagcagctgcattgaggccctgccactggagaggatttggccatcatcagtggccacagcctggaccggcaggtggggaattgtgcctctttcatgccccagttttagtgaggcttgatcccctaccctggtggcggtagcctgcacctaactcatccgcctgcaccagctgcagcaacccctgcccagctcaccaccaattccagcagcaacttgtgtctccatcttagatctcagcaacacatgtctaccagcactgggtgcttcagctcatgtctcactggcttcttagccttggctacaggagcactcccagcttgccctgctgtcccagcagtaatagcctgagtttccttaatgcctcagtcctggaactgctgggccccaggacagcacgacgtttgtcaaaggctaggtttggaaatgatgccttgctgtagctgcttaggtctcagaaaggatgtggggcccagtgttaagttctctcctaggagcagttccatttcatggtctcttggcagctccctgtgttagtttcggggcttgggaggattgagggcttttcaagtggccagaattgcacaattccacggtggggatgttggctgctggaagtctcccactcacccatttcccactttgggaaatcactcctggctcccagctgatcccagtcagggaggatgcaagaggcaacctcttttcttacttttggtgcttcctgtcccttctttgttgaattccggtgttctcttggataatatatttgaagtgtgactgtctatatactgttctggtttttctaagtggaggagtcagtcatataaactgcttctagtgaaccctccccaactcaaaaagttaatagaaatatattaaacttgctagttaaaatgcagattttcatattaaataaaatctaaccatatgtcacttacagagacacatcaaaataataaagatatagttgagagcagaaagacaggaaaagataaatgagacaaatactggagaaaggcttgggtagctatgctactattaaacaaaataggctctaaaattggaagctttattagtaataaagagcatcacttcatattgataaatggtttaccagagagatctaatggttatgaacttatattcactaataaaataccccgaaaattataaaggtagaaatttagagttaaggaatatgttgataaatccaccaccatgggaaatttcagcatggctttctcagtgatcatagtacaaacataaaacgttaatgacaatcaagatgatcctaatgcattttacaaaattgatacaataaacacagaaacctgcatcaaataaatactacatttgatcaagaaaatgaaagaaaatatctaagaataaataaattaaaaatacaggttagtggttacctctagtggcagggtgggtcaagctggaggacgggattaggaagaaacacacaggtagcttcagtaatactaataatgttccagtgcttgaatgatgtgttcatggtatattttaatatggtagatcttagcttgcatttatattacatatgtttttaccacatctattaaatataagaaaattttgttcctcacatattctcctcgttcttcagtgtgtttcagatttgttcttggtgtgggaggtactgtatttctgaccatatcaggaaagatgttagaaagtgattcatgtcaataccatttgacctagcaatcccattactgggtatacacccaaaggaatataaatcatattataaagatacatgcacacgtatgttcattgcagcactattcacaatagcaaaggtgtggaatcaacccaaatacccatcaatggataaagaaaatgtggtacatatacaccgtggaatactatgcagccatacaaaggaatgagatcatatcctttacaggtacttggatggagctggaagccattatcctcagcaaactaacacaggaacagaaaaccaaacaccacatgttctcacttataagtgggagttgcacaatgagaacacttggattcaaggaagggaataacacatgctggggcctgttggagggggtgggcggagggagagcatcaggataaaaaagctaatgcatggggggcttaaacctaggtgatgtgatgataggtgcagcaaaccactgtggcacatgtttacatgcataacaaacctgcatgtcctgcacatgtatcccagaacttaaataacatttaaaaaataataataaaaaagaaagtgattcatttcctctctcagcagacattccattctggttaatgttagctaagtgcctatcattctgtctttttaataccaacaacaacctataatatgtcagtggacagttagtccttcacaaccacaatggaaagaaagggatatgaactaatccctccaacctctgagaaacctagattagataggtgccttcttttatggaccatctgttctttttaccttcggttacagcatcacagaattacatgattttagtaagtcagcatttctatattttccaaatgaagaaactgagcaacagtccagtaacttagggtcagatacactttctactttcaaagacctctgtagtaaagcccacatttttcctcatactaattctgaaattcagtaaactacaaagcaaaatattctggtttcttatactgagattaacatggctttaacttaaaatgatttggcatcattgggccatgtttcaagacagagcttgagtggcttattttattttccacaaagtcacatttaaagaaactcttgtgaagatgttgaatcctcgtttcttcgtttaacaaatttgtttggggcatttaaaatatgaaaggtaggcactgaaagatgacactgacttttaaacttttttttttgctttccattttgaaataatttcagatttacaaaaataaagttcaaaaatagtgcaaaaatttctgtgtacatttcatgcagattccccaaatgatcttacaattataaaagttataaaaatcaggaaattaacattgacaaaatattatcatctaacctaaaaatcttattcaaatttcaccaattgtcccaataatatgtattttttttcctggcccatcagagaatccatggttacatgatgcatttaatttttatgtcttattagtgacctttaatttggaacagtttttttcattttactagcctctcatgaccttggcactttaagtaagtataggacaattattttgtggaatatgctttagtttggatttgcctgttgtatcctcatgtttgaatttaggttatgccttttgggtaagattaccacagaactgatcttgtctttctcagcatatcatatcagctgcacatgatatcaatttgtcccattgctggtgacatcagctttaatcatttgattaaggtggtgtctgccaagtttctccaacataaagttactattttttcttttgtaattaagtatcttgaggggagatattttgaaactacatgaatatacatcatacatttttcattgcatatttgcccaccaattttactatctagtgatgatttttacctgaagcagttattactatggtattttacaaataataatcatctaatcccatcatctcttcacatctagtagttggaattctactgtgaagaagagcgcctccttatcccacatttatttatttattcatttaaaaatgtatatcattatgaacttttggatgtctttttcattctatgggtcataatctattaccagcattatttattttttgtttaaattattccagtattgtccattggtagcctcttcatggtgacttctgtatctttttattatgttcctatccatttttaagtatttacttgatttcaggcaccacaatgttccaggctcatcttgtactttccctgatacagttctgaaataaaccatttctccaaggagccctggtcagggaataatgctatggacaggattcaaaactttcgacattgcctagagagctgcaaacattcaagtactgaccatgaagatatttgttattccatgtaccaacaaagttgtccatataattttttaagtgtcattttataagactaggtctacaaaaataataatgtagtaaaattaaaattttaattttggcacaccaggaaaaatagccatcacatttaccatctggtttcaatgtattcattttatttttatttttatttttatgaataatttacagaagtaagaataaagagatggtaaaaaaaacagcaaaataagaatttaaacatagcaaaccacgtttttatttcatattttcctgattttggaggtaatgtaacctgaaattggcaatgcctttgaatgcaaataactggtcatgagctgtcgtatatgaacctagaacattatcatctcgtaaatactggctccagattttaaacagatctctagtaggttatagctcatcattatctctggttcttcctgcatatgcattattatcacagtgtaatgctatggagaaatttgagggttcatgattttgtagaaaagaaggtggccatgtttttgtttcacaattacaaaaatattttcatttttacttttataaatgtcaatcagattgagcaacccaatgaacttttaaaatttctacataatgtctgtctgttccagtcacctttacatatatacctaccttcagcatttgtccatttatgaatatcaagtaaattttatcaacaaatactataaaagataaaataattgtcatatgtccttttatcagagcaggatggtccaggttcttgtgcaaaatactaaatgatgaagtccttcctattaaataattaatgggttagaatatcatgtttcctttttgtctttgtaaatatattgtttactctgattctcaagtctgacagaatttatctgaaggactcatagcccaagattttgcttctatggtcagttttacctcatcattagaatctcaagtgctctgtctctgccttcattttctcattcatctaattattgtgaaatatctttctcttaattttattctttatcccattatgggcagaaaattaagaattccaaattcttaactttgtttaatggaagctgaaaagaatatggcaaagatggcatctctagacttcttttataactttttgaaagatgtattacacaacacaattagaaaactgaaggatgatacagtggtgacattcatttctaggcaatttcgtaatttttttttccttattttagttttttagcacaattagaaataattgatgagtgatgatgaagtaatttctagcatgatgaagtagcaaaatactttaaaatacaggaaatataagatcactaaaatatcataatgtatcttagatcctataatgcatcttagatttataaaatgatcaatagactaagtgatgaagaaaatgagtttaacttactaaaaataagtattttttccttttgatttttggaaaacctgtaagaaacaaaagtcatgaaatatcagtctttacaaataattaaaactgctgcacagagaaacctaaaaactgaacttggggccgggtgcagtggctcacgcctgtaatcccagcactttgggaggcaggcagatcacctgaggtcaggggttcatgaccagcctggccaacaaggtgaaaccccgtctctactaaaaatacaaaaattagctgggcatggtggtgggtgcctgtaatccctgctactcgggaggctgaggcagcagaatcacttgaaccccgggcggcagaggttgcattgagctgagattgagtgccactgcactctagcctgggtgacagatcaaggctctgtcttaaaaaaaaaaaaaaaaaaaaattaggatcagtgggccttggtgatactgcaaaggttaaaaagtttgattcagtcacatggtgaataaaaggatagggacattggtaagaccactttttccctaaacctgataatacccaagaagtggatccttaatgaaactaactttttaattttctccttttgttacctggactttatactgtgttcaaaggagcatgaaaatgtaatgagctatcagctgtgagcaaatttattaaatagagtgaatgaaaagagaaccagaccaataatttaagaattctaactagctcaggcttggacattaactagttctgtttctttgggctgactaatcctggaaattatgtgtattggaaagaacacattgttgagtcagccacaacaagaacctgcttctttggactcaagctccctgcctctcaattttctcatgtgtaatagagagaaaaccctgcttcacggggttattgtaagtactaaataaactactagagactgtcagactctggagggctggaactctcttaaccatctttatttttcctgtgactagaagttatctgagtatttattgggtaaattttgttacatgtgtttatgaactgtgtattataaactgtaaaatgtacaattacaaggtcattttgtttgtatcaatacagctgtgttaagtgctctacaaatttaaggtattttcctttatcttaaaaatcctttgggaaaagaaagttatagtttaatcagtgcctccttctacatgggctcatagtttttatcaaatcaaggaaaacatgtaaaaggaaagctttgggacattttctagaatttgatatttaccaagtgtagatttatatttattaagcctcatctctgattattttttaaatggcaggcactaaataattatcattgtttttgtcctaaattagatgactgactggttcataagttcagaaatttcactgtggtgctgtaaattttatagagtaaaacatcttcgtatgtcctctaagattacatggtctaaaaatattagtttaggtttctcactcaataagaatttaaaatttttctggccttttcttttcccttgtcctttaactcatttattacaaatcttgtgagaaattgacttgaataatttcccaaatcttcagtctctttgccattttaatctcaatttcatacatagggagaccaagccttttaagaaatcctggggtgatcatttgaaaattacaccccacttgctaactccccatccccatcttttttggctctgcaagatagcctattcagcaaagggaaataaatctaacttggatttacacatataacttgttgaactaactagttagtttggttagagtcattgttcaggacctgagtataaattaggtgaatgcttattgcagcaccattcaagtttccttgagaagtcacttaggcctgtggcagagaaagtaggatctaaggcttgatgactgtaagtttgatctgctatttaaccctcatggatactagccagagcttgggctatcgataactcttgccttagcatcagtgtatgattgtatgtatgtgagacactctatccttatttgtatctttagttagttgacaggttcatgaaaggtaagaactgtagttagcctttggatgatgttaaagcaaaaatatagaggaaattcctaaattggcgttgagtctagaagggtctcttaaaacacttcaaattgtatacttttattatacaacaagtgttattaccatagtagttccgtaacacttggccgttgactggctgcttatcacctgtgtcacagatcccattctgttatctactcccttagatctttataaacaacgagtggcagaactcagagagtgggagagtgttccctgtctataatccagccacaggagaacaggtgtgtgaagttcaagaagcagacaaggtatgtcttttgtagataaaagatttcctatgaaataactgccttcaaacagcagagcagcaaacatatgctctcagtacaccactacatgctcatgcttcacttttttcatgacagtggatggttcttcctttatttggagtgtttttcttcagttgtgcctcttcctctctaacaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcagtaagtaacctaagaaaacattaagtctttaacccacatttgccattctgctgaaatttacattcttcggctgtattttattttatttttatttattttattttttgagacggagtctagctctgtcgcccaggctggagcgcagtggcacgatttcagctcactgcaacctctgcctcccaggtacaagcgattctcctgcctcagcctcctgagtagctgggattacgtgcacgtgccaccacacctggctaatttttgtatttttagtagagacggggtttcactatgttggtcaggctggtcttgagctcctaaaaggatactttgaagcagacctggggaaaaagcaaaggaataggtaatacatatgaaaaatgagacatgtttggatttggggatcagatggagaaggagaaatggaggatcagctgaatatcttttctcactgaattttgaagagaaaactggagcttgccatgactggtaagtaccttcttttctaaaactccccctccccatgacaaattaaaaacagtcaagcaacaagagagtcaccatgctgcttgcagaaaacgagtatcaaatgattcttatgagaatgaaatagaacaagtttttacctccccagagttaacctctcttgagtaaaaggaatccttcagaaccagaggggatggtacggacctctcatacacttctgctccgtttgccctgtcattctgtgagccagtagaaaggagagacagcaggagatagcaacttcctttcactaaaacaatgattttcctcacataacgaacttctcctgccctaatgggttttgttgttgttgctgtttttaaaataaaagtcaatttcttagagaatataaactttttggaaactgaaagcatttaggaatgtatgcactatacatttgggatctccacctggtatcaatgaatatttagggtttccttgttcagtcagggcattcaagccatgagtactatatcctttcccctacttgggaaaataggtcactattgggcttgcttctggggaaggaatcattttttccctttctcagtgtccctcctaccatagttcttcccttctaccatccccctcaggaatctgttcatagtatgggaacaaaatgattcctttatggaaatggtttgggattctagctatatataacatttatgtgtatataaaaatattttctaatctggcactctagggaatactcttccaatgaggtgtttattcatactgtgaaaaaggtgtttcatggtgaagaaattcctccttgcagattcacaagacactgggcatattaaaggctcaggaaaagcctactaaatgcttctcaagcttatttgagtctcatcaccatttttctggctaacataccaatatcatgcaaaaccaagttttttgggacacattacttgtcttttcactggattatcattttcttgagaattaaacttgtattttacctttttttggtaatcctagcatggttcttagcacataaatggcaaatgagggcacataggttgtcaataaatgactgtttaattgagctaaagatatatgatatctatagcattggattaacactgtgctagaagatgattaattaatttctccagttatattttcatataataaaactcaaatgcctttctttttcttctctgtgtctcactgatcaggtctcttttcctaccacacctaaatgagattcctgttttaaacactctcaagctatgagaaaagtgagttttagtaagaggtagcctgtggaagaaaggggagctcctgactggaaaactgaagctaatcctgcatccaaagtaaacacaattgaaaatagtcctagagctggcaattgtcagtggatttgactggtgtcggcagctcacagggaccatttaggcagcccaaattctggttattgacactattcactctaagctgtgcagatttcggtgctatgctagctgtatagagaatgtaatgcctatcttgtaaacatatacatgttctaaaaagtactaggaaatagtttgattcccttttttaagggtgagccaatatacagtgataagtaacatgatatttttaaataagcttcattttatacacatactaagtagataaattacactggaagtcatagtattttcatctcattgattggagaatattttaattttagctttgtcagagatcaaataattttcacaccagtatgtcttataaaatacacttgtaggaaaaaaagaaaattacaaacatgtttgttaatttcatttgtcgaacttgtaacacctttaatatttctcaagtcaaaatactcttctcatttcagcgtgttcattgtttttgttacggacttagccagttcaggaacatgtcgttaaaataacaatgtttataatgtaaagcagttcaatattgctatttttattaaatggagcagatatttcactcttaataggtaatggttgttaatgtaaatgtttacaaaaaaccagcctttaagttgttaacatctgggcttccctagaggagatcttgtttatttggtggtaataaataaacttgctgtgcaccatggatattccatttctcagcaggggtcttggcagctgtggagaacactttctattctcatcagttgcataaagagcccatgtttctgctcctctttatggattcagattactggtgtagatgccaaaaaatccccagtgagctctgatcattaatataacggaagctgttttgacaagcagaacatttctttatcattagttaaagaaatattgtgttaacgtatttggatagtggttactggaagcacaggaatatgcacatatatactcattgtggtttttactaggaactagaccaaactgacagtactagaaatctttttatttgagaattcatagttgaccaggtatgcaactccatatgcatttgtattctctctcttccttttttcttctgctctagaaattagtgtatcgctggaaagttctggggacttagtatctctccatttctcttccaacagaccatggaatccctaaatggtggcaaaccattcctgcaagctttttatgtggatttgcagggcgtcatcaaaacctttcgatattacgcaggctgggctgataaaattcatgggatgaccattcctgtaggtatgtgaaatctgagtacgttgaaaaggaaaacgtgaaaccaccagaaatgcgctttggccaccaaacacaaacagcagtcacacagaatacagatatgagcacacttacagcagttagaactgagtgaagaaccaaccaaattatgtcactgactctgacaacatccctttttctatagatagaaatatataagtacaggggcatgccacttaatacatcattcatctaaggaagaggtatgtatttgtcagctggtaagtggtcagcattgtgctagattaggtgccggggtaggtatgaaggggcattattgggtggagggaagtcatggaaaattccaacgaggttaagacttgctccttgccctcctgaaacacataagatctactctttggaaggaaatattctaagtgttaacagttgtctctgagtggtgagattatggctgattttcagtgtctttttaatatttttctctactttctatatttctcgaacggccgtgaattactttcataatctatacaaacaacactaatcctaacccctttttattattaagattcaggttacatgacagaatcaacaatacaaaaaacttaaaggcccctataggagtgttataattgggtgctaagttgtgtactttacctgtcagtgctgtagccctttaaatgagagggaaagtatggaagactaaagcaactaaagcagtcagtgaagagatttttatctgtgcttgaatactagtgatagctaataccaattgagtgctttcacagcaaccccaagagaaaggcactgttacaaacatcttcagtttacaaaagtggaaagaggtctggcgaagtaaaattagttttcctaattcacagagtaaataagttttagagctaaaactttgacgttagaacctaggcttgtaaccacttcattagagaattcaaaatagatcctaggaggaagagatatccttataggaaagggatggactgaaagagatagggagtggtgaatagacataaggaaaggaaatgcacatttattgagtggatactagatgccacttagcactgtgccaggtgttctacctgtgttctccagaaggcagtctgctttccatggagagtgcatagtagcaggattggaaagtaatgctcaggacttcgaagtgtctcttttgggccttcttagccaggctgagcagtactgatttactaaaaaagggagtggtttggctgatagtgtggatggctgggaatagttcttctccaatttaatgtgctcatgaatcactgagggtctttttcaagtgcagtttttgactgaataagtctggggtggggcctgagactctgcatgtctaaccagcttctggtcctctgcattgagtagcaaggagaggatgcagcagaaccaagttaggtggctgttgtgatgcctcatgtaggtgtggtatgacaagggtaagaataatttacagtgagaatggagatgatttagagacaagacttccaaggattattttttaaattgcccctacaaatgatgatgacatgtggaatgttagtttttagaaaatgggtttctgattgtaggggctcttcccttccatctagaggtttttcccttgttcaactgactgagaagggtggagaagattgcccttggggaaagtcagaatcttagttcagttctgactctaaggatattacagaacagctgttttccagcatcacttgcaagatgtggggatggcctaagtgaggtagaaagtcactattcgttatgagcatacctattagagggcctgagaattaaaacctttgtcaacagtgggacacatgtcagtctttttaggtgggcctgtcctgtatcagtacagaaaggtaaatttacaagatcaaagtccctagttgttggtttttttggtccccactccacctgtcatttcattattaaaacaacaaatatgtttcaggtgtttaaatatcttttcaaactatttacaaagctctgaggaagattgtgaaacagaaggcaatgcacatagatctctatttggcctaacggtaccttggttttcttttacttcctcaggagggaagatcctgattagataaagctaaatattgattgacatccctgataatgtttgaagctttaatgtaacttgatctggcaatagaggtggttggcccataagcctcactgttttcatctgatgcgttttggagatcctgtggatgcttatctacgagttataaatacagggcatagaaaaggctctcatagggctctcacagtagtctttccccactttactcattaactgttgttcagtcaatgaaggaaaaaaaatgatgaattcttttaaactctaagtaactgtttttccccaaaaagtttttctgaaagtgcatttagagtcatactaggatgaggtaccctccctgccatcaggcctgttggcagaattctcaggaggctgaagtttgggtcataagagctctctccatggtgtctcaaacagatgagggaaggatggaggtagaggttaacttggcagctgtcctctcttttccagttttagatacatttgggcttgcctagaggccacttagaattcagccaacaatgtctttagctagtctagtgcttagtgaatgtagctggactaaatcaggggagtcataggggaagatcacagaaaggggtatcgtaatcataattattcacttgttctcaaatttgttcagtaaattaatccatttgtatttgtcttttgtaactccataatttaacatcagcttcattttgtctctgcatacttggcttttttttttttcacagtgaagtctggaatatagaaagtccgttagtctttaaccatgagatctttattgtgctaaatgcattttcctacaaaacaacctaattttatgttgggaattataaagaaataatgtactttatatttgcatagaatttaaaagtataaaatattcttttatgtacaatatctatgtgattctgtgtgtgatctgatgagatagtctggattttaaatggtattttacccattttacatctaagaaaataagactgcaagggtttagtgtcttgtagaaggtcacatggctagtaagtgggagacgtgagattcaaacttaagtgttgttctgcctaagccatgataaattctcttcttatggagattggttcagcaaggcaggaaggtggccctgatgaagtctttaccccagtgcagatttttatactaatatgatgaagtctttaccccagtgcagatttttatactaatatatggtttattctcatcattcatagtagttatgttttataaagttgtcacgaacactgaattagcaaatacggaactattgctcctaggggaaataaaagattaggttcctgtgagcttctgatcacaacattcttgtctgctgatcagagaatggccttgatttatgtgtttctgttgaaagattctttgtttaatatatattgttgatttatgaacactgaactcatggccaaccagacagaagtactataactgatgcctgaatgaagcttgtgtgacacatgtattttctctgtaaggcacattacagcattcttgcacttaggaacactagacagcactcaacactatgcttaggggccattttaaacagcaaaattgtgaacaaaaggcacaaaaatatgaaaaatgtggtactaaacagaccacaaaaaaggacacttttttttttttttttaacaatatgagagctgaagcaagaaggcagagtgtcaccttgctcaaccccagctgagaatttgtgcatcaggtgactcaaaattttccctgctttggggaaatgcaaattaaaaccacagctgaaccacctcactactgcaaaaaaaaaaaaagtccataatttaaaaataaaaaaaatagatgttggcgtggatgtggtgagagggaacacttttacacactgctggttgggaatgtaaactagtacaatcactacagaaaacagtatggagattccttaaagaactaaaagtggcactaccatttggtccagcaatcccactaatgggtgtacctacccagggaaaataattcattatatgaaaaagacacatgcacatgcatgtctatagcagtacaatttgaaactgcaaaaatatggtaccaacctaactgcacgtcagccaacgagtggataaagaaggtgtggtaaatatgcaccatggaatactactctgacataaaacagaatgaaataatggtctttgcaacatcttgaatggagctggaggccattattctaagtgaagtaactcaggaatggaaaaccaaatatcttatattctcacttctaagtaagtgctaagctatgaggatgcaaaggcgtaagactgttataatggactttggggaaggatgggagtggggtgagtgataaaagactacatattgggtacagtgtacactacccaggtgacagatgcaccaaaatcttggaaaccactgctaaagaacttattcatgtaaccaaacaccacctgtactcccaaaactattgaaataaaaaaaaaaaaatccctgctttggatatacatgcccgtaaatgactctgagaacactctgtacttatttttgggttacaaataaattttaggtagtaggcaagtccttaaatatggaatccacaaataatgaaaatcgactgtatctagagcctacttttctcaagatagcatttatgaagcttaaatgttctggaacacttgaggtggggatctccctgcctagatcctaatcatatgggtaaagggggctttcatagtgagtgtcagagatagtaacacagttctgtttggtcacccataaaaaaagaacctgaaatagggttttttgttgttaaatttttagatgtaagactgctttacaacattgaattatactccatggttcatccagcataacatctctaacactaaacaaccaaaaagaatgggaagaaataagccattatgtctttcactcattcccatttgggaaggctagggaaaggtatcatgtaattggaagggattttcttttacctcctttctgtggcatcaactttgatctcttattccttcacccatttcttcatacattcatttattcaacagattttttttagcatctgctatgtttcagctcctgtattaggcattggggttacaaaggcaaataactaagatgtttataggacagtaagaaaaacaagtagcgaagcaactgcaatatagtgtgatctatttagatatggaagcatgaaatttggtgggacaccataggagagacatctcctagtattaaggcttcctggagagggtggtgggatgtctaagtgataacctgaaggacaagttaagtgaacatggagtcagggacattacaggcagtgggagtagctggcacaaagtatgagggaggagagtaccatgagttagtggatctaaaagtataagcagatatgaaagacagtagagccccaagtctgggtcagccatgctgcaagttttattctgtaggcaatagtgagtcaccaaattaaataggtgagtgccttgatcaaaattacattttaggaattgcatcaaatctgtatattgctttggaaagtatggtcattttaacaatattgagtcttctaatccatgaacatggggtgtttttccatttgtgtcatcggtgatttttttcattagtattttgtacttctgcttgtagagatctttcacctccttaattaaatattgttaggtattttggaggggctattgtaaataaaatgaacctaagtgctgttcaatggatgactggataaaatatatatatatatatgtatatatacacacacacacacacacacacacacacacacacaaatcatgggatactacacagccataaaaattatgaaatcatttcttttgcagcaacatggatggggttggaggccattatactgaaataagtgaaataacccagaaacagaaactaataccacatgctttcacttataagtgagagctaagcggtaggtaaacatggacatacggagagacctaatacacattgggagccttcaaaaggagggagagtgagagggggctgaggattgaaaactacctgttgggtaccacgttgactattctggtgatgggcgcactagaagcccaaggctcatagttatgcaatatatccatgtaacaaatctgcacataaacccgttgaatctatttgaaaaattgcattttagaaagagcactttgactacaaatggataatcagttagagacagcaagtacttgttttatttctccccataaaggatagatttcactttgactacagatggataatcagttagagagagcaaatacctgcttaatttctccccgtaaagggtagccttcaactagaatacttgggaaggagacaaaagggttatctcatgaccacttttgagcaatgaaaaagtgggtggctgcttctctctctgaattggaaatttctcccaccactcttcattctgtttcgctcaaggcccacagctggatgttattgcacaattatgcaatactagtttgattcacaagagtcttgatgttgtttcctttacaacactatccattatttcctgccatggtacccagtggagccattgtctctgaccataaatcctaagctttgacccttttacgatggcagtgcctaattatgatgataaataataatcattactatgacctatggaacacttttttacctgttacattatcgctaatgttatagcagccctaaagaaaagtattgttttctccattttgagtatttttaacctgtattcaaatcctcttctctcacgtctacaacctctttgtgatgaaggaaggatcaacgcttggttttcatttacttagggagaaatggaagttaatttgtattgccttagatttttctctgtagcaagtgttgattttactgattttatgtaagcagaaaaaaatgtccatgttttaagctgaattctgatattaaaatggacttacgatatgttagcatatagaaaaggttaaaaactacccaggtcatatataactttccatttcaccctcttccagtttaacctgttaaagaataggatacaaatacacaaagatagtgattcagatcctaagattttgccttgaatcagcttgatctggtttactgtcattaacaaatgcatagggtgaaatctgaagtattcttgttccatcagaataagagtgaggggtgatttgctctgcccacctaacaacaaccagggcttgcttgttagtgggacctgaattgattgtgacaggaggtcatgaagtcagcttcacaaggaacctttttaagaggttgaagctgaaaagggcctcagggatccctaaggctgatctcctgattttacagagaaggtccagagaagtaaactaacttttgttacgatcatgtagtggaatagtcgtagagctaagctatcttcatgacagactcaggaacataatctaacttcttagaaactaccagcagacttctgggaagaaaagcatcagtacacttcatactaacatacagtttcagcgtttgtataggcatttatagagtttatcatcatagttataaaatgttgggtgaggtctgttcaacgtcaacatgatgggaatctgctacagtacatacataatggaatagttcaatgtaatcatctcattttttaatactgtggtcatcaaagaattgccagctccttgaaaggtaattctgtctacaaattagggattggaagatgaccttcattcactgaattgtgttacagatttttatgctattgaataaaatcgtttttattgttactaggtatataaaatttgctacagttcttgtagtgttcttagtgttataattggaagctatttgacttccatatttgacaaatttctcaatttctggcacatttcagattcttctgattttatcactgtttatagattgcttagtcatactcactctagtttatattaatatataggatgtgccaatgcgagatatttttatgagactaaaaattccatcagtttctttcaggcaactgtaagatctgatttaagaagtaatgtttgccttgaatgaattatccaaataattaaatttttctaattaaatatttctctctcttctgtgtagtttgataaggccccatcaaaaaacatagaacagtggctcagtagttcgcaaatatagtagaggcttattgtactgttgatctctagcagcaagggcttttcttaatataattatagaaatggctcaatgcacacatactcagtaaaatttaattcacagctcagccaaattcatagcctaatgaagtatttaattgtaagatttttatattttccataagttgtaaactactatttggtcattaaaagcacccaggtatcaaaactcatcagaaaagttacctctgactgggtcttaaaataacccccctttaagagcaatatctgttagtctgcgttttaccttctgagtgaaagggaaaagagacagagatcaaaagtcctacacgtgtgacttagtatttgttttgatctctcatcttttctttagttttctccatcatagttgtgttctcacctattgacctacaatgtggtatccagaacattttctggtgtccccatcaaatgcagtccttttttatgctaagtctgagcgctctctgtaatccctcatatttgctaagaagatccaaaaccattcataccctacaatggagtatctgaatttgggtggagactgtttttatatcaggctgttgagcttacagcacaaagctagagaaatgaaggaaacaaccttctaagtcatcctgccatactgagagaccattgttagcataaaagatggaaaattggctttaattttttctaggcagagaagagtactcattatgtatcatctgaggtatagatgagagggagaattaacactgtctccacttcgagttggctctgcctagatgaaagggagagaggcgcttagtcctgggctcacctattccagggaatgtttctctgtagtgttccctttataacaagtttccatgtgttctgtgttcatattacaaaagagttgtcattgaggttttttctttgtttatttttaccccatttgtgattgttcttgacattatactctaattctgtgatttgtgattatccacctaaatccaacaccttcctcacaagagtcattaatatgtttttatgggtaaagaacttgaagtctgaagacccagatccaagtccaggagcctcaaccagtggtgccactttggacttaacctctctgtgccatattttctctgtttataagatgctgataatgatagttgctctatttttttcagagagttttgagtgtaaaatgagataaggatgtgaaaattataaggctctacagaaattctaatagtgttttcattcttttttttttttttttttttaacaattttgaagtattaaaaatacagatcagattctcctacactatatactcctttcaggaaaattagtagagttattagagagacaaaaaataaataaaaatgaaggcagacaactgtgaagcaaccatagggcatcataatacacgtggactcccctttacactcctgatcttgctactcagagtgtggtctgtggatcagaagcatgagcctcagctgagagcatgtagaaatgcagactctctggtcccatcctagacctgttgattcagaatctgtatattcacgagatctccagttgcttagtgtgtacattcaagtttgagaatcaccatatagcatcccgtgtagcactggtagcattcaagatgattctatacagtaagcaagtaaacttttttaattttaattccttggtttgaagaatattagaagaaaatattaccagcccatgaaacctgttattttagattttagattttccttaaggctaacaggtagctatttacatatttctaacaggtgagttaatttaacagaaattaagtaaatgacagagcaaatgatacttggaaatggcaaaaattatgaaggtggcttttataactggtcttacggtaaccctgatttagaagttcagtgggattcatagtagggtcttagtagctgtgaatgacttctggggtgctgttagccctagctgaaggtgcccacagaaggcttagctcttgtgtttgtcagacaccccagatcagactaggggtgtcacctttcaccatccacgtgaaaatgcaaactgagattacaaggtctagggccctttattttattttagttctggattacctgtgcaggtttgttacacaggtaaacgtgtgccatggtggtttgctgcacctgtcaacccatcacctaggtattaagcccagcatgcattagctatttatcttgatattctgccttcccccacccctccccagaaaggtgccaatgtctgttgttccccttcctgtgtccatgtgtgttcagctcccccaatacatgaaaatatgtgatgttcggttttctgttcctgtgttagttcctgtgttaatggcttccagctccatctattgtccctgcaaaggtcatgatcccattcctttttatggctgcatagtattccttgatgtatatataccacattctctttatccagtctatcattgatggggatttgggttgattccacgtctttgctattgtgaatagtgctgcaatgaacatacacatgcatgtatctttataacagaatgatttatattcctttgggtatatactcagtaatgggactgctgggtaaaatggtatttctggttctcggtctttgaggaattgccacactgtcttccacaatggttgaactaatttacattcccaccaacagtgggaatgtaaacaaagtgggaaataggaacagtgttcctatttttccacacctttgccagcatctgttgtttcttgactttttaataattgcccttctgagtggggtgagatggtttctcattgtggtttagattgcatttctctaatgatcattgatgatgagctttttttcatgttttttggctgcgtgactgtcttcttttgagaagtgtctgttcatgtccttttgcccactttttaatggggttatttttttcttctaaatttgtttaaattccttgtagattctggatagtagacctttgtcagatgcatagattgcaaaaaatttctcccattctgtaggctgttcactctgatagttccttttgctgtgcagaagctcttttgtttaattagatccaaattgtcaatttttgcttttgttgcgattgcttttgacattttcatcatgcaatcttgcctatgcccatgtcctgaatggtattgcctagattttcttgtagagttttcatagttttgggttttgcacttaagtctttaattcatcttgaggtaatttttgtataagatgtaaagaaggggtccagttttaattttctgcatattgctagctagttttcccagcaccatttattatatggggaatcctttccccattgtttgtttttgtcaggtttgtcgaagatcagatggttgtagatgtgtggtcttatctctgatttctctattctgttccattggtctgtgtgtctgtttttgtaccagtaccatgttgttttggttactgtagccttgtagtatagtttgaagtcaggtagcatgatgcctccagctttgttctttttgcttaggattgtcttggctatatgggctctttaggttccatatgaaatttaaagttattttttctaattctgtgaagaatgtcagtggtagtttaatgacaatagcattgaatttttaaattactttgggcattatagccattttcatggtattgattcttcctatccatgagcatggaatgtttttccatttgtttgtatcctctctgatttccctgattagtggtttttagttctccttgaagaggtccttcacttcctttattagctgtatttcttaggtactttattctgtttgtatcaattatgaatgggagtttattcatgatttagctctctgcttgtctattgttggtgtataggaatggttgtgatttttgcacattgattctgtatcctgagacttagttgaagttgcttatcagcttaagaagcttttgtgctgagacaatggggttttctagatataggaccatgtcatctgcaaaaagagacagttttactttctctcttcctatttgaatgccctttatttctttctcttgcctgagaaagaactggccagaacttccaatactatgttgaataggagtggtgaaagagggcatccttgtcttgtgctagttttcaaggggaatgcttccatcttttgcctgttcagtatgatattggctgtgagtttgccataaatgactcttaattattttgaggtatgttccatcaatgcctctactttattgagagtttttaacctgaaggaatgttgaattttattgaaagtagcctcctttctttgtcccttcaactcagtgctcttttgggaagagttcaagcacaaaaatagcgtttattttttaatttgctacttagactaactgtagggactagaagattctgtctctttccctgtgttagcctgtagctaaatgcttttcaaatatgtgaacggtttatccaagagagttttaattcctcataactcagtttctcttgagacacaattatggagtcaaactcaattcctcatgaggtccgacttttaagatttttgtctacattttcttccctttcacttttttcggtaacttgtgatattatttaagtaaaacaactaaatgtctaagcatcataaaatgtgtagggggaaatggtttatgaattgccatgcagtgcttgtgtagttgccttgtgagtttttttttctgaaccattccaggttcctacatgtgctgctaaaataaacacgtgtactcttctgttcatcttccaatttttttcctcagccccatttgcactctttcttgacattactctctgattctgtggtctgtgactatccacctgaacccatcaccttaaccaacttagagagttcagttgcagaagattttcttgtaaatgaaactctagcttattgatcagtggtgttgctcctcatgaaaaaccttttcagagatttacaaattgaagaagcatggtaatttgtagtcttgtaaagaatgatatccagaagattctttagttatctgcatacaaagctaaatagttaatttgatgtttaaagtattactcagacttcatactgtcatcctatggacagttgcaacatcttcgctattttttctcgtaatagatattttaaattaatttcatacagttgcagaatccagcctacttctgaatttcttccatttaaaatatacataaaacaaagtcaagagataagtagcagattggggaaaaatctttgcaatattatgacagaggcctaatttccttaatatccatagagctcttcaaatggctaaaaagaataacccaatagaaaaatagcaaacaatataagcatgaaaagatgttcactctatcattaaacataaatcaaaacaagttgcagttttccagctatcagattagctgaaatgaaaatgttggaaaaacctcagtgttaaagagtaggaaaaatagcgtgttgttgaaattatgaattgttaaacttttctgaagggtgatttggcaatatttttgaaaatctgaaatgtacatacacttagatcaagaaattccacagatatgaaaagatatgtttgtaatgatagtctttgcagcattatttataatagcctaaactgaaagtgacttctatgtcccttagtaggagggtttacagtagtaacattgtttattgagcccatggaataacctgcagccactaaaaagacgtcctagctttacaggaaaaaaaaaaaaaagagggaaaaacaaaatataaaagactgaataatatcccgtttgtataaaaaaaaagaggataaaaggatcctataaatacttgtatgtgaataaaagttccttgaaaagaggaaacagataattatggcaagagggggtagagatcagagatccagaggatagagagtgacactgggagagtaagagagagagagagagagagaggccaagactttaatgtaattatttaaaaaataaataattttgaatatgtcaaaacaattttgtgtgataaatgtgatttaggtgtgttgagagacagtgataaacaatctgattcatatcgcttctcttttcccgacccacacagtcctcctgtccccaccttcatttccacctataatagttatgctttcatgaatattagctgagtgttttcacttgccttaggggactgcttttgagagagaaaacaagtatcagtgaagtggcctaagggccggcagtggagggaaaaataaagactttgcccagtatttaaaatgaaaagctatctgctaaaaatgagccattctttggtaattttaattaaccatttaaaataattcagataaaagcaatgacattttcctaaagatgaatttggtttggacttcctgtataattatttcagttgcctattactcctgtaaggaaaacaaggttattaagtttttctgaagctctttttcttttagcccctaggacattctcatttctatgtctagtttgggggcagacgctttggattattgatggagttctttttagaaatggacttttaccttctttaaatagccctggacatgcctatgtctcatcactacccaggaagtacattttgacacctggattgagttatgaaatatatcttttactcctcactttttccagttgccgagcattttaaatttgcccaatagcattttacttagtttattttaatacttcagaaagttatttaaaggtttgttgactcagtttttaaatcaaacaactgttctacatgttattttaatatttaacataaaattcaatttttacatatttttcagctgtcccctctgccaccctgaggacttcttgtatcataaatttgtcattcattttgccttagagatcctttcctcaatactgcatttgggtgtctgagagatatatccagaaatatgctatgtccagtgttaggcttctaccagctttcatgcacggttgagtaggatgttttttcaagtttatttctgtttgtttttttttttttttttttgcagccaccaaagttctccctttgcattttttttcctaatctaaactttctgggagtgaccatgcttttttctttcagatggagactattttacctttacaagacatgaacccattggagtgtgtggacagatcatcccagtgagtgtatttcctcgcacctcgtatttattttcatttgacccagttctcttaaagacacataaaacatggtcctcagcgatgtgtgttttccattactggaggaaaaaaaactgagctcatgttgttgacatatctttaacagcctccctgcaaatgcttatttgaacaggttaatagggtttcagctctgttaccaggagttgaattctcaagtcatggaattctcatgattaaaataagcaaagcacagtgtattaataacctgcccttggttattatgtccattctgcttatggaaaattaatgctttgttatagttgtttattttttagaactgtgactcaccatccttccaggcatattattttatatgatcttttaatcccattctttcccactgtttcttttctcaagaatctagatagaagatgctacagaagacacagcactacagttaacgtcacagtcataattgaaaccatgccgagctgttatgtgtcttgtaaagagaaatagatgtagtgcttagtgtttggattggaacattaaacattgtccctttgttcctgtctgtctctcatacacacccttggtacaatacaaaacatgaccgtagcttttaacagtactagctaatagttctggcagggatttcaaggggatgctcaaagtaaactcttacagtatagacaagaagttttcttttttcaaagtacagtagtataactcaagataatctttggcattgggaaccaaagatgtggggaagatataatatttatttgaataattgatgaatcccaggttactgtgaaatttattagagaatgccaagggaaaatgagaggtttgatttaagttctcttgctcttaaaggccctggggaaatcctacttggaccagctctgggatgaggtctgtcaccttcctcgtaggattcaaacttacttttcttgcccttgcccagactctcaacgctgcagcttcactgacaggacaagagctgcttgtcagccagctctggctcaattactgcactttaagatttatacactgtagatggaattaaaacattacggtggactcccaagtttataaacaactaaggggaaaagaaattgggtgtttggtgaaggcaagacacttgtatatttttgcaagcttgccagagccagtgagaagccttgaaggatggcagctgagatgcttcaggcagaaacacattgtggtcaagggctgaagccaggggatgaggatttctgttttctttcttaatgaaattatcaatgacacctgatagtactgaggctcatgcctgagcttatgacaatacaagcttaatatctttttaaaatcagtttaaaccattttagaccccaacctcatctactcatgtaaatgttactgtagtctccaatagcttcttttacagtggaaaagagacaaatgaaaatttttgcatactcatcagtatatgcagtttattttttgtaatcatatatgtttgtgacaatgcatgtatctaaagaaaaagtactaccttgaaatacacattgacttaactacaactcagttagaattttctagtttttccatgttgaagagctttcataccagtgtgaaaattgtgatgtaaaaatctcagatgcaagaaaagttttcatacacgagaacttattggaaccaaagcctaattaaaaaaaacataaaaacagtgacaaaacaaaacaaagaagtaacaaaactcccttttcacagtgggatttcttttggtgggtagttggagtatagtaattggttggtcagagagaaaaggagagatttccaaggtcagtgctattctattcttaatgaagtaattgaaaatccaaacatctgtactttgtagtggacaagatttatgtcgaggactagtttgagaaatatgagaagtcacagcttgaaaacaaagtagtggaagaatgtttttccatctatcaactttgagttttttcctttcagtggaacttccccctgctgatgtttgcctggaaaatagctccagctttgtgctgtggcaatacagtagttattaagccagcagagcaaacaccactcagtgcactctacatgggagccctcatcaaggaggtaagagaaacggacttcgggagtgcttctgactccccttacagctggagcctactagagcatatctcatttaacatgatgcatcagctttcatcagccacgtttcctcctgttctgttttcttaggctggctttcctcccggggtcatcaatattttgccaggatatgggccaacggctggggcagcaatagcttctcacattggcatagacaagattgcattcacagggtctactgaggtaggtatctgaaaaaccagggcttgaggaacagtcttgcaaatgagttgaggggttacaaaaacaataaaactagtacccataggctagacaccaaaagggcagtgagtacccaagcccacaaaggataacattggtgtcatagaacactggtggatgtgaaagcaaaggcacacagggaccatttgaccccacagatatctgagcatttttgtgataccatctgtgtaagaactatcccagaatgtggggttctagacactttgttgaatagcggcagaagcaagttaagaagctggaaatctaaactagtctctggtaaggataagaatggagacacaagctttcccttctcattgtttggacaggtccggtaggtgcaattggcaactcactataccccatgaaccttaagagatgatatagagcagggctcagcacattttttttctgtatagggctagatagtaaatgtaaattttggaggcaacgtggtctctgttgcaactactcagccatgccatagtatcaccaaacagtcatagataatattgagtgtggctatgtgccaattaaagtttatttatagacatggaaattggaatttttacataatttgtatggattacaaatgctaatctttttattgtttctagacatttaaacatgcaaaaactggttttagcttgtaggccataccaaaacagcagggtatatttgacccatgggccatagtttacagatccctgttacagagtcacaagtcagcttaagaagatttataaatgttactcaaatatctctgatccaggtaacagatgataggaaagtctgattcattgtttcaagtagaacctcacagatgatatcatcattgaacaaaggatgtccgcaggtctagaacagtgctatctaatagaatgagagcaacatttgtcatttaaaataagctagtagccacattaaaaaatacgtgaaattaatgttaataactttaatccagtattttcaaaatattgcaacatataatcactataagttattaatacaatattttgcattctttttcatatgcattctttgaaatatggtatgtgttttacattgacagcacatctcttcagactagccacatttcacgttctccattgccatgcgtgctaccgtattggacagcacagatctagaaacattttatcagttgatacagagttaattatacttggttaaactgactcacagtagtaaatttaataaaagatttattaataaacttgaatattaattcagttagattactgagttttgtgtttgtcgagttaaccttgtttgtttccaaatattttattctagttgtatttgttattgtaattttgcagtttaatgaaatatttaaaccaaaatgtgagtatgaaagggaattattaattattctgaagtttaatgctttgaaaatatttgctaaaggctagatgctaagaaaaactaaagatgcaatcaatttaagacaactgtaaaagactggggaaaaatataaacctagatagaatgggcacctggaattgctttgcaaatgttcttaagtccttacttcactttaaggaaattgaaaccagaaatcataaataataatttaggggtgtgatttaatcagaagagacaggtggacccatgattaagtaaagttcttggttctatatcaaaagactggagaaatgaaatatttaaagtatctttttctgctttaacctttttctgttgaccaaccaatggtcctgattgagtcagtcaagaggcttctattgtgtaatttttttttttttttttttttgagatggagtttcactcttttgcccaggctggattgaagtggcacaatcttgtctcacagcaacctccgccccccaggttcaagcgattctcctgcctcagcctcccaagtagctgggattataggcacctaccaccatgcccggctaattttcgtatttttagtagagacgggggttttgccatgttggccaagctggtctcgaactcctgtcctcaggtaattcacctgccttggcctcccaaagtgctaggattacaggcatgagccacggtgtccggcctattgtgtaactttttaaattaaaaatgacagcataatatgtcaaacaagagataacaccttgtcatgttagtacctacatctccggcatttatttttaacagctgcatagaatactcttgcatcagtatatcatcatttaatcctgtattaatgtacacttgagggtgttttttccactaatttttcctattaaacagactgctgaaataaaaacctttggagacccaagaaaaattttacttgtaaatctgtaactgtatacacatatgtatatacgtatacacacacgtatatgtgtacatattagatgctcagttggatatggttctagaagtggaattgcaaaataaaaacatatttacaacttgcttaccaagaaggccttagagtattggtttcatttataagaggttaggtatgttaatcttttgtttgttgtagaatttgaaaatatgtttgttctttgctttttaatttttttaaaacagttgtttgccatgtgcagattttaaattctcatgtagtcttctcctttagtctttttctgacagcttctggatttcctgtcatttttgaacaaacccctttaagattatacaaacggcccttaatattttctttcagtacttttatggttttgttgtttaaatctttaatctggttggaatttattttcatgtataatgaaaggtgagggttgtttgtttataaatgaatgtttagttacttcaaaacaatttattaaacagtctacccctttgcaactcatctgaatataacattacatgatgcatttccatatatacaggttggagcaaaagtaatttgattaatggcaaaaactgcaatgacttttgcaccaaactatacaggaaatttctgttttagagctcataattttttctgttctttcactagtaccagactgccttaattactaggttttataagatgtgttactataatataggcaacataccctcttatttggtttttcaaagcccatttattcttttagaagaaatttcaaaccgattttctaagtaccttatgttactctaaaaaactttgattggaattttgattggcataacattacatgtccatattaaaatgaggaaaaatgctatctttaccatattgactcctcatctaggaatatgatataatatgataaaaatcccttcaattatttgttgtaatgttcatcactgatgtcatcatataggtgttaggaatttcttgataaattaacttctagcatttaatgttttcttccaagatatttcagtctaaaaacgagtaacatttttgagatggagtcttgccctgtcacccaggctggagcgcaatggcgtgatctcggctccctgaaaccgctgcctcccgggttcaagtgattcgtagctgggactacaggcacgcaccaccatgcctggctaatttttttatcttaagtagagatggggtttcaccatgttggctaggctggtcttgaactcctgacctcatgatccaccagcctcagcctcccaaaatgctgggattacaggtgtgagccactgcgcccggcacataagtcacaatatcaggtagtggaagttaaattgaataaatggaatctcctctttcaggccagacaagaagccacatagtgagtccataaaaccataagtgcttattgcaaggcagcttgggttcaaatctgttttgccactgaagatcttttaacgttttaaatgactttactgaagtataatttacatacaataaaatgcacccatttaagtaccatgtatatacacctgtgtaaccatccgaatcaagatgtagattgtttccatgccttagaaagatttctcatgcctctttgcaggtaacacccttggcttctggcaaccactgattctttttaattatttttgcctattctagaatttcatataaatggaataatatctactcttcgtgttttcatttttgttgttcaacattcaatgtattaatgatatggtcgggtctaaaatcccccattttgatttgttttctctttgtccatattttccctctttgtctgccttcttttggatgagttagataattttaccactctttttattctattttgcattattagctgtacctctttttaaagtgtttgctttagtgtgtacaatatgcacctcaatcacagtctaccattaaatactttatgttacttcatatacagtgtggtaaccatacagcagcattgttccaatctcatcctttgtgttattgttgccctataatttacttagacataggttatatgccccacaatacattgctgctgtttttgttttaaaatttgttttttgaataagaatacaaaattattgtctgtttactcacatacttgctattcctggcctccttccttgtttgtgttgtaggcccatttccttctggcataattttccttatctgtaacgatctttaacgtttcttgtagcgtaggtctactagtgatgacttctctcagcttttgtttgtctaaaaaatggcttcattttgtcttcacctttttttttttttttttttgaggggtcagcctcactgtcgctcaggctggagtgcagtagttgctcaggctcactgcaagctctgcctcccaggtttgcgccattctcctgcctcagccttccgagtagctgggactacaggcacccgctaccatgcctggttaatttttttgtatttatttttagcagagacggggttccaccatgttagccaggatggtctggatctcgtgacctcgtgatccgcccgcctcggcctcccaaagtgctgggattacaggcatgagccactgtacccggcctgtcttcactttttaataactaacttttttttctggatataaaattctaatgtgacagtttgtgttttattttactttcaagacttcaaagatatcattctggcatgtttctgactttactgtttctgatgagatacagcaatcattgttatctttattttacggtaagtaatgtttcttttcccccagactgcttttgagagagtttctttttgtcagttttcagcaatttgattgtgatgtacttttgtgtattttgttggttcgttaaaatttctgtatatctgtgagtttatagttttcatcaaactgggaaacattttgaccattattttttcaaatcttttttttttgctttctactttcgccttctgtttacagatatgttaggtcatttgtcattatcccatgggtcactgggactcttttatttccagcatttttttcctttgtgcttccggctaggtaactttcattgtcatctttgacgttcgtatattcttctgtaatgcttaatctgcttcagagattttgttaagttctagaaattccatgattttttaaatatcttatattttcttcctcgctacacccctttattcctttaaatttgtgtagacatctattttacaatccttgtctgtggccgggcgtggtggcccacacctggaatcctagtactctgggaggctgaggcaggtggatcacctgaggtcaggaatccgagaccaacccggccaacatagtgaaactctatctctagccaggcgtggtgttgcacacctgtagtctcagctactcaggaggttgaggcaggagaattccttgaacccaggaggcagaggttgcagtgagccaagatcacaccaccgcactccagcctgggcgacgggagtgagactccatctaataataataataatataataatgaaatccttgtctgttacttttaacttctctgtcgtctctgaatttgactggagtttttcctgtttatgggtccttttttttttttttttttttttggcttttctgttaattttgaaaggatactggacattgtgaccattatattgctgaacttagagattttgttgtttttctttaaagaatgtcaaactttttttttcctaaaaggtagttaagttacttgaggttcagcttgtctcttttggaacttacctttaagctttgttaagactagtttattcttattaataagctgaaatccttctgaggtttctgttgaatgtccccagtgttcaacaagatctttcttatctgtctggtcagaattcagaccatcatattctgctttggtctcctcataccatactgcaatctagaaagtttaggcacaaaaggatttccttttctctagattcatagtcccatactgcctgatatccaatgtttgaataaaacaatttcatatacttttctagttgtttataatggtaaaacaagtccagtgtcggttactccattacaattagaagcagaagtctctctggcaccttttgattaattttgatattgtttgattttctttaggtttcatgcagatcacctttacagttaatgaggttactattttatttacttcagttggtcaaaccaaagtattaggaatacaaccataaggacatactggatttggaaaagcccttgatttaattaattaatattgaatatttaagcagtactttactctcataagtaactcctttttcatctttgagctgatttgcttatcagtttagtcttgatttttataagttttactttcaaaagatggcagtttctggtcatatatgaagatttgtggggaggacattctctttggagtctatcccttaggccttctcagtacctcaaatagtatcttatgtatagtaaacatacatagtaaatatttgttgctacatgaaggaggaaagactgaatttggtaaataaaaacttaatctcagagctagaaggcgaggtatcagtagaaccctcccctgctttaaaatgccaccataagcatagggtttactattttttacttcatagctatataattatggaccagccacttggttttgtacaaaattggtttaataatagcatacatacctgtttctcagggtcatgggaattaaatgcaatatgagtttgggaaattttaagcagtaagcaaatgttagtttgtaatatgacatcagcatctcaagaagggagagagctctaggggttgggtggtctatcaaggtttcaagagaaagagggatttgagggtctgtaggatatagataagtagagtgaattgggaagaaagggcagtgttagtcaacaactcgaagcaggagaacacaaagtcttagtggaataacggaattgggaagggactggggagaaacgttgggagtcagatgaactgggaaataatatgcacatcaaggcattggaaataattctgggtcaaaaaattgtggccaacatgtagaagataccacagacaaagatatcacaagaaaactatataccaacatcttatgagtatagatggaaaaatcctcgacaaaatagtagcaaacaaaatccagaaatatataaaaatgattatataccatgaccaagtgggatttatcccaggaatgcaagattggttttatatatgtaaaaaaatcaatgtaatactccatagtaatggaataaaggacaaaaaccaggtgatcatcacagaagaaacgtgacaaaatctaataccacacagaaacatgtacaaaaatgttcacagcagtattattcctaattgccaaaaagtggaaacaactcaaatgtccattaaatgataagcggattaacaaaaagtggtctatccatacaatggaatactgttcacccataaaaaggagtgaggtatttatacatgctgcagcctgaatgagccttgaaaacactataccaaatgaaagaatccagttacaaaagactgtatcatgtgactgtatgaaatatccagaataggcaaatctataaacagaaagttgattagtggtttcaaaggactgggagaatggaaagtgactgctgatggaatatgaagtatctttttggggtatttatgtcctcagatagaagtaatggttgtgatggatgcacaactctgttaatatactaaaatccactgaattgtacacatcaaaagagtggattttatggtatatgagttatatctcaagctgtgaaaaatcaattaattttacaaagtattaaaggctttacattttggatattaatagccaacattgatttagcacttactttgtgtcaagtacctgctaaatgctttgaatacattattacagcaaccctacagcattgagcaaagtgtggctaagaggggttacattacctgcccagggttacatgctagttagttgtagggccgagagtcacacccagggcctatattccatattacagtggtacactgcctcccaggctaagggactatacaccctcccataggggagagccattaaaattcggaatgacatattaatggaggtacttaggaaggataatttctcagtgcagcatgcttaggtcatagacacattgtaactcctttttttcctaaaattcacttcaaaattgcatctttagcctctttaaattccatttgttacaatacagggtttccatttgacactgtctgatataggacatgaaaatttaaaacttaagttgtttccagtcaattccacaaacatttatcaagcacttatagatcttggagaggcaaaggtggtgttttatgtgattcagtctagcccaagagataatctgtgaatatgtaactattagagtgtggtgtgttatgggagcatggagagaagagaattctctgcatcattacctaaaaatgtcatgattttcaagatgataagatcaaggacaaaactaaagttctgtcatttaatataattttcaaatgtatctgtatctaggagaagtgtcatcagttgaagatatttacatttgaatgaaaagctactttattcaaagataaaagtattttaagaaaaagataattctccatcttaattccacagttgttaatagtcacaactggcaagaatttaaggctgtcttccttttctcttaacattaatctctttggagaaaatggaactgtagttttatgggaaccaaaatacaaaaagaaattcgaggaaaggaatgctagctgtgaggaccctcgtgagtcctcagggactcacaatgtgttatttgatattggcagataatcaacaaatagtggtatcatttattctcaacatcatttcctatgccagatattaaagaatcagcactttgtaaaagctcgatacatattttgctggaaggtaggatgggatattaggtttcactgtttcctttcaatagcgaatgcagttttgttgtcattcctgcagttgtacttttaacagtcatttaaacaccagagctgcagattttttttgaattcagtgtctatccttagaagtctctttaataggatgtgaaaaaccttatagagatgggaaaataaaaacaaacaacacatccctaagaacctaaatcataccagatgggacatgttgagaagggtagtgtgtgtctgatttcctagggtcgttaactcttggtaggtgagccaacactgaacatgacatgctcagtgactgctaaacatgtagcctcagtgttctagtgagagtagttaatagtcagggggtaccaaagtgtgtaaaagctggagaaaatactaggctttcctcaacagtgatttcccatgaatcatctttttacacttcagattatattattcttaaccacattgagggcaagtaatgtccatctacaaaactatgcagatggcttgtcataagcaaagataattcccaagctgaacagtaaatgatcaatctgattaagctaattatcaacaaagaccaacccataaagtttaacgttactttaggatttttacagcattaatgtagttcagcctgagttaatttctcttcatcctttacttagagtctcttaaaagaaaacaaagtactcctcagtgctttcttaaaatgaaagtttgacagaatagtatatcacaactctatagtttgcgtctctctaaaccaactaaaggaaatcatcactttttcagtaagttttgaacatagtcttcaaatcatactaaaggaatcaagattaaatatgtcagtcatatcagaaaactagacaacttaaacatctattatacttgagtggattcattcacattacatgttattatttaatctttccaggcctcagatatcccagctgtagattagagatgattgtacctacctcatggattgtgaggatgaaagatgatttgaatgtgttccccagaaagagtgtgtttgttatttaatctacaatgcaatagtgttgagagatgggcactagtgaggggtgttcaggtgggtactaatctgttaacccacattaatagattaatgccattataaaagggcttgagattgcacattgaatctcgtgctgtcttgtcgtctcttgctcttccatctttcaccatgggatgacaccacaggaagtcgttcaccacatgtgggtctctcaaccttggacttcccagcctctcgaactgtaagaaatgaatttcctttctctattaggtatccagtctgggacattatagctaaactgaatggactaagaaaagctagtatatctagagtgtttagcactggatctaattcttagtaaagtgtcagtaaatattaactgtcattgttttctatttatttttaaaatgaagtttatgggacaattaatgcttggggaagtgtggtataatagatgaggcactggatttgatccacaaatcatggatcaaattccagctttcctgctgtgtgacttttggcgaattgtttagtctgttatttcatgtcttcttccattagtaaggcctatgaatcactccttacaggctcatttgaagattgaaataatgtatttgaaagttccaagcatattgcttggcatatagtaagaattcagtaactattaggtgaatctgaaacttccatttgcaaataatatatttgtcaataactacattctgctctcctctggcagctttactctcctttcgtttattttgtagcttttgtaaatattttacaaatatttttggctaccagtcagtgtttgtgtgtgtctgtgtgtgtgtgtgtgtgtgtgtgtgtgtgtgtgtgtgtttgctcttctatttcacttcttggaagactgccttcgtgcttgcttggataaaatgatgatgaatcctttttcttttttggtaaaatagtgtactagatttagaatacagtgcaggaacccaggagctggttttttgaaaagataaacaagatagaccactagccagactaataaagagaaaaagagaaaagaatcaaatagacacaataagaaacgataaaggggttatcaccacggatcccacagaaatacaaactaccatcagagaatactgtaagactaaaccaggaagaagttgaatccctgaacagaccaacaataggctctgaaattgaggcaataattaatagcctacccaccaaaaagaaaagcccaggaccagacggattcacagctgaattctatcagaggtacaaagaagaggtggtaccattccttctgaaacaattccaaacaatagaaaaagagggactcctccctaactcattttatgaggccagcatcatcctgataccaaaacctggcagagacacaacaaaaacagaaaatttcaggccaatatccctgatgaacaatccagcagcacatcaaaaagcttatccacccctgtcccgtgtggccccatcccgcagcctgccagccatgagttccacgcagttcaacaaaggcgtctagtatgggctgtcagccgaggtcaagaactggctcctgcccaaatatgacccccagaaggaggcagagcttcacagctggatcaagggactcacctgcatctccattgagcctgacttccagaagagcctgaaggacgggattatcttatgcatactcatgaacaagctgcagccggcctcattccccaagatcaaccactccatgcagaagtggcaccagctggaaaacctctccaacttcatcaaggctgtagtcagctatgacatgaaccccatggacctgttcaaggccaacaacctgtttgagagtgggaacatgaggcacatgcaggtgtctctttttgccctagcagggaaggtcaagactaagaggccgcagagcggggtggacattggcatcaaatactcagagaagcaggagcagaacttcagtgacgccgccatgaaggctggccagtgcgtcatcgggctgcaaatgggcaccaacaaatgtaccagccagttgggcatgaccgtgtatggcgtgaagaggcatctgtgtgaccccaagaatcacatcctgcccccccatggaccactcgatcattggcctccagatgggtacaaataactgtgccagccaggtgagcatgacagctcctgggacgcggcagcacatctgtgacaccaagctgggaaccgacaagtgtggtaattcctccatgtccctgcagatgggctacacccagggtaccaaccatagtagccaggtctttggcctgggccagcatatatgtgaccccaagtactgcctgccaggcacagtggctgacggggctcccttgggtgctggcaactgcctgggcccaggagaggtccctgaatatcccccttactaccaggaggaggctggctactgaggctcccagcacactctctccccacattatctccctttctgggtttttgggtttttctgtgttttcatcttttttttcttaacctgttcagtgctgccaatcaaccgagggtctgtgagtggcaacgtggaatcaggcagcagggctttcttcccccttgccttggtccctcgcaggaatgagccaccaggctgtggaggagaaggggtcacggccatatcccaatatgtgtatggtgagggtccctgctggcacgtccaggctgccagcagagctgtgccggggagaagagacctgggcttggagggaaccagtacccggaggtttccagttgccttgcctcttcccacttttgtcagccgatcagtttgtggtttctatacccgcaaaagtttcaggatgcattaacaaaagaaaaatacatttttttttcctgaggaatggggtggggacagtggagagggtgctgggaaatgagtcccctgggaaagggggcctgtctatgatgctaaatatctcaggctcccaagtggctggatttccctaggaccctcaggccaacagacctcagacctgcctcagggcccagtggggaaagtgaggcctgtacaaggaagtggatgctgagtggttgggcctaatccccccaactccccacaccaccaccgtggcctcagtagggtttttttcttagtagttgttgcccagtctggagtgcagtggcatgatcttggctcactgcacctccacctcctgagctcaagggattctcctgcctcagccccccaagtatctgggattacagacatgtgccaccatgcttggctacttttgtatttttagtagagacgaggtttcaccatgttagccaggctggtctcaaactcctggcctcaggtaatccacgcaccttggcctccctaagtgctgagattacaggcgtgagccaccgtgcccggccccttagtaggtcttaaggagccccagcccttctccccttctgggcctgaccagctatactgctccatctcccccggccacatgcccctccaagtactgcacagggaccccccacccaggggccctgctccatgagataatgtgaaatatgactgtggaccaaacacaataaaacctctgtctgtaaggaaaaaaaaaatcttatccaccacaatccagtcggctttatccctgctatgcaaggctggttcaacatatgcagatcaataaatgtaatatatcacaaacggaaccaatgacaaaaaccacatgattatctcagcagatacagaaaagtccttcaataaaattcaataccccttcatgctaaaaatccaataaactaggtattgatggaccatatctcaattagagctatttaagacaaacccacaggcaacatcgtactgaatggacaaaagctggaagcattccctttgaaaactggcacaagaaaaggatgccctctctcaccactcctattcagcatagtattggaagttctggtcagggcaatcaggcaaaagaaagaaataaagggtattcaattaggaagagaggaagtcaaattgtctctgtttgcagatgacatgattgtatatttagaaaaccccatagtctcagcccaaaatctccttaagctgataagcaacttgagtaaagtctcaggatacacaatcaattgcaaaaatcacaagtattcctatacaccaataatagacaaacaaccaagtcatgagtgaactcccattcacaatgactataaagagaataaaatactcaggaataaaacttagaagagattggaaggacctcttcaaggagaactataaaccactcctcaaggaaatgagaggacacaataaatggaaaaacattccatactcatggtatcacaaaaatggccatactgcccaaagtaatttataaattcaatgctatcccgatcaagctaccattgactttcttcatagaattagaaaaaacgactttaaatttcatatggaatcaaaaaagaccctgtatagccaagacagtcctaagcaaaaagaacaaagctggaggcatcatgctacccaacttcaaactttactacaaggttacagtaacaaaaacagcatggtactggtacaaacacagatatacatagaccaatggaacagaacagaggcctcagaaataacaccatacatctacaaccatctgatctttgacaaacctaacaaaatccaagcaattgggaaaactggctagccatatccagaaaacagtaactggaccccttacttacaccttatacaaaaattaactaaagatggattaaagacttaaacgtaagaactaaaaccataaaaatcctagacaaaaacctaggcaataccattcaggacataggcatgggcaaggacttcatgactagaacaccaaaggcaatggccaaaattgacaaacgggatctaattaaactaaaccgcttgtgcacagcaaaagaaactatcatcagagtgaacaggcaacctacagagtgggacaaagtttttgcaatctactcatctgacaaagggctaatatccagactctacaaggaacttaaacaagtttacaagaaaaaaaaaaaaacatcgaaaagtgggcaaaggatatgaacacacacttcgcaaaagaagacgtggccgttaaacatgaaaaaaagctcatcattactggtcactagagaaatgcaaatcaaaaccacagtgagataccatctcacaccagttagaatggcgatcattaaaaagtcaggaaacaacagatgctggagaggatttggagaaataggaatgcttttacactgttgatgggagtataaattagttcaaccattgtggaagatggtggcaattcctcaaggatctagaactagaaataccatttgacccaacaatcgcattactgggtatatacccaaaggattataagtcattcttccataaagacacatgcacttgtatgtttattgcagcactattcacaatagcaaggacttggaaccaacccagatgcccatcgatgatagactggataaagaaaatgtggcacatatacaccatggaataccatgcagccataaaaaaggatgagttcatgtcctttacagggacctggatgaagctggaaaccatcattctcagcaaactaacacaaacagaaaaccaaacaccatatgttctcattcataagtgggagttgaacaatgaggatgcatggacacagggaggggaacatcacacaccggggcctgtcgggctaggggagggataacattaggagaaatagctaatgtagatgatgggttgatgggtgcagcaaaccaccatggcacatgtaaaaaacctccactttctgcacatgtatcccagaattcaaagtataattttaaaaaatacagtgctggaagaagatgcctggtacctattaaggaactcactcatgatttcttgctgtggcctagagtggtggccactccttcaaactgagtttgccagaatggaattctggtgtagggagaaatttctttgcagaaaaatgttacgtagtttcctttgtttttcagtagttgtgcaaagaccaactactgccagtagtctgcaaaggacaacaaagagatatatggcataatttctgtaatgaagtaatatttttgtttaatgtacctttattaacagctttattgtagtataattgatatacaatagatttcacttatttaaagtgtacaatttgataagtcttggccatgtgtatccatctacctgtgaaaccatcagtagagttcacaatgaatatgtccctcaccctcacatgtttcctagtgcccctttgtaatctctctgtcttatctctctctccacccccacccccacattcccaggctttctggcactatagattatctgcattttctagaattttatataaatggcaacatatagtatatactcttttgtctagctgtttttactcagcacagttattttgagatctgtctatgtcgtgcatatcaattcgttcttttttattgccaagtagtagtccatttatgggtatatagtttaactattctgaattcaaaaaatctgaaatctggaatgcccccaaaacttgaaacattttgagcaccaacatcatgctcaaaggaaaggctcattggagcattttggattttggatttccagatcggggtgctcaactggtaagtataatgcaaatattccaaaatctgaaaaaatatcccaaatccaaaacacttctggttctacacattttgataagggatgttcaacctgtatcaggtttaatagccattcagccaatgatgaacatttggatttatccatttgttgtatgtttgtttatccattcagccactgatgaacatttggattgttttcagtttgggactaataaaagcttctatgaacattcatgtacaaatatttgtatggacatgtatgtccttttctcttaggtaaatacctaggaatggaatggctggattgtgtggtagggcaggaaactgccaaactgttttccaaatcggttataccatcttacattcctaccagcaatgtttaagactttgaactcctttacatccccaccaacatttgatgtggttagtcttttacattttagccattcaaataggtatatagcattgtctcaatgtggttttaatttccaattctctaccattgagtgtcttttcatttgtgtatttgccacagcatatcttctctggtgaagtatctttaaatctttgcacactttggagacaagcgttgtttgttttcctcattgttgaattatgaaaattgttagtatattctggataaaagtcctttgtgctttgcaaataatttctcccagtgtctcttaaagtttttaattttgatgtccagtttattaacattttcttttatagatcaggcttttggtatggtatctaagaaatctttgcctaacataagatcacaaagactttctcatatgctttttttctagaaattttatagttttgtgttttacatttaggcctatgatctacttcaacttttgtgtatgttgagaggtaaggatccaagtgctagatagatggataatgacaatagttcctgcaccatttcttgaaaagactaccctgcctccactgaattgcctttgtgatgcttgcttttttcaagcataaattttccatatttatatgggtctatttctttctttttttttttttttttttttgagatggagtctcgctctgtcacccaggctggagtgcagtggcgcgatcttggctcactgcaagctctgcctcccgggtttatgccattctcctgcctcagcctcccaagtagctggaactacaggcgcccgccaccttgcccagctaatgttttgtatttttagtagagatggggtttcaccatgttagccaggatggtcttgatctcctgaccacgtgatccaccagccttggcctcccaaagttacaggcatgagccactgcgcccggccctatatgggtctatttctgtactctctgttctgtttcagtaatctgtgtgactgttgcatcgcaagtatcacattattttgactattatagctttataacaacaggaatttttttatcttcacaaataaaacattaacaactacctatgcaatcttccaatactgagatattcaatagggaactgagagagagagagagaagggagaatttgggaaagagaatagggtggaaggtgggtctttgaattgttttgcttttaggaatagttaaaatattaagtagcctattacagtgtgaatagagcaagttttcagctaaactttctaacagaatctacatttgattcttctctctctgtagagaggcttacattcatttggaggggaactaatcccgtgacttctaggttatctcttagtttcttctctggaatgacattattggcagacactaaaggacttaagggagagcggcatttgtctagaatataaaagccaatttgtaatttccatattagtagtggtggatggagaattttcacaggcaaatcaaacgatcacataatccccaaaccccttttcagctgtagttatttacttctttatccatttattctaactttgcaggctacctgagaagttgtatagattcttccagagtgaacatgtcacttaaatatggattagaacatggcttctgctgtgattaccttagggagatgggacctattggtacattacaaagtgtctggaacagttaacaagaagaagcttatttgaggtggctgctttccattttactaaagcaaaaggcctttagaaagccaacaactttactcagattaaagatgggattaatttctccttatgcagctaaatacataagcagtgcatgtaaatatttaataaatataaaagagctcttataaacacaagtcaataaacaacttcaataaagtacaggaaaacaatatgcattttgcttggtatagtgttttctttactcaggttaacaaacaatgatctcatcattagcagcaagatagtggagagaccatcaaagcaaactacagcagagtccagattgattcgtgccaaacaaatgtttgtagctaacagctgtattatcactcattctaatttacgcagctggggttcttttatttcctaagtgagataaatgtcatgttgcatgatacaagcaccatctctactgcttgagtcatgaatcaggtcagctctctcctagttagcttcacccctcattttaggttgggggaagtggcttgctacagttttagctataaacagctaataggcctttttctaaggttgtgtgagtccattcgtgaatcattcagtattttatttaaaaataccagtttgaatgtcatgaaaatattgaaaaaaccagtttcatgtggaaaaacctttggttgtgtaggttttaaactattagcataaaacttctctttttaaaaaattcttaaaacttgaagactgaagaataagtatggtatagtctctgcctgctggatgagattccatgatttattctctaactatgctaagtcaaagattctgcagttagctttctccccaaaactcaggctgagtttgagcaggtcctaaggtgttgatccctttagctcacctagttaatgggacatagagtacttttggcttgactactccatgctttttcctatcaaagcagaccaagacaatcaaaaccttgatttttaaagcttacctgaaatagagtcttatgtaacaaaaggatggctaagtgtacaaggcagttgaacatgttagtggtagatgatgcatttaactgtcaaaatgctactcacagcaaaggggaaccaattcccaggagaaggtctggagaagaggagggagaagagcctgaggcttggtgtgcacattctgagaccagtcctggctctgccactcagtgggtgcctgtttgcaagtcatttcttgacctctgtgagtcttgtcttgtctttttttccaattataaaatagaataataattcctgcctcccagttttgtcatgaagattaaataaaataatgtttgtgaaaacaagtagacagaataggtgctcaatcaacaataacattagctggacacgatggctcacgcccataattctagcactttgggagatcaagaccagaagatcgtgtgagcccaggagttcaaaaccagcctgggcaagatggcaagccccagtctttgcaaaaaaaaataaaaaataaattagccaggcttggtagtgtgcacctgtagccccagttattcaaggggctgaatggcgggattgcttgggccaaggagttgaaggatgcagtgagccgtgatcacaccactgctctcaagcaattttcgtattctggcttattgacttaacaaattattgaaagtttgtctgggccctggtggctcaggcctgtcatcccagtgctttcaaggcctaggcaggaggaccccttgaggccaagagtttgagaccacctggtcaacatagtgagaccctgtctgtaccaatttttttttttaattagccaggcatgatggcaagtgcctgtagtcccagctactcaggctgagttgggaggattgcttgaactcagaatttcaaggatgcagtgagccataatcatactactacagttcaaccttggcaagagagtgagaccctgtcttaaaatctgtgtacatatgcatatttttttaaaagtcagtcattgtagtcggggagacagctattaaacaagcacaatgtgagagttacgtacatagcactgtgagatcagagaaggaacaccaaaccctgtagggagggtagggaaggaaagctaccttctcagaggaggtgaaagagttatctctgtaaaaatgagtttatcaagtaagcaaggggtgaaaaggcactgcaggtagatggagcagcttatgcaaagacacacaggcatgttccagaaagggcaagtggttttgtgtgcctagagtcgtgggtgagtggtggtgggaatggtgggacagaaggctggaaacatagtggttatactggccttcataatctgaatttcacagataaaggtttaaactgctgttaccacttaaaggaactgcttagatgccttggtcctgtttgtttctggtggaaatctggacagattaatttggcctgttatttctgggtacttcagaaagacaaacacccaatccccatatttttggcatttctattcccaacacagttggaaccaggaagcataacaatgaaaattaagaaaggagaagagggaagaagcagagagtaaatctgtttgggatttatgaaaagatattacaagacacaggcatctttgactagtttactgggatctctagtagagatttttccatttttaaaaaggtgttatatcgctgagaaaaatctaccttgatatgtgtaataaaatagctctgagtaggaactcacctgagtaattaataaaaaaaaattttacccaactttagaaactgtgttcagggagcaactgccctgaataaagagggcatgaaaagccttttgtgttcctttttgtcctgtataacaaattatttttcttgcaaagccccaaattgctttcccctacattgccgcattgctgtgaacatgattccagtacactgtggctcttccagggatactcctgatatcaatcttgaggcctattcaaacgaggatgggagtcagagttgaactgtgccagcattcctgctgagaattagcccagtttcattatgtgtggaggagcccccagttcactgcccttgcatgtttggggtacacagagctgagaggctctgcagggagtgcaaagttaaggaactgcatgataggaacactatcacttactctttcataaggagctctgggcagggaaactaaaaaaagatgaggtttttccatcattcagtgcagctgtggtgttctacttgtaacaagctacttctgcttcataaggcaagaaaaacacaagaattgtgaacagactctcagaatgagcagggtccccaggagtcctgtctgtcttttttaactccttcaattaactggagtactaagggagagatttgttgcttggcctgtgccttcattctacagatgcagaagctgagacccaggaggagaagtggctttcccaaattgaagattcattagaagccagagtttgtagtaccaggtcttctgactcctgtgggccaaactgtcgtccataagcctaaatatggttataattagccaggttgtcagcaatggggcaggaggtatcacacgagtacgttgtaaaatcttttctgcttggaagaaaaggtgatggcgaactaaaaatttgatctctgtgcctttatcctatttaatctatattacatcatatacaggatttaatttctcaaactgtatgtttacctgttttatcttacaaattaccaatttcatcagaataggacttggtatcatcaagtacagctctattaacttgacttttaaccacttggaaaacgtgtgcacccttgcagcctcctttatcttgccgtgcactcccaccttctggtcatgtcaggagggacagtatccctgaggaaccacacttaaacttttccattttagaaagattggtcaatcctaggcctttgttgtatgcgtaattcgttcattcttatactttctaatcccacaggctttgacttcggaaacctttgggttataacaaagtactgaggaactgtaatttaatctgttcagatctaatattaaatgagacccagatttttttttctagtggactgcaaagccacatttattgaacatctactaggtttacatgggagtccttttagctgtgaattccttattggtaagggactatgcccaacagtgtacctggcacatagtaggagaactatgaatatgtgttgaatgaaggacattggtgaaaaccagggctgtttaggagtgtcctgtcctgaggccactccagatggaagtggttctcccatagcctaacacatcccgttctttcttgaactataactcgactttcttccaaagatgaaggggaaaggtatcattcatctgagatttgccttgtggtgtttaccgagttagtgggtgcagcgcacaaatttgttttctaaggaaaggctggtaaagcattgatgcaaggaaaattattcttaggtattcttctctgatgatcatagactgaaacttttacttttgtatagttaccatagccatgaaaataatcactggccgacatttctagtggcaaaaaaatatcaacctctagaatggtctgatgaatatcagggagtagggctaacagaaatgtaatgccagctgggccagcagtgtctgccaaccccaaatatttactcagcatcttactatgtgtaaaactcatgatttttcctggcttttgcttgtttcttgaatataatcctgaaggcagaatctaagttttgtaactgatgatttatgaacattatttttgtctagaagaggtgatattcctacctactttgaaatcagcttggagtgcagggataagattttgatggtatgtggcacacattagtgctcagtaaatgtagaaaagagaacagaaaaatgacagaatgctgggaggaaggaagggagaaggagagggagtaatcccaggcctgggctctggcatcagcctgcagatagtccaacaggttctgtcatgaaccagctggggagcctggtgacattcactaacttctaactcatttagctcatctctaaaatgagataaaacctactgtgtagggttttttgagaggcttaaatgacataatgcttgtaagtatctaacatagactactcaataaatactggtttaatttaatgaataatatgtttgtgaattccagtaattgtcttgttgagaaagcagttacctgtttatcttccttgactttaaaatgagtccacatcagttaatttggattcccccagagtggagcgagcaagcacaatgacattctcagaagagcagacagtcacagatgacagcatcctcagggaacacccctccctgagtgctggcagtaagtcagaggattgctgtttccccagttgcccttcggtgtgagttcccccttaccagtcataattttcagcattcccagaagagagggccagattctccttccctttgtgtttgcctgttttcttctcagaggaccatgtctgtgtgagaacagggcctttactgagaccaggtcttcctgaggcctttgcgtggaagtggaagagacacaaaatggcaagggcgggggaagggcagtctggcaggttggccacagctcacccatcaaacttcagggccaggtgttagcattttccaacaccttggtaagtcatgttttcagcaaatcaagaaactctagttctgcatctttgagagacatcactttttccccctaaggttagcttttctcaggatggggatacattttcaaaatcttttttaggaggaggcagagttacagttaatgagtgatattggagactgaggggaagttggagtttccccggtgtttttctgaaggagttaacagcacaggcagtttgggagatctacgggagacctgctttggaaggtccagctgtctcctttacatcacccccatttctgtccattgaacgtggaagaaaagggaggccccagcttctcacacttgctcatggttagcatgtctgcacacttactgtgtgccaggctgggttctaagtgtcatatatggtacaccacttaatcctcaaaatataattctgaagtacatagtatttttatccccccctacagaggaggatccaaggctcagatagtaaataaatttcctaggctcaaacagttacgaagtgacagaactggttaaaaaaaaaaaaaaaaaatccaggcagtctggctccagagccttttctcctagctggggttctccgctgcctgcgaagtcgttagtcccactggaggatctcaacaagggactgcaggagttgaaagtgaatgtagcgtttctcttcccccgcttttaaaatatttaattttcaggaaaatttcaggaacaaataacattttttcatctcaacaagaccaaattgcctctatggactatatggcggctctgctctgcattttccataaagtgatatgtgctctccagtggagtcgcatcctgttgtaggttaggttcccagggagcattcacggagttggagtttagcttgcaggattttactagggatccctgctgaaggggagtggccctggggaagtggaactgcaacacaggcctgacacagcctctgccagtcacttgggtcatcatggagtatataccgtccctcagagcccagtcctgtgctgggctgaaagggtaggacctttatacaaaccctgccaccaccagtgggtggatatgggccacttggaagagggcttctccttgggcaagggagctcttttcagctgaggtggaccctgaaggaggtgacagctgcaggctgtctcccaacagcattccccatcactgaggtagagttctgccttgagcaggggctctaagtggtggatctttgcttccattatgacactttcattttcattgccaatgtgagtctactcattggcaagtgctttctcctaactcagcctcttgtttacttggattcaagataaacggcatttacaagattgcacaaaaagagagattctcaactgtctggtatccttttactgtagctctaggcagaggcaaaggtgtaatattgatagtctctttggagcatgtaataaaaagcatgcctggcattttaggagatacatgaacaatttgttttatcctcatgatatctttcaagtggcaccagttggcttttttctggagccggagtccaaagctaaaggccacaatgcagtgattgaaatctccagttacatttttcttgccagttgtctttagagaaatctttcagtgattaagattccagatttaactcccttttccttagtccttccatcacgaaactaaagctgtcttccagttcactccagcatggacattaaactgtaccccactaacttacatcttgtaacccaagctgatgacaagagctgggttggcttgccttttagggtttgttactgttgcatcccattgatgccctgagctggcattggccggtgactgtctcacctgcaggatttgcaaaacctgtctccatttcccttctttcaggttggaaagcttatccaagaagcagctggaagaagtaatttgaagagagtaactctggaacttggaggcaaaagtcctaatattatttttgctgatgctgactgtaagtcaactacaggtcccatacatgaaccaccacacaccctttggtgctctcttttatatctccacttttgatgggacactagcaaaagatatttgaagctaagggcaatcaaaaagatctcctctaaggagaaaatggtttaataatggggaaagagcacttttcagttgacgactgaaccagttgttttctagacactaatgagccattttgaatctgtgatgttgtagaatagggggatgagatgaaggcttggtcagtggcatatggttcaacagcagtggtctcagctgctgagcacctgaaggatagtctctctgcctagattcaataaatctgtaacttttcaactgtgcctggtggctggtagaccattttaaataaatccgacttgaccagccctgccagcattttccaaacccacagccccttctctgtttagtcaattccagcccctttctgttgctcgcatgactttcagttaggatgacagcacacgtgggtcagttcggtatgagtagtcctaaagctgggatgattccacttgccagtaggaccttacagaggcttagagaagtaactgagaaaccccatgtctctaggaaggatgccacctaggccattctgcacaggtgtgacgtttctgtttgaaaagctctccaggtaaggaaatcccaccatctcattcagtgattcttttttttttttccctccacttgttgccaggcagagctgctttcccagtctcaccaccagagagatcagaaaaccaaaagcagattgcttgaatttcagcaccagcttggaatttgcagagttcagctttagctttatattagttgtcaagaaaatcagaatccttatgcctgttcctcttgaggagtaggaacttcatctccctaacattgactgattcatttattcagtcagtcggtcatttagcaactaatgcacgtcagattaagctgttttgaagtgtaagatataagggatgaatatggaagagttatcataggattttacacaagtccatgtcaatctagaggaaatttagtgtcttcaaagaagacccattggtgttacggtttaatcccccaagtaccaaacatacagccccaaggccctgtagatttaggagttgtaaattggccaaatacaaaatatagacatgtttacctgtctaaacattacactatgttcaaaacaagaactgcacattaaaatattgatttctgtgaaaattgagaggatctggcaacctggggctcatatttatgcatggcaatgattaaatgtagtggctttccttcttagcccctccattacattgctttaccacctggcagactcatacctgtaccttatctcccaagccctgtggtatataggggtttgagactcctgttatacacgaggttcagtacctctgtttgcagaataagaaagagacccaaagaagtgaagttgttcaagttcacatagcatgtcagggtgtagttagaactagttgcattcccaatccagggctattcatggttatgtcatgcagtgagcacactatacctagggctttggagaggggagggaggcggcttcatagacaggcccctccccaggcaaagcggtgagaacatggctgtttcctcttgtagtggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccaggtagaaaaatcataaccattccctttgtttacttaatccttgactggcacagaactgtgtacactgtagtaggtcccagcaaagcgacatcttccttttcggctgactcctttattctccaccatgtcttcgtggctggaaatggagccagagagggattgcttatttcttatgcttctctgtccctttctaagttttatctctgaaaaactatgggattaccattactttaagaatattctggccgggcgcagtggctcacgcctgtaatctcagcttttagggaggccgaggcgggcggatcatgaggtcaggagatcgagaccatcctggctaatatggtgaaaccctgtctctactaaaaatacaaaaaaaaaattagccgggcgaggtggcgggtacctgtaatcccagctactcgggaggctgaggtaggagaatggcgtgaacccgggagatggagcttacagactgtgccactgcactccaccagcctgggcgaaagagcaagactccgtctcaaaaaaaaaaaaaaaagaatattctgacctttgggactaagctggagtctctcagttctaaagaaagccatgagtatgacaagatgggtctggacactagaacccagtcccagtccttccaatcactgaactttaggacatccctacagatgccacagtcaaggagggtagatatctttctttcctagagccatctatccttttacgagctgccaaggagtctctccagcagcctgaaccagtctggacagatcccttgtagcttgtgaaagtgtaggaagtgaagggctggctcacttcccttttgctgtatggttatttcttaatctgaaggcctcgtgtactttagtggggtggggagggccacaaagtctctcctgaacagcctcctctgcaggttcaccgtaatcatcgaggcatatttctaaagggaattctggttttaatctgtagacaggttctgagaattttcagaaggaacctggaccagctcttatatgggtcactaaagcatgggtttagggattattcaagagaagattgatgttctggctgagccattcaaacttgggtaaatgtaggtttttgtgttatttaccataataagcaaatgataactccgtcagttttttgggggaagactgaccttgtttttttttggactaggaagctcatccttcactctttactgttaatattttcctctaaagttcctctaaaagtgtaataggaattcctttaaaaacaaaccacaataagattgggtatgtagcactatctaaaaaggctgtgtgctaatttttgcctctttttactatcaatacaacttgctaagttactcatttaattataaaagtcaattttccctcatatgaacattgaatagtaaattagccagtgtctccatcattttgaaacatttttctaaatgttcagctggtacttctgattaggcaatatcatcagagcagtacatttattggaatcgtcgatatattaggattaaccatacaaaattgccagttttttgtaggtcaaaaattggtaagtaacagcagttttatatgatctgactgggtgtagttaaactttgaaaaaaaccctaaaatgaaagattctcaagaacatacttatttccattttcatagaaggttatatttggagtcattaagtcttgtctcccacagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggaggtatcaaatatgctgttcttacaaaagccacatctttcttgggatcatttctagagcatttctagtggatgatattagagttttagctctttatattttacatatattcattttgcaacagtaatgaacatggctatgaaaattccagtttcaagaagaaaaataaaccaaaagacaagcaagctaggtggaggccaggtgacatgctatgtgcttatgattattattagccaacagaacaatcagaatagcctgccattggcctcaacaatacactggcaatagttcggctctcctaaatgtgggtcactgggatgttaaccaggagagagaatccactgaagcatctttacatctgtgcaagagagggacaaggagcaaatcagcccacagtccagagcattccgttctggagcagtgtttgcaggatcacggaggatgccacttgctcttctgtacctaaagaagacacccctagtatacacagtggaatcaagtgatgctggagaggttggggaagttggggaggttaaacactaatgtcagactcttcttgcataatcttatcctaggaaaggttgggagattttacagttttgtactgctaaacttaaaggtcatttaagtaatcaaggcagagtaaacttgcattgaaatgtggaaagcaggtaaaggaatgacagagcaaccatgttgagtcatattatctttttgcagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggtaagatcagagtcagtcttgtaacaaattccactggtggtatagggaccagggtgaaataaacaagtatctccttggaaggatggggaataccaaaagcaaccaaagttcaccagaaaaggggtacactccttactgcttagatccagaaatcaaagtagattttaaattacaattttttcctctggaggaaaggaatttaaaaataaaacttctaaaagaaataccatgccagtcagattatgtgctcagacttcacacgaactcacagtgctatgttttcttctttcaggatcaattgttacaatgccttaaatgcccagagcccctttgggggattcaagatgtctggaaatgggagagaaatgtaagtcttaaagttgctgatgcctgcagagaaatagattgcaaatatcagcacagagcagtacttaaaaaatagtttaattatcttacactcatccatacattcaacaaacatttcgtggagcacatgctactataagctaagttctattacatgttatagagatgaataaaacacaattccatttcccaaagtgagaatggaaaaaattaatgtaccattaattccctgtagtaaaggctatgattagaagtatgttaaacattttgtcagtacagagaaaaatcaattaattttgactgctcgggtcctagaagacttcacaaaggaagtaaccgtttttcctggaagtaacatccaggaaaagaacccactttccctccttttgaaagaaactgatctgtatttgccaaatgctgtgactcacagaggaaacatgtttcatgcccgttccctcagccattactgaatgcctatttttttgagcaaatgcctagttcacaatctaacaaatattgagcataaatatgtacaaagcactgtgcttggtctatggaggaagatgcaggtccttaaggcatttaatatgttttggggtaaataaaactaataacattgaaagaatcagaggaatcgcagaaaagactgtaaaccaatggaggagctcagggatagggaagatcactgtgaactggaaaaatctgggaaacctttagatatgatctgctacagggatttgtgtcagcctttcaagaagaggaatgcttggatagagaagggggaatatattttcaagtttgtcgggcaaaacagggtagcagtgggggagagtgagtaaaggtattgcgggaaaaataacggtagtgtgtgtttgtgggagaaatgcagtgaaccaacaagactagagcagaggatttacatacttcagatagtttcactggtaatttcaagctcccaagcaaaactataaagtaggtatagcttggagattagagcagtttctagaatcacactgctcggatttgaatcctgccactattactacctgtgcaaccttggacaaattacttaatctaagcctcagttacctcatctccaagatgggaataattatactacctacctcagggttcttgtgaggattaagtgtaaggattaagtatgcaaacatccaacagaatatctggcaagccttcagaaaatgttagctgcaatcatcattattcatcaagcagattagtgttatatagatgattcctctttttcttaacctgtaactttggcggaagtttccccaaattccagctggtgtcaccaacttctgttctgacagccagaacctataaccaatctgggtcatatttgttcagttcttagtattccttcagcttttacagagtcttcatgcactccaggtatgtcttcatttgcttttgaccttcaccttctgcttccacttttcaagatgcattccgcttcttatttcatttccttcctctatgtctgtgctctcccagtctctgaaatgctggggtcagtcactggctctgggaatgctgcttgcattgattgttttgttacagatcattaacagggtgaatcatgagcataaaatatactttcaataaatgatcgctggttgatggaccctaatcccaggctaatccatggtccctcattgtgggcacacttgttacattagctgagtctagtctattcccatcagaaatgttctccttgcccagaaaggtggtccaggagacagtttggctctatctgaacctcatataacagtgctcaagagaccgaagaaccatttctctctacttgtcttccaggccctatggtgattggaccttctcagtgcagttaaaaaataattaggaaatgctgttctttgatgagacccactgcatcttgtctagattgcatgtttgtttgtttgtttgtctctacttacccccaaaacatgttttctctttcttaaatgaccctgagtgacagaaaatgcttcaaataaaagaagctgctctgtcttggtccccaactcttccacctcatttgatacagcctcagaaactccacttaatcctccgtctacacagaattatttatctcatggcctgcaaactccatgcagctttggtccctgacacctccctgtctatccctaagaggagcagagacgtgaagtggcacttccagaaacatctggaaactcccaggagggctgacctagcccacgaggtctccccacagagagctgtggggagggctgccctcttaattcccaggctcagagacgagcttttctcaggtcctcctgcccacctatttctgcctgtttcacttttcctgtcctttttcttacttccttatcaaactcccctgagatgaggggtggcaaagcacaagccataaaatgtcacaaactgaggagatggaaagaattctgtgaacctcagcattttaaaaactcaggacactggctttgaaaatgagaagcattgttagatactctaaatcagagcttgtcaaatttatgtgtgtgtgtgtgtgtgtgtgtgtgcgcgtgcgtgtacacgcatgcatacagagaagtcacctccagtctgggtgatggttttgttaagcatgcgtatctagggacccactctcagagattctgagttagttgatctgcgataggacccaggaactgcgtttttaacaagcttccagagtgactccagtatacatcactgcccaggacccacagagaagcacctccgttccagcagggttttacattgcatcacacacccaaacactgggatccaccagtcacccttgaaagcaacctgccttccggtgacccgctcccacccaccctctcagtcctgaccacctgcaagctcctctgatgctgatggtctggagactttactccgctctgaaaaatgctgctgcaagtcaagtaaaagagcaggaaaatatataccctaaacagaaactcttacttgttttatgagcaagtctgagtgagtcctaaaatggctggcgaagagctaccaatactgactgacaggttaccttaaagcctctaggtgtgccaagtttgatttatcttagggactagaacctagtcttctaaatgtgattttgccttgctgtttcgtcctgatgtgaaggtaaccacacagagagattgggctgcatcagtaatgatatgcatacctttcgtgcatcagtgagcttcttccctgttaactgtatgtgccacaaaatttagctggagtaaataaatatgcgacagaaatcctggaacaagatggtgaaattgcttaagaatcgagacttcagggctcaatgacctctgagcatgtttcccaaagtgtgacccacatgaccatctgtctctcagtctcctggtccctccgtagagcttctgaaactgaatctttgtggggtgggggtagcgttcaagaatcaaaagttgaaccaagctctttgggtgatacttatgtatactgaggttcaggaactgctggagagatgactgggcaccaagaggatgacagtgactcagctggcatcccttagctggttcatggcagagctgagtggccactcctgtctctgaccccagcttcagtgctctttatctcctccatgcctcctcagtcgtgctgctctaagactgcttactggctttccttcatgtcctgggcacagagcagttcttttggtagcagatttgagtccacttcccccgtgcacagatcactgctcaggacccagagaggagcagctctgctccagcagggttttccattgcatcacacacccaaacggtaggatccaacagtcacacttgaaagcaaccataatcgtgaggtttctgatgctgtagacttccttacatttctcacaacctagttagagagtcacatgggggtgaagtgtggctcgcgacctgccccaacaagtgcgtgcagaagccaggaaacaaaggagtaaattcacttcaaatgggatgcacatggtgtccgtgatgaagagacacattcagaattgcccaaggacaggaaaatgaccagagagagccagagctgagctggtaataaagagactccgagactgagtggagttaatgagggaagcatgcaacgagtggggcaatttcagttggtttctctcattgctttaagcgaaatgaactatacggacaggagaacagcctgcttgccccagtctctccttggccgccctctgttgtccctgtcaactcaggtgcccacggtgctcagaggaggtgctggcaaagcccctggagccttatgtaggccatgggggctcctaaaaggaacctgaatgaatcatttacagcaggtctctcttgtaaagcccagccacagtaactcgtacactgactgtttcaaaagacagcctttcttaatcatttaattgtttcatattcaaatatatctcctaattgtttttattttttcctgatctagaagatatgacaacagggtagaacttgggaagagggaataggaagctcgcccttcctccttccctcctcccctctctactttccttccttccttggtcatcaggtaccttctttgtgcctgctgttgtaggctataccctatgtttggtggaaggcaaaaagaaaaatcagtaggatacaactcagtagggaagacagagatattcaagccccttgtcctcccagtgtgataagtgtggtggttgaggtgtgaacaaggggctctgtgaacagagaggacgaaagaggagctcctcctgaggctgttgggaaaagcatcactgaagagtgactttcagaagaagagaagaaaaagaggagaacatgcgtgattttataatgaaatagattagataaggggaaaaaaggcatttaaacaaggcaaaaagaacaggagaatagagaagagatgtggaggagaaggagcactgtagtaaacacgcagaaggacaggaacacttagacatgcaacccactcccaccctccgtcttgggggaggaaagcacactactgtcccaaagaactaatactgaaccagtgctgccttgtggagagaggcatggccaaggcgttcagagacctgggcctggtcccaccgctgcccacagcactcagcctctgagcacagcctggggtcatctgtgtgccctctggccaaggctgatggtagttctctgagtaattgagagtcattgcctgtctgtgcagtattgtgaaaacaagtcaccttttaactttaaaactactttaaaaaactttaaagttttaaaaaaacttctttaaaaactactcatgagatgacagtttctctgaccctcagaggaaggctgggctgcgcatacgtgaggaatttttacatgaacatcccaggacttgctgttcgcaggtgataaactgcacctccccaggactcccgctgcactcacatgcagctccctggacttctggtatctgacccggcccatttctgtgtttcaggggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaattttccaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgaccccatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtactccttgggattgtttggctgtgtctgtaagtctttgggtcatactgagtctctttgggtccttcctcagctgctgggtttttcagctgtgttgccctcttgggtaactgagcagaagcctgcaagggtatttttacagaattcattaaggcaactggtaaatggtattaaggtaaacaaaaaccttattttctgatgctatttaaaatctgtgtgcatgtgtagtttagctggcatgtaagtataaccatatatgaaatat

SEQ ID NO: 15079 - DNA, 39690 bp, Human
  misc_feature (1)...(39690): n = A,T,C or G
tagatttcatccttaattgaaatacacaccaaattggctgtgtggattctccagctgagggctcactggacaactggtgtcacagtaaagtgggatattgctggagtgaatgtgaactctatgttagtgcctcaatctgcagaagagcacatcaggaggctgcctttgaaaactgaatcttgtgggctgtagccatcccttgcagactttctccccacacatcactggcccagttttcttggatcaagtgcctggggcaatgtgactggttcaagagagaatgggaatgggaacttggagattactgtggactgaaagcttcttaggaagagcccactgtcatctcttgggggcagttctgtgatgtttttctttttttgtttggaaggaacccatttatcaaagtgtttttaaattactggaatgttcacttctagcacagatctaggtttgtgttttgaaatgcgtttctaagacttgatcggtgattttaattcatgtgggtaacatgatatagttatcatgcatacctcattgagaacgtggcctaggggcagcaagaaagagttataagacctggattcagtttccaactctgttattaactagttgagttactttgtttttttgttttgttttgtttttttgagaccgagtctcacttcatcacccaggccggagcacagtggcatgacttccgctcactgcaacctctgcctcctgggttcaagcaattttcattcctcagcctcctgagtagctgggatgtcaggcacatgccaccacgcccagctaatttttgtatttttagtagagacaaggtttcgccattttttttttttgctttttgttttttgttttaaatgacaccatgttccatgaaataattgaaccgaaaatcatagttctattgttttgtttcccagtttggccttaaaatcattaactcatttcaaatatacgagccagggttttaaaaagaggattaaattaatataagaacttctgttattaacattcttcagaagtcagtggctgtaaccagagtacaatagtcttttggtaaaccccgcttcctgtcaaaaagagaaaatcatcaacataatggaagagtaaatcagatgcacattttcttgaagactgatttccccttctcttgtttctttttgctgcttaaaatgcccctctgtcttcacacccaggcaatgaatattgtagacctcaggataagagaaatcctcactgttttgattgccacctactctgatattgcttggggagaatgacagaaatatattctggattggggttcccatgggtggttacagatttggtttgtacttaaccctcactgtcagattgaggaggtacctcaggatgcagttagaagccaaactctttttcttgagggtagaggaacatatagctctactaccaccagtgacctaatgaagtgcttcccataaagtcaccaatgaggttttcatttcaaatttaggactttaccccaaatgcccatataatgccattttcaaagagacatatagtaaacaggaagtaccctaattggatgtacagtatcctctcaggacccaggtcacatgagatttaagtagttttctcttgacttcctagggaggaatgcagtaggcatgaactgaataaggataaaagagtaaaattattcaaagaaacagccctgagggaaagtggtgacaggccaaaaaaaaaatcagtgagagattagttgtgtgtgtttgcgtgtgtgtgtgtgtgtttcaggacaaatacctacctagtctgtgagtgtaatacagacatgtttaattccaggcatctgaagccagtatgcatttccaagtaatggtgggaaagttggataggttgaaaggaaaacaacaacaaaacaaaaaacagcttaacgttgaatctggctaattaaaatagtacacatcaaattctgaatcaaaactgaccattatcttgatttgaatttgcagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatggtgagttggctggagaaagtatgatatatgttattccctcacttacagctggaaggtttcaatttctccactggttttagagaatacttgagggaatttggagactgtgttttggcaagcttaattatttagaatcttagcttcataaatgtattcattcattctttcattcaccactatgctgggtaggcaagggtgaatgagacatgattcctgtcttccaggggcttataattcagtaagcttctcttttttatcttttttttcccttatccatttttttctggttattatgctacttgtataaaaaatggactaagttagagaactgctctaactctgtgaaacaatactcggaacactataaagtgttcacgtcttaggttgaaacttgtggcctactttagtgtggaagcttatttctatttgtggtctgctttcaattaactttatttttataccaataacatcagaaactgagatgaagcccaggtaaatgttgcaggcacaggatggagtcttgggctggcttgttcctcttagactagaggttatctatttgtgacaaatcagtactgggggcaaggacatctagttaagatccagttgcccttagcggatggttatgggggatgagtaggagattaatacaaacatcagcctcagggacccatttctgtctcattcagttcagttctacaactggttgttgagttgctactgtagatttacccacaaagtaatgtcttaaaggctggaagtactgaaaactttgggatgagataagggaatcatttggaagtagggattgggttttagtttctaacactgtcgatccaatttaatttgatgaagcttgattgagtctttagaaccagaataagcaaactatggcctactggccaaatcaggcctgccatctgtttttataaaataaacttttactacaacacggccatgtattagctatggctgcctttgcactataagagttgagtagttgtgatagagattaaatagtccacaaaacctaaaatatttactatatggttctttgcagaaaatgtttgctggctctcgttccagaaaggcagtagactaaagtttaccttagttttgccatgaaaataggcgtaacaggaatgcctctaagaataatctgtataatgtgctaagaataatgcttggtagcagaggtactaatagagtgatgagtgtggtgatggagttgtacttgggtctagggagaccagaaaacaaagaagtcaaagccagcttaaggccgggtgcaggggctcatgcctgtaattccagcactttgggaagccgaggtgggtggatcacttgaggccaggagttcgagaccagcctggccaacatagtaaaaccctgcctctaccagaaacacaaaaataagccaggcatggtggcaagcacctgtaatcccagctagtcaggtggctgaggcatgagaattttttgaatccaggagacagaggttgcagtaagctgacattgtgnnnnnnnnnnnnnnnnnnnncgagtggtatattaataaatagtcatttcctaggtaggcaaacagtcagaaagaattccagtctgacaaaacagtagatacagaggcagaaagaagtgagagaagattatatgtccaggcaactacagatagttgagtgtttcttgaaaataatgtacatagtagagaatgatacagtatcaggccaaggttgtggacagacccagatcaccaaaggccttattaaataatttgtgtgtgtgtgttgtataggtaatgtgggaggtaatcaatatttattgaatgaagaagttgggtaaggtattggatagggagaggttcaggggaattgcctttctcctttgacctgagatattgatttctttaacaaatcgtattgacttctgtggactggaaattgtgctagatgctgggatacaaagataatcaggacacagtctctactttatagtgacttagtgtctaattgggggagagtgccatacaacaatcacaataaataatacctgctataataaaggtatttatcaagaaccctaagagtatggagggaaaagtggctcaggtcctgtagatggtggttcaattttgagctggatccttagagaaagttatgaatttcctagacttagagagattaccagcctttccaggtggagagtagagcttgaatgaagacaaagtagcacaaggagtcgagtactggagaacatgcaccaagaggtattgtgtgcagtatgagttagaagacaaaaagactgcctaaaaggatgccaattaggaaactattgctctatactctatactgaatgagaagagcctgaagtaggatagatggctcaactggtagattctcaagactgtaaaatagaattcagttgcaattggcaattgctggtatctaggagtgaaggaaagaagaaagagaagaaggaggggaaggagggagaggaagaaggaagaaaggaagggaagaagaaaagaaatataaggtaaataaatccaaggtatggataactgggaaagttaggaaattatagtattgaagtgattttggcagtaagatgacaagctcatttctctctctctctctctctctatctatatatatatatagatagatagatagattcatctatctatcattgaatttgtctggtgtgatagcaagatatctaaatagagatgtaaaacaggtaaagatccaaatgatataataattagatttgggggttattgttgaaaaggtgagaaagtcttaatagacattgaaaatgttgactatgaaatgattttaaaagagtcatttcatggtgtcacttagttcagaagccttcagaggcttaccattacctaattgcctgagctcttctagtcctgtcttaactaagttctgtcctgtgtcccttttgagcccatacttgcctgtgtggacagtgttaccttggttggaccattccacttactaattggaagcttggtcttccctctgggcttttaatcctaaataccactgtgcttttataaatgaattttctcccttttctgaaatgcagtttctacctgtcttaaaagcttaatataattcttatcttctgcttatgcttcttaatccacaacctattctcttgctctgtatccatcttcctttctttctgcatctgcctgtcttcctttcttttagattttttttgaataagtaaatttcccagaatgctttggaaaatacaaagagcaatttgcttatcaaacaacatgtattgctctctctctgcctctctatgtatatattcataagcttttcctcctgaagaataatgacttcatggtttttgtaaaaatgaggcatgcttcatcttatttctttttttccagaacttttatttattttctttttcaacttaattttaggttcagggcatacacactaggtttcttacatgtgtaaattgcatgtttctggggtttggtgtacacatgattttatcacccaggtagtgagcatagtatccaaagggtagtgttttgactctcactctcctaccactggccatcctcaagtaggccctggtgtgtacttttcctttctttgtcaccatatgtactcagtgtttacctcccacttacaattgagaacatatggtattttgttttctgttcctgcattaatttgtttaggataatgtccctcagctgcatccatgttgctacacaggacattatttcattcctttttatggcagcatagtattccacagtgtatttgcaccacgttttctttatccagtcaactgttgggcatctagtttgattccatatctttgctattgtgaatagtgctgcagtgaatatataagtgcatgtgtctttttcttttttttttttaagacagagtttcactctgtagcctaggctggagtgcagtgatgcgatcttggctcactgaaacctctgcctccctggttcaagagattctcctgccacagcctcccgagtagctggggttataggcacctgccactacgcccagctaattttttgtatttttagtagagacagggtttcaccatgttggccaggctggtctcgaactcctgacctcgtgattcacccgccttggcctctcaaagtgttgggattacaggcgtgagccactgcacctgtccacatgtgtctttttggtagaatgatttatattcatttgggtatatacccagtaatgggattgctgagttgaatggtagttctgttttaagttctttgagaaatctccaaactgttttccacaatggctgaattaatttacgttctcactagcagtgtataaacattcccttttcttggcaaacttggcaacatctgttgttttatgactttttagtaatagccattctgactggtgtgagatgatatctcattatggttttaatatgcatttctgtaatgattagatattgagcattttttatatgcttgttggccatgtgtatgtctttttttgagaagtatctgtccatgtcctttgcccattttttaatggagttatttgtttcttgcttgttgatttgtttacctttttcatagattctggatattagacatttgtaagatgcatagtttgcaaaaattttatcctatctctgtaggttgtctgtttactctgttgacagtttcttttgctgtacagaagctctttagtttatgtctcacttgtcaatttttgtttttgttgcaattgcttttagagatttcatcatgaaatctttgtcaagttctatgttcagaactgcatatactggctgttttttctagaatttttatagttttaagtcacacatttaagtttttaatctaccttgagttgatttttgtatatggtaaaaggaaggggtccagtttccattttctgtgtatgaatagccacctatcccagtaccatttattgaatagggagtcatttctccattggttatttttgttgacttcgtcaaagatcagatggctgtaggtgtatggatttatttctgagttttctattctgttgcatcagtctatgtgtctgttgttttatgctgttttggttactgtagccttgtagtatagtttaaagttgggtggtataatggctccagctctgttctttttccttaggattgctttggctatttgggcccattttttatttgaatttttgaatttttttttttctaattctgtgagaaatgacattggtagtttgataggaaaagcattgaatctgtaaattgccttgggcagtatggccattttgataatattgattcttcaaacccatgagcatggaaagttttcccatttgtttgtgttgtctctgatttctttcagccatgttttgtaattcttattgtagagatctttcacctccttggttaactatattcctaagtatttcattctttttgtggctattgtgaatggtattgtgtttttgatttggctcttagcttggacattactggtgtataaaaatactactgatttttgtacatggattttgtatcctgaaactttactgaagttatttgtcagttccacgagcctttgggcagagactatggggttttctaggtatagtatcatattgtcagtgtagagagatagtttgacttcctattttcctacttggatgcattttatttctttctcttgcctgattgctgtggctaggacctccaatactatgttgaataggtgagaatgggaatccttgttttgttctggttctcaggggaatgcctctagcttttgcctgtttagtatgatgttgactgtgggtttgttatagatggctcttattattttgaggtatgttcctttgatgcccagtttgttggtagtttttaacataaggagttcttgaattttattgaaagtctttatttctattgagatgatcatatggtttttgtttaattctgtttatgttgtgaatcacacctattgatttgcctatgttgaactaacctttgcatccaaggaatgaaggctgcttgatagtggtggactagctttgtgatgtactgctggattcaatttcctagtttttgctgaatagttttgcatctatattcatcagggatattggcctgaagttttctttttttgttgtgtctttgccaggttttggtattggaatcatgctggccttatagaatgagttaggcaggtgtccctcttcttcaatttttggaataattccagtaggattgctaacaggtcttctttatatttttggtagaatttggctgtgaatccatctgctccagggctttttctggttggtagattttttattattgattcaattttagaactttttatttgtctgttcaggaattcagtttcttcctggttcagttcctggagtttattcatttcttttaggttttctagtttgagtgcacagaggtgtccacaatagtgtctgagggttttttgtatttctctgaggtcagtggtgatatcacctttgtcatttctgattatgtttatgtggatcttctcccttttttctttattaactaggcagcagtctgtcaatcttatttattcattcaaagaactagttttggtttcgttgatcttttgtatggatttttatgtctcaatttcatttggttcagctctgattttggttgtttcctttcttctgctagctttgtggttggtttgctattgttttcctagttcctttaggtgtgatgtttggttattaatttgagatctttctaatgttttgatgtaggtgttcagtgctataaatttcctcttaacactactttagctgtgccctacaaattctgatatatatttgttttcattagttttacagaattaatttcattgccttaatatccttctttacctaaaagttattcaggagcaagttgtttagttttcatgggattgtatggttttgagagatcttcttggtattgctttctttctttctttctttctttcttttctttctttctttctttctttctttctttctttctttctttctttctttctttctttcgtgctgtagtctgagagcgtgattggtatgattttttttttaatttgttgagaattactttatggctgggcatgtggtcagtcttataatacgtgccatgtgcagatgagaagaatgtatattctgttgttgttgggtggagtattctatagatatctgttaggtccatttggtcaagtgctgagtttaagtccctaatatctttgttagttttctgcctggatgatctgtcagtagggtgttaatgtctcccactattattgtttggttatctaagtctctttgtgggtctctaagaacttggttttataaatctgggtgctctaatgttgggtgaatatatatttaggacagttaagtcatcttgctgaattgaaccctttatcattatgtaatgcccatttttgacctttttgatcattgttagctttaaatctgttttgtctgaaataagaatagcaacccctgctctttttgtcttctgtttgcttgatagatctttctccatccctttactttgagcctacatgtgtcattgcatgtgagatgagtctcttcaagacagcatgcagttgattcttgcttctttatcccactcatcactctgtgtcttttaagtggggcatttaacctgtttaaattccaagctaatattgacatttgagggtttgatcttgtcattgctttgttagctggttgttttgtagcattgattatataattgctttatagttgatatggtttggctgtgtccccacccaaatcttatcttgaattgtagttcccataatcccgacatgtcatgggagagatcctgggaggtaattgaatcacggtgccagttatccccatgctgctgttttcatgattgtgagtgagttctcttgagaactgatggttttataaggggcttttccaaccttcacttggcacttctccttgctgccaccatgtgaagaaggatatgtttgcttctcattccgccatgattataagttcctgaggcctccccagccatgctgaactttgtcaattaaacctctttcctttataaattactcagtctcaggtatgtccttattggcagcaagagaacggactaatacagtagtgttggtgggctatgtacttaaatgtgttttgtggtggcaggtaccagttttttgtttccatgtttaacacttccttaaggatcttttgtaaggcaggtccgatggtaatgaattcccttaggctttgcttgtctgaaaaggattttatttcctcttcacttacaaaacttgtttgtctggatatgaaactcttggttggaatttcttttttttaaggatgttaaccttgaggtgacagtgtagggagagatgttcaaatcaagcagtggcttgaagcttctgttaaactagccagacttccaaaggcccatgcgcagttcttattttctgtttccaaatttctaataattagatttagaaatgctcagtggccattcaaattaaacacacacaaagcaaaatccttcaatcctttagatgttgtttagaaacttttaggaatagtttcaggcttatttgccaggccttacccacaggtaggaattgtctaagggtgtggtagagtggtctggagtcttggagcctcaggggccagacttaattgggagggatgtttcccatggtgtgacccaagaagaaaatttgaagctgtggtcagggtaaggagagataggcacatgtatcaagcgtataactcaagaacacacattggaggacagaagaatttctgagaaggtaaatgggcagtgaagtagagagaatgggtcagttggtttagattctagcttaaaaaaaaaaaggaatttgttgggagcatttcttttgggagtgtccaaactgctctgggttggggtggcccagctgcttagccacactgtgctggggtagacccaaatttcattacttcagttatcaactttgcctgtgaccacatgctgacaaagtgctggtcagttcctgactcatttgtttgccttgtatgatctccagagtcatgggtgataatcatgacttttaataaagaacaaagccctgatgtagattgctttttaggaagacacctagagtcaatggtaaagaaaaaaagaacaaaacaacttgttatacactttatagttcccacgtgaccatttacacacaccttctaatttgaatctcacaacaaccctggggcacagggttatctgcatttcacagatgaagaaacagaggtgagagaatttagtgatttgtcaagaccacataggtggtacgagctggagccggactccaaatcctagtcttctaacttaatccagtactttttctgccatcactttttaaatcttggcacacttataagctgcccttagcaatcctgcaccaattacgggaggtgatatcagtattttgactttgcttggctctaattttttcttgagactaaggagtaatgataaagataggtagctttatgtccaaagagtttcctttatggctatttgccattctagtgttttggccttagaagagataagactgtgtggcatctagaagcttgctttatttaaggaacaactcaacttggccataatatgcataagctgttgtgttctagaagagccatgagaagtgctatggaattttcacgtttaataaaaatgcagttctcatagattatcttggttaagtctaagaagattagtttgtttttatctaataaaaagtataaaggtgctttacaatgtaaaaagggtcagttgtttagtaatttaaatgtccagttgagggttctcaattatgaaggaaattgatttaaatgtagcttataagatatcaagcactaaactctgtgatctcaacagattccattgttcttcttgtaaatgttttggaagaaaagttttccatagaaagctagacgaaactccaaaggaagttttagacccttctagagtttacagatgttggttgaacagaaatccttaaaatctgtgagatggacttctaatgagaaagccaataaaatgggtcctttggttttgtctattgtttttgtttttatgagaaaaataatagactgttgtaaaacaaagtataaaagaataaatcaaataataatgatttttctttcacacaaaagatattattctttaagttgttttggaagtcaagtttgcagaaaatttgctttcattagtccttttttctttctctctctgcctggtcacttccttttgcccatcagcttctattgacttctcagttgtctggctgtggaggacaggttcatgccaggaataaaggttcctaccttgtttcctagggaaaaaaaatgggcttacctgatatcgcagataaccaggaaattccacttcctctttcagatgtgtgcgtgatatgtccctattcattggttcaccttcccccttcaaaactaaaaatgaatgtgaacataccttattaagtaggatttttaaaggcacggcatcataaaacttgcaacttctgtaggaagagcctaggacatgtgttggaatcacaccagtgatttgtgttgtgtgttggtcagcttctcagccgctggtaggtaggtcagtactcacagtgtgactcttgtcccacaaggctaatggtgaccatggttctggcttctgaggccagcagagaagtaacaatgtgcatgaactgccgtggcaccagctgctcctatgtagacctttgaagcatgaaaaatacatgtctctcatcattcttagtatatttacttatttgctcattttccctgtatgtacctggtttcctgaccctgccaactatcttcttcactccagctgcctccttggccttggcatcactggcctccttggtctcctcagctctgaccaccaccttggtccagccttgcaggcctctttgtttctgaccctgtagttcctgtacatctcctcagccccagctgcttctttggctctagccttgctggtcttctcatttgtggctgcctcaaggggaaggaagggaagaaaaggaaaggaaaatgtataatttctaaacttgtaaatatatgtatttaagtctaaggaaatgttactcagtattccctttgcttaaatttatcatggatgtatctctgtctttcaggagtgaaattatcaaaggatcagctgtgaagttattagatactatgttttgagtagaatgaggcttctgcagatataaggacatctcattgtctcctctgtcactcctctgctggtttggaaacatctataggaaagcatcttctatagtcatcatcaacctaagaggccaacatcttgccatcctattttccttttttgctacttatgctttcatttttacattttgtaggtttccacataagtaagtgttctctttgtatacaaagcagcttttcttatggtgaaattcatttattttggtcaaagtgattgtcctgtactggtaagctcaaactgattgtgcttcagtaacaaacaatttcaaagtctcagtggcttgaccaagcaaaagtttatttcttactcactctttatatctaacataagtcagcaaaagagtttgttcatctaagacacttatggagctgggctcagagggctccatctcaacacgtttgtccacaatcatggcaggaggaaggtaatgttgttaattgctctctggctcttaacatctgccagagtgactggcatcacccctatgctcattcgattggccaaagccagtcagatggatgtgatgaacttcagtgagggtgaggtagtacagtcttaatatgtgtgaggatagctggaatatttggaagcagcctaatgacaactgtactttcccatgttgagtggctatgagtctcatcccatcaaatcttggtgataccaatgagaaccaatttactttctcatatacaaatacgaagttgacattttttccaaacatctgggacaatgaatattgctcttgatcaaatttcaagttattttcatttaagaattagacagacatactgtgatctctttttatgttacacatttctctcatactggcattttatctgcacatgatctggtgaaagcttacttggtaatgatggcttgtcactttcttccctgtcttgcagagttcatggtctcttttcaggagccagtcattctaatatcctagttcaagaaaacatcttcttctgtttattagttgttcaatttctgtagtcctttttcaaagtacttagcttcaggtggaagaaagtttcctaataatttctaaattagaaattgtatgctattttctacctactgtgccatttgtttccaggagagtcagctgaggcgagtaactgtggatggatctagtgcctttttgcaggttattgccaaatattaatagtaatgacaacaaaaataatgacctattgtatgtgtatagacactaacagtttaaccatatgagatctcatttgatcatcattcatgtggcaggtttcagacgaaaatatgacaggccaccactctatattcagggtagagacgctccatagttttttagaaaatgtttgaggaagatggtttcttgttttgtctttagaaaggattagaatgggagagaccacaaagattaacacccttagtccattaggacttctctaatattgggaaacccttattctgtcaagggccactgatggaacagtaaaaaagaccagagaccacctacataggaaagcaatataatttagtcttttaatgagaagttataaaatgttccaagaagaagcaatataaaagtctacttaattaacacaagaaatagcaagatacatgcttcatttctctattttagcctaaaaagggaagggggacagagaggatgaagatcacaagggaaagagtcatatgaataaagaaaacaggaaagagaatctgataaaggggggaaggttgcttatggaaaagcacataaacacaaatgcagagaaaccacaaacaaacacacctgtgtgcattcacttcccaactggcttccggagaactacataagcacatttgtaatcatggagtgctgtgaaatagcagcatcttgatttattctttcagggtattgccagttatagtgtaaacaccttgagaataggaacatctctagatgtttgtgaaagtgaaagatttttatcttcttaatgctgcactgcattttggaaagttcaggtatagtgtaggtgtattgtccttcaataggaagttcggagaagggccacatttggcacatgattcagagctccctcactttcagtcaccccaggtcactcttcctgttctgctccagtacctaccttccaaaagcaaactccggacaacagcctatgtaatctagtagggccattttacatgccagatagcatagtttcatacttgcttaaactgttgacgtaatctgttcactgactactttttcatcattttgggaaataaataacataagtagagatagatttttattcctttatcaacaaatgtttgagaaccagctatttaagcactgtgctaggtactgtgtattagaagtcagtaaggccagcataatccttattattatttaattttgtgggaagacaacaataaaataataactaaagtgttctaatagaaatatgcttatttcacaggtaagcactaatttttcttttgcctctctttcacccctttttattcccttatgtatttttcctgtaattcaattaatagaagaaatctaggataagagcttattccctttcatgtaaaaataccaggccaggccagccctaggcaagcatgaccatgtttctcatagtccttcttgcagctctgcattgaccacgattccttcttaactctctaggttcctttttaaatggcttgaaattgtttcctcttttcacattttgcaagaatgaagttttagggaagttctggaaaattaatgggaaagtaattccctcaagagagtgagacacaaaaatgtggctcatccagggagcagcttcagattcttcccttgctaataagatgagagcaagatgatgtgtattgagaacctgccatattcaagacactctattaggttccaagggggctataaagataaagagggcacagtccctgccctccagaagcagtatatggtaactataattagaaaggaacacaaagtaattaaagaagtgtgccgagatgggaggtatggatgcctctgactgttatgtttttggagagttttgtgaaagaggtggcatccaggctgatactgaaagagatgtggggattgcagaatcggactgggtaggatgctgatgcagcatcttcattctggtactctgcatgctgccagtggacaggcaatgatggtgcagggcaggtatctcaagtcaacggggagaggatagtgtcacaaccataccatttgggggactgttgatgtttcttgatgaattgaaatacgggggctttcatttgttgggcaatggaaaaatacgctagatttcgatgcaatgaaatattcacaaatgccacaatcaaaatggcaatttgggaagtttgttatggtatgtatgagcaggttgattagaggggagagggataccagttagaaggtagtgcaatggtacagacatgggatgataagaatccaaactacaaaggtagagggtagaatggaaagaagagagtgatgggctctgtcttgtaatgtgtatgaccctggagttatttacagaagcttagcatatgccagcgtgtaaaatgcaggtgagggtgactacagtggagtgaggcaaaggttttgatcagcggagtaaaatgtactatggaacagaccttgaaggctcttgctactttggaaatctgagaaagggaagccataaacatgaggagcactgttactctccataaaacagcattatgctgttgattttcaaatattcacaaatgcttcttggaatgtacttttccatggattagtgtgttttatgttgaaagtgcattttttttcatcagcgagtttgcttttaaaatcaggtaaagatattttccctttaaatgtaaaatgctaatttaatttagtctttgcagcatgggaatgggatactaatgtggctgaaaacagcagtttattttttgtgggtttgaccatttcagaagtttaacatttttaaaaaatattattactaggaaaataaatttgaaaccacattccagcttcaatgaggattattcaagtgtttttcaattatattgcttaaatgctccaaagagtctttgcctcagagcacggactttttattatgacttcactgcaaagggaaacagaggactctgttctgggttctgaagtggttttcctcatccatctctggattgctcttcttggaaaccaacttttggtttagcctagtggagctttctatttgttagagaaattgaccagtaatgtgtagttatatgattgtgcatagccagctacagccacaactacttttagcccctcactcaaacagtgggaaaatattctagggtatgaaagtctcagaaagattaattatacacgtacatgataaagatttccagttatctcagaccagcatatttattctttatgattaattatcctgagatagtcttcattcaaggtaatgaaatattcttaaaatacttattgctttttagcttgatagctgaaaaccaatgctctgcattcttctgtatttataaacctttatgcagtttggtgatatgaggctacgtggagaaactcgctgcataaagaatgagggagatgatggtccagctctcccttgcagtcatcagctgacgtccagaactgcattcaggcctgggaaccacccttcaagaagggcatacacagactaaagtgtatttggaagaataaacaggtgaaggagactggaaatttgatcatgttggaacttggaaggttgctctggagagaagactcaaatagttgtggtatttcactgctgcagtgggcagatggcagcagccatagttttggctacctagcatctgggccccttttccatctcagggaaatctgctgtgtgtatgttggtgatggagaaggtcttgcattctatggtagaagctgaagggtcagatttgtctcttttgagtcacttgacatctgcatgtggacaagggtactaggcttcttctggtgtccgggcacttgtttatggctggggctttgagtctaacaggcataggtcagttgataaagtgtctagattccaatgtcatatccagactgctcttgtggaatgattttggcagtgttcttcactggctgcttcccttagcttctaaccacttcccacctggtttcacgttctaatagagaatggaaatatataatcctaaaagattttgtgagcttctcaatatcttcaaaacaagtttcttttttgcttaaggtagttggtgtaggtttctgttgtttacaaacaagaatgctgactgatataattactaaaaacataatgatttcttatttctaactggaattattttattttttactatttagtgaattttttctttaatttttagttaacatatgacaattgtgcatatttatagggtacagagtgatatttcaatataggtatacaaatgtgtaatgatcaagtcaagataattaggctatacatgacctcaaacatttagcatgtctttgtgttgggaacattcagaatcctcttttctagttgcttgggttttttttttgtttttttttgagatggagtttcattcttgttgcccaggctggagtgcaatggcatgatcttggctccctgcaacctctgcttcccgggttcaagcaattctcatgcctcggcctcctgagtagctgggattacaggcatgccccacgacgcccggctaattttgtatttttagtagagacaggtttctccatgttggtcaggctggtctcgaactcccgacctcaggtgatccacccaaagtgctgggattacaggcatgagccactgtgctggacctcttctagtttttttgaacatgtataataaattcttgttaactgtagtcactctacagtgctataggacactagaacttattcctcctatctagctacaattttgtaatcattctcttcctacttgccttcccccactacccttcctggcctctagtaactataattctattctttacttccatgagctcagttatttttagctcctgcagatgggtaggatcatgtggtttttaatctctctgtgcctgatttatctcacataacataatgccttctaggtttatccatatttctgctaatgacaggatttcattcttttttattgttcaatagtactctattatgtgtacatgccacattttctttattcattcatctgttggtgaacatttaggttgatcctatatcttggctattgtgaatagtgctgcaataaacatggggtacagatagccctttgatatactgattttctttcttttggataaatacccagtaatgagattgatgaatcatatggtagttctatttttagtttttttagaaacctctatactgttttccataatggctgtactaatttacattcgcaccaacagtgtagaagagttcccttttctctgcatcctcaccatcacttgttatttttttgtctttttgatagtagccattctaactgggtgagacgatacctcatggtggttttgatttgcatttccctgatgattagtgatgttaagcattttttcatattcctgttggccatttatatgtcttcttttgagaaatctctattcagaccctttgcctattttttaattggattttttgttgttgttgttgttgagttgtttgagttctttgtatattctggatattagttccttgttagatgaatagtttgcaggtattctctcccattctgcaagttgtctcttcactctattgataggtttcctttgctgtgtagaatctttttagtttcatgttgtcctatttgtctatttttgttgttgtcactggtgatttttgttgtcttacgcataagttctttgcctataccagtgtcctgaagcatttcccctgtgttctcttctagtagttttatagttttgggttttacatttaagtctttaatccatcttaagttgatttttttatatggtgagagacaggagtctatttgtcttcttctgcatataaatatccagttttctcagcaccatttattgacaagcgtatcctttcctcaatctaactggaatttttaaccaggattcaacaatagctttatggaatctgtgtgtatgttgtgttatatgcagtattttggttatttgttcattcacatgggggagagagtccattgttttatttacttctcaaaaggttctgtaatccctaaagggccaagaaccacttatctgcaggatacaatttaaacatcttagcatgacatacaaagtcctcattatctggctggcctcagcccattgctttgattttctctcctgttacattctctgttgcttctatttctttatcctcttttcatgctccagtagtcaaagtactttgtttctctaaaagcacctaatggtttataatctcgacgtctttgctcttaacgttctttctgcccaacccttttctttgcttcttatcccaccatttcattggtttgctgaacacctactcatctatttagacttcactggtttaattcctatgtggatgtaatgattactgtgctatatcctcttggatatatccgtattgtactttatattctgatttcagcattgctggcagcccatgttaagctagcagcttgtatgagtgcctcttctttgtagccattgtgcgttctccaaagtcactaaggcagatgtgttacccaggcacatctttgtggagaagttaacccttctagggggaaacactcaaacaatgagaatgtgaatgggtcaatgccccaggcttcccattgcctgtgggccaatggtaggcacattcgacatgactcttcagagagatccctgagagattgggccgggggctgtccacacagttaatctgctcattaagccccctttattggcttgctttctttcctgaatcacttttcttcctctttcactcctgctttctagattactgctccctgcatccaagtctttatctcaagctctactctcaggtgcatctagatccagacaccctcttgactgtgtgcgtctattttagctgtgagatgctgctttagcatctcttgccctttgttgatctcatttaatgatttctttctagtagactattacttgtggggcgtaaacagcttatcttattgtgatgtgagtgggcaccatccaactggctgccagtatgggtagaacaaagcaggtagaagaagggagataggttttgctgagtcttcttgctctctttctcttcctgtgtcagatgcttgtttcctctcctcaggaaggacatcagattctatgttcttcagccttggaatctgggacttaaaccagcagccttctgggggccctagggcctttggcttcagactgagggctgcactgttggcttctctggttttgaggttctcagacttggactgagtcatactactgtcctctctccctccccagcttagagacagcctatcaaggagacttctccttgtgattatatcagccaattctccctcttttgtatacctatatatcctgttgtttgtgtctcactggagaaccctgattagtacacttattcattattggtccctaagcaggtacatagtggaccctcaacaatgtgtaaaaggcacagtgcatgagagctgtcttcagatatctgaagggttaccttgtgtttacatatgtctggggaacagaaccaagaccaaagagtagaagttacaggaagacagattataattcaatacattgtttatcagtgcacctatgggaggtgatatttgatagcaacagtaacagtggctcattatggcatgatgacccactcagggaagatatttgcccactcttctgctgagaagtcctattatagaaagttttatagaacaaggaccacaagcacatacctgcaaggaccaggctggcatataaactagtgaggcaggctaagtgtcacatagttgggaatggtgagaactgtgtggaataaagtgtgtgtaccctgactcaaaggggtaggtactccttagctccagccaacagttgctagacagtaatgcagatccagcactgtcagaccttccagttttccaaaagtaagtagaaatccagattcttaggtaaatcttccaatataaagacatttgagtcaagaaggcatcaccgtggctggctatggcacatgggttgtttgtaatctttgtgtagtggatgtagctgaggatgctaaagcctcagatgtgaggatagctttctagagagccagattctggtcagcttgctctcttcaggcccatgaacacactctgcctgttcccaccttgggcctttggccatcctctcttcacagaagggacactgtgtggctcaggcccctctcctgtgacatctcccactactggtccttccccagcaagccctgtcttcttggtgcaccttcagcatttccagcactcagatgtctgctgcaattgctcactgtctagtagtgtcatagtttgtcttatctgtgtaactaagttataagttcccttaatgcagaggttctacttcatgtggctttcctgtcatttggagcacagtattgggtgcatagcaggtgctcaataagaactgttggttaacttttgctagatgactatcatactcagtgcttatggcatccctcttagtagaagatgaggtaataaagaagaggccaccagctcttgcatggagaacttaaaattaaatcagtgaagctctttcagatgactcagtgcttttggcattgctcttagcagaagatgaggtaataaagaagaggccactagcccttgcatgcataggttaaatttaaatcagtgggactctttcagagatgaaatagacatgtcctctatctactgttgacctgctgtcctcagagcttaaagtggcgctcagtgtgcctcacctgtcaaaggctttccctcaccatttcccaccagagatccaataaaataaccaattatgtgtgccctgatttagattccttgattagagatgggttctgatcataaactatgtaaccatcttttaaaggaaaacgttaataggcaactctttgttacaaagattgcctaaaagaaaaactaattttaactgtttacaattatccatttttatattctttctcttttatttgaaacagattttgttttagaaatctcttttctctcacatctgtaaagcaaaatacaatataaacaattctcagtcatctgtgataatgaatattagggtatactttgggcactgaagtttactaattgtttccaaactttattttagcaaactttccccactttttggtgaggatgctagtgagtataaattgttaaaatagtatgtctcctttatattccatattgtacttgtctcactactgtttatttagcctagtttcagtgcagttttgttacaaggagaaggatttgaattatgcattcaacaaacatttattgaacccctactaagtgccagatcctattttagctgctagagatagttatgaagaaactagacaaggcccttgctttcttggagctgagcttccattggtgggagacaaccacaaaccaatgaacaaatgaacacacaggaaaatattggatggtgataggtgttgggagcataaaatagaatggagaaaatatgtatgtgtgtgggctactccagattggagttgagtctcttcaaagctgtgacatctgagtgttgaaccacaagaaggaaccagccatgtgaagatcttggggaagagcatttcaggacaacaaaacagctactgccaagggcctgtcacaggagccacatggtgtgctggaagcacagctcggaggctgggcagaaggaatttagccaatataatttattatacaagccaaaattattagcaacaaaatgaaatatttattttgcagtttaagtatatatagccatgaacatttagatttcagaatttgtgccatgatttcatgactagattcagtaattatttaagattcacattggagaaaatcagtgttctgaagactatgccgtatatcccgctttgaagttttggatttttcttgaataggataggccattaacaatattggaggaaaatatcatctagtgttatattcttaaattgaatttgccttggaagtaatcatgcatgcaatgaacatagtaagaaacagcttctttcatcctttaatgtaataattgctcccaaggattacaagagcttatagacagctggaacatccagctataatgttagctggacagggaagaaagttgttatggataaagcttcagattttcttggattttttggtatctgtataacagagacctgatgagttgccagcacataacaagccagaaccctggatccagagagcatttgtgacattcagccaacacagaactgctttcccacccaaagggtggtctccaaatctgttgtagcttttggcaagatttttatatcacaattgaaaacagatgccctttctgccctttcccttgttgtctgagttactaccgttcaagagattgcaagccatggcaatctctcatgcaccttcagaatgcccagcaagagtcctcgttagacattcctattcagaagtcctgctgtgacacacttcctctgcaagaagagaacagattcaggaaggtgccaggattgtgaggttctggtagtctgcagggtgtactgtgaatgctttttgtcaaaatcaaagcaccagtcctgggtttaatagaaaacatctctctggatagtttctattttaaaatatttaatcctaaaataaaatatttaatcctaaagaaatatgtaatcctaaaggaaaaccaaagtgtactctccctgatggactatattgagttttattacaggatatggccctaaaatgtgcttggatgggatattgaaaatccagagtatcaaaaatcactaaactactaaattcttgattgactaaaagagacttattagacataacaactgaatataatgtgtggaatttgtttggatcttggtgtaaaccagttgaaatgtaaactggtggacaattgggaaaatttaaatatggactgaatatcaggcaatattaaggaaccactggtaattttgttaggtgtgataatgatatagtggttatctacgaaagtaagagttataaggacagtgctgtggaggggaaaaatgaaacctgaaactttaataagatttattggttcaaacaccacatgttctcactcgtagctgggaattgaacaatgagaacacatggacacagggaggggaacatcacacatgggggcctgtagtggggtgggggtaggggggagggatagcattaggagatatacctaatgtaaatgacgagttaatgggtacagcacaccaacatggcacatgtatacatatgtaacaaacctgcacgttgtgcacatgtaccctagagctcaaagtataatacaaataaataaataaataaacaagaaaaatcaagggcaaaaaaaaaattattggttcattagtagaaatgtaaaagtgcttcagaaaaagtaatcatagtttaggggagaggaacctaggggcagacccaggaggagagaaagtcatgtagaaaaggagattttgaaggatgttcagtgtccttcagtggaaagacactgccagctctaaatggctctgcaagggaggagccggggaataaatcctctgacatcactctcttccctcccatctattgctgatcttttcctgctctcaaatctagatggcaagggactcactggtgtagtctatacaggtcagcctttggggctgatagtagggtggaaaagggcagagagtaggactggggtgtaaacaaaagctaccagtaacagcatcttctttacaaagtataacaatatggggggaatgttgaaggatagatacttttggaagaagcccttcatagaattataaaatgttagggctgggagtatcctgagaagtgattctcaacctcattttagaggtgaggaaataaagggagcattatacaggtagcaatttgtgtacagctagttgtcacagatctgttaagaaattacagactttttgatatgaacagacacttctcagaagaagacatttatgcggccaaaaaacgtgaaaaaaagtgcatcatcactggtcattagagaaatgcaaatcaaaaccacaatgagataccatctcacaccagttagaaaggcggttattaaaaagtcaggaagcaatagatgctggagaggatgtggagaaataggaatgcttttacactgttgttgggaatgtaaattagttcaaccattgtggaagacagtgtggcgattcctcaaggatcttgaactagaaagaccatttgacccagcaatcccattactgggtatatacccaaaggactataaatcattctactataaagacacatgcacacatatgtttattgcagcactattcacaatagcaaagacttggaaccaacccaaatgcccatcaatgatagattggataaagaaaatgtggcacatatacaccatggaataatatgcagccataaaaaaggatgagttcgtgtcctttacagggacatggatgaagctggaaactatcattctcagcaaactaacacaggagcagaaaaccaaacaccacatgttctcactcataagtgggagttgaacaatggacacatggacacagggaaaggggaacaacacatactggggcctgtcagtgggttgggagctaggggagggatagcattaggagaaatacctaatagagatgacgggttgatgggtgcagcaaaccaccatggcatggtatatctatgtaacaaacctgcacattctgcacatgtatcccagaatttaaagtaaaattaaaaaaaaaaattatagactttttgattttcagccctgtctctttcccctaggcctgggaattttcataaattttccaaaattttcccagacccaccacaccagctcagcaactgttcagcatgggtgaaaatggtaaggaagtctcagttgttattcacaggaatgtgtaagcattatagacatagccattgcaatataccatgtttctgtagctgaaattacagtgtcactgtgggtaatctggaaaatacatatatgtgtcaaaaggaaaataaaatcacccataatggaccacagagataactaatattaacattttcgtgctttcctatcagttttttaaattaaaatatacataaatatgtgtatgcaaaattagtatcagttgtacatatagttttgtaggttgttttttcacttaataatgaataatttcctatatatcaaattgccttagaatctgagttttgatagcagtaatatttcaaaaatgaatatagcataatttttaaaagtcctctgttattagatatttgtttcttattttcttctatgataaataatgctgcaatatatatatataggtacatatataaacattatatatcccatataaataattgtgtttatctgggacatataatatttttatttaaaaaattgccaccataagaatttccagtggtcctttctgttggggcagagtggaaagaacatggctctagggccaggcatccctgatctgtttggcttccgccacattctggatgtgtgtccttaagcatgtcacttcactctattgagcctccttctcttttctgttaacagggatcatactgcacatccctcagtgctgtgatgagaactttatgaggtagtacttttctttctttcttttttttttttttgagacggagtcgtgctctatcgcccaggctggagtgcaacggcgtgatctcagctcactgcaacctctgcctcccaggttcaagcaattctcccacttcagtctctcaaatagctgggattacatgcacccaccatcatcatgcccaggtaatttttgtacttttagtagagatgggttttcaccatgttggtcaggctggtcttgaactcctgacctcagatgatccacctgcctcggcctcccaaagtgctgggattacggatgtgagctaccgcgcctggcctacacaaagtagtattttaaagtgtttggcatgtagggtgtactcattacatgttaggtctgtcttcatttgggatggattagattgcacacaagtatatgcacatgtgtgttgagtgaagtgaaggaaatatagttacaagattttattcagtatcaagaaaaaagtaaacctgacttgccgatagacacatttcaattgaaagaatcctttcagcaagagagacctattgaagtttaagatactgataatgaaaacagaaatgaaagtctttaaaagtgtatttttctttatactgggttgtccagtaactattcctaacctccttccccatcctcttccttcctcagtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggtgaggcagcctggtgggggccaagggatgccatcaaataatattgtttaaattaatggaaaaaaatgcaacatttcataatctacgggaatgaagatcattccccacttcctatatgaggagtctctgatgatacagagctacacttgttcccttctaaatacctgtaggatgaaagatttgctacctggctccatgattttatgaggctctgggtttggagtcagtttggagtcagctctttacatcatgagaaagacctttccgtctttggatgattaggcctttcaggatggtaactttgctcagagctgggccctgttaactttcttatgatatgttttattatactgctgctctgccagaaactcctgtccagtgtcctaattaagtttagtagttctactcagaagaagggagaaaactgacagaggatctcaagcttgatgggagcatgtggggagatttgctgaaggaatcacccagaaagccagcatttcctgccttctaggtttagtttaggcagtttgaggaaataaaggctgaagaaagcccaggtgatacatggttaatagaggcagaaatgtaaagaggacaactctttcacaaagcctaaaatcagctttcctaaaattgtgaaagaatggagataacagagttagtcctcttacccaggaaggagctcagtgaccctgggagaactgaaactgggaaagttctcaaacgctagatgttacttcactgtgagaacacaatgctacactacaattagtaatggaaatgtaattaaccacttggcacttgtggcttgcctcagtcattgccacactcccagcctgaaaagtttaaaccaagtaactccagtgatcacaaatggcctgggtaatccagcttgtcaaaagacttgaacacagcattgatgaagatcactctgctgacatgtttgctcactcatttccaaaagccttccccagcttgtttcattttaagtacccttttctgaaaatatcaagggcctagtatatggaagggacaaatattgttcagttctggaaataagaggaagtggaattatttctgcagagatcaggaagaaatgtctttgcctggaaggaagtgggatggttggaatcccacctgaaaagctgcggaagggcatttgccagcttcctggaattctctaataaactttctcttcctagagtggtcaacctgtacttgttttcatggagcttacattctcgtggggaaagagagaaatgacaattaaaaataatttgaatggtagtgataagtgctatggaaaaaaatgagaaggaatagagactacaggtttgggtgggtactctttctgtggagtggttgaagaaggtcactctgacgaagagatctttgagcagaggcctgaaggaggtgaataaatgagaacagcaaatgcataggccctgaggtggatacttggctgtcaggtgtgaggctcagcaggatcagcatggcagagggccaggaaggaaggagaggtagtagatgaagtaaggaaggaagtggggagccacaccatataggccgtgtaggccatcggaaggcttctggctttgagaagagaaagggggcaatggaaatgctaggcaattctatgccaaatatgcctgcaaggaagacttagataattgctgtgtgggtataagagagaaatcaagacgactcctgggtttttgtcctgagaaactttccttgtgcctctaaaagccacatttttgaaaagcacacttcaccactgtaggtaagagttatcttagagtaccataaaatattagatcaggaaggggtcttagagatccaggaaggcactaagagatgaaataatttgagtaagtttcacatatgagttcattggaaagcctggctcccaatccaatgattttgccacacgtgcctctccccttgggttatactaagatgtgattacacttaaatgtgggtcatacatacgtgtgtgtacgtgtgtgtttgtaacctattttcatctcctagctttgaagctttatgatggaggcctttgttgtcatagtttccagcatttgaacattaagcaaagtcatgttgagcaggaacgtaatgtgtagagtaggatgaaaagtgggctggaagtgaggaagcttggattccgactctcttttcattctgagctctgtgagctggaactgttgcttcgctttgtgttctccattggctttttctgttctagcagtctacagacctatacatttaaaaaatatggttctagtgaaaaagcttatggctatgtcttaaatgggtttggaagagtaccttttatttatcttttcattttgtttgtttttggaaaatcctttcttaatggcagctaaagtgtttcattttcatttgctgtatttattttctgagaaaaattcagttctgtgaaaaattcaggagctccatcactttttcatgattgttttgtttggaaagccaattgctaagtatcaaagttattttctacttattcgataaccatatagggtccaagttttccatattgaaagattatcttctggcttgttggccagaatagttgtctggtccttaaagcttcttatataattaattttttctttgctgtcactgtgaccagcagataatattcttcaaatgtttcagttggctgcaagttactgaaaggtcctaagtggcagagcaacctcagaggaggatagccccaggggaattaagttgatgcaggcattatgtccttccctccttcaatcaatacatattttcacatgggtatctttgtaccgtgtgaaattgcagtctattctctactttcaaaagctgtgactttctcttgccgggcccaattgctcacacctgtaatcccagcactttgggaggccaaggcgggcagatcatgaggtcaggagatcgagatcatcctggctaacacggtgaaaccccatctctattaaaaatacaaaaaattagccgagcgtggcggcatgcgcctgtagtcccagctactcgggaggctgaggcgggagaatggcgtgaacccgggaggcagagcttgcagtgagccgagatcgcaacactgccctccagcctgtgggacagagcaagactccatctcaggtaaaaaaaaaaaaaaaagaaaaaaaaaaaaagatgtctggaaagtaatgaggcaagaaggaggggttcagaagaatgcagaaattagtgggaataagataaaggatggataaaggatggggaagacagacggtacaagagtagcaggtagtaacatggggaaaggttcgaatgaacagtggagctacttgtaagccctagttccttctgaagccttgtgactgtctcactgggtcaggcagagaaggtgttggacatactggaaggggtcctggcaaggcctggtgtgagccactggtgccacagacacaacctctagcaaagtattgctttgtttaaaaaccaccaccacctccacaattaccctgccaccattaaaaatgttaacatcagtagggaaggtgtgactaagactgggcagcctgagcaggttgcttgttttccccaaaagagggaggaggagggaagctgaaatgggttcaaggaggagcactgccaaaaataatctttacatcaccctccctggtccacttatggcacttcaaaattcctttagtgtttctgaagggcttcttggaaactatttgtatgaaaagacaactaattgagtgagtaaattaacggcttgaatacctagaatacctaagttgctatacacaagcagaaaatcttacagtgatctgagctagactgaattaaaaaggcatctcctacttagcatataggacaatgtatagaacaactttgtgacccaagtggagagaaggggggttgggaaagagcaccactgctagctgtctttttcagttgaaccttttcctgctcttcaagagaaaatcagtttagaatctaaagaaaggagcagggaggatgaaggaaactatacttacagagtgaggcttttttaaaaaattaaattaatgttagaacttaaattatatgaaacaaagtaaataatgaaggaaaaagataatgtttgctgaattataaagtatcttttgtagccaaacaaaatgtaaacagaaagaaatgactaaattttaagtagaatttactggagaacacaaaacaattttgaaaccaagtcagttatatgtgagacagctcattcactattggttccctcgttttacttaagacaaaatggttaatgccttttgtttttgttttgacacttgttgaagttagagaggattaattgctgcattatcgcccaagctattaagggagatgaatgacaaattttagtggatcaactatgattacaaaagttaatttactttgtcttcctcagaagtctttctgcaatgtattccatggtgaggctgctcagcctctcgcatccattcttcaacaaggtcataatggggaagaatgaagtgcaaatccattgttgcatgctctttccccatgaccttaagtgctaacatgcataccctgtcaaaaaaaaaaaaaaaaaaaaaaaagagggagggagccatttcacctccccttaggggttcacttctctttgggcctctttgacttatgaatatacatgccatttgcaggacccaaacccactgctcttcaatggcctttaagtggcttacatttctaaagtagacatgtgggcatattttcttatcctttctcatttgaacactgaaggctgtggtttcttgactgtaaagcaatttgaaggcacggtgtctaacctggctgtaaaaatcatagaaactgctagaagttcccttacctgtgactcttgccatttcccagagagcagaagctagaagtcttctcaagtaaaaaaatacactgctgactgcttatattatatataatttttaaaatattttaagggaaatatcgtagtccagcagccatttattagaacctagaatttctagaattgtgctgggctggggtcagagagatggatgtgacctgttcctaaattctagatttcctgaaataatttatttcatatccatttgtataatatatatttacttatttagaaagaaatgacacagaatttaaatacaaggcataatttcttaccttccctctttttcaagtgtgtagtgcagttgggtctcctggatctcctccccaccctctccattgctctgtatcttgcaacttagtaagtgctttatggtcgaattagttcacttaaaagtaggaaatttgactttggctatattgggtgcctggatagttaattctgtgaatacacaaggatcaaagagtaacattcctcataatctccatccctcatctgccctagcctttgccatcgtgctttataaagtagaggctgcctttgttgctttaacaaacccttctacattattcccaatctagtcatcacaatcatcaaagtgggatccgagggattttagggttttggtttttgtaattcttgtattgcctctctgatgtgcaatagctcaggagatatatttttaatgttttattgttcttccagaaaaaggcgcaaacatgaaaagttcactaaacacccttggttcacttacttttctttcttaatttaaagggtatatcggtctcctaactttcggtcttctcagaatttctatggcatatgccaaagggcctattaagtaccagcagggaacactgcagacagacctttctgcctttataagtgtatacagctgcgcaggctgctgaccagctgctggggcagccctgacttgtgatcagatgtgccactgacttgggggcagaaggctatttctaatagcacttatcattctttatttgggaaatttgagccctgatttcagaccatgtgattgatgcaattcagtccattttcatctgtagcaggcagggtggtgacagagcagctctggagactcagtagcaaatatctttacctacaaagacttccagcttctgctccctggaaactagtaaaagtctcaggaaaatagacctctggcccagttcctataggttttacagccagattaaaaataatactctgtttgctttaggttcaattttgaaaaaccacagctttcaaaaactgttcaaatgagaaagtataataaaatatgccttttagaagttggattgaggacccttaaagacttgataacttgagtccagcaaaacggcatattttagatcttagaaaatcaagtaagaaggcacagtattcttctctagaccatgtcatggctggctttaatgcccatattttagggtcttccagagacacttcagtgacacctcagttttccccagcatcttccacagtaagagtttgatacgactgcatatgacaaccatttttttttttttttttttttttgagatggagtctcactgtgtcacgcaggctggagtgcagcggtgcaatctcggctcactgcaacctccacctcctgggttcaagcagttctctgcttcagcctcctgagtagctgggattacaggtgtgcacccggctaatttttgtatttttagtagagacggggtttcaccatgttggtcaggctggtctcaaactcctgacttcatgatctgcctgccttggcctcccaaagtgctgggattacaggcgtgagccactgcacccggcatgacaaccattttttaaatccaacaaactgcaaacaggccctttgccaacctagaaatttagaataatccaaggatcccaaggtcagagaaattttttagcctggatgatgggatttcaggcttagtcactgggccataaattgaatgttaaagggataggaggagatcagtgatgtttatttgtttgtaagcattttttttctttcttaaatacctatgttcatttgaaaagcgtattttaatatatataataaagcagatgataaaaagaaatcaactgagaagaatcactgacaggaaaatcaattactgacatgcagtaattctgatgttctagagtagaggtagtattctattgatatgtccaggaagtaaaatatctcatttagattgaaaaaaagagacaaaattgtgctaaattaatcatagagcctttaatccactagtaatttggagtgaattttattaagaagaattaattgtaagtacatgttaactttcgtgtcaggataaattgcatcttttaaagctaagtgatctgtgtacattgtgatagggcctttcactttggttgaaatcttaggtttgaaactgtgcctggtttacagtaactaaaattaactctagctgtgtggtcctttatatagttgttatcatcccaatcagatatatctcatctgatgtcaacttctgagtccaataatcagactagctccagaaggcacagggaaggtggtgtggacctctagggactgccctctgctttgtggaaaggcttggttaattttccattagagattcaaccaaccaccgacccaacctggagtttaataacaagctttttgttgataagtttattcagtgaactaggctatctgttctaggggactgattcttctttgaaacagcccggccttaagaatgcagctgaaatagccattggggaaaacttgtataagactgtacattttaaattttgatttgtcctcatttggagtgaccttctgattcagggttgcctacatttcttttaccattgcctgttttatcttaacgcctccttcctgatttacgtgtaagcttgctatacaactcttcaagtggctactttatggaatcaatattacagtgggttattgccagtcatgaaatgggaggagtactgttgacttaccacttggagtcaaaaccagggactagatttagatacaatgaaaaaattccaaatcactctctgaaacagtataaatgtcttaatgtcctaaaatgtttgatgacacctaaaaaccccgcatgtattttcttcttagaacttagataggctatgtgttctacaaacaccaagcaaatcccttgtattttcatttataggttctaatatttttttcctcactgttttaggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaacttagataaaaaacactttaagactcttctattcacattgaaataaagaattatctagatgataattcagataattcagtttgttcatagaattactttcttatcactctttttctactactttttctcaaatacctctctaatccaagaggcacttccaagaaattccacacattccttatatcccttttttgcttgtctagcaaagcttgtttgtatatatgcaccccattgtaaagcaggtatgcaggtatgtgggtgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgtaatgatttggaccaaaaagtattttgctgaaatactcaggtaattgagatagcaatggttttatggcatgaattatccaaaaaaatatcagaattacttattattctgtgatttcattagctcattaatgtttaactcacagattgggcatcaccatctagaatttcagtttaagggaggcctgcgcaaagctagttttatttcttaaaggataacagtcatacatagaatactaggaaagccaatattctatttaaaaataaacttctgatgcattttcattcttagcagaaaggtaaatgcttgagaaagcttgagtcaaatttgttaaaagaattttgagttctataaatccaaaaatctgaaacctgaatttatttaaatttataatcctttattttttaataccgtgccattttccacaaaggatttgtggttggtatataattctttaaagatacctggatcagtgtaaaaaaaaaaaaaaaaaggcacctgtcattgttttgctgttccatttacaattttcaccaggtgatttcttcttcacaaaaggtgagtaaaaatttccaatgtgcactcttctttgggggacacacatggtcattctaagcgagggatctattctatatttgttttgatttctctcgataaaaagaactatgtttcagtcttactatcactgtgtggtatctagatattatgagagatgctaaacttacctggaagggatagggccggggccattagaaaaaagatcatgcagtaaatggactttgagcatggccctaaaagatgagtagagtttaaaagctgtggagtgcaca
